United States Patent 8,067,671 (METHODS FOR GENETIC CONTROL OF PLANT PEST INFESTATION AND COMPOSITIONS THEREOF) - sequence listing, part 21

SEQ ID NO: 24706 - DNA, 1730 bp, Heterodera glycines
  misc_feature (1646)..(1646): n is a, c, g, or t
  misc_feature (1670)..(1670): n is a, c, g, or t
  misc_feature (1713)..(1713): n is a, c, g, or t
agtcggcgatcagcagaagaagaaacgaaatgaaagactgatcaagcaaaggaagagcataccgtaaagagaggaagagcatactgtaaagaaaggaagaaatactgtaaagagaggaagagatactgtaaagaaaggaagacatactgtaaagagaggaagagcatactggaaagaaaggaagacatactgtaaagagaggaagacatactgtaaagagaggaagagcatactgtaaagataggaagagatactgtagcgagaggaagagatagtgtagaggaacgagaaaaatgtaaatgcggaacatttaaaaatatgacatcaaaaaatatttattgaccgaagaaaagttccgattcaatggaaatcacaaatttaatggtcaaagaattaaaaagttcggtgaaaggggtaattaatcagtaattattaaattattattttcaacaacgcttttcttcagctgctccaccaaaagttggcctttttcgcaactttcgtcccacctttaaaagagggaaaagcattttgaaaggctttttcagcgtggtttcaatttgctcgctttttgcgtccttttaataaaattgagcaccatttactccacggggccggcaaattgacggacggacgccgacggagacgcaaaagacggcacacttggcaaatgccgaacagccgttccgcggacggatcggtgaaagagttcaaaggcacgacgacgaaattggcacgccagcgaaaataggcactaagagagaaaaaggagaacgaaattggccatttgaaaggcatcgaacaaatatttatcggtgtttttcatcagtgaggacaaatggtgggccaaatgcgcaacggaagcgaagtcatcgacggcaatgaacgaatttggtggcaaaaggtgttgggccaaggaacggcggagaatgaccggcacggagagagtgccgaggcctaccaaaagcaacgggacggactaattgtaaggcaaaacggaaggaaaagagcacaaggatggacggcacggaaaatgggcaaaaaaggcaccaaaggacaaaaggaaaaggaaaaagcgaaaaggaaaaagcgaaaaggacaaaaggaaaaagcaaaaaggaaaagcctaaaaggacaaaagcaaaaggaaaaagcgaaaaggaaaagcctaaaaggacaaaaggaaaagcgaaaaggaaaagcctaaaaggacaaaaggaaaagcctaaaaggacaaaaggaaaagactaaaaggacaaaaggaaaagcctaaaaggacaaaaggaaaagcctaaaaggacaaaaggaaaagactaaaaggacaaaaggaaaagcctaaaaggacaaaaggaaaagactaaaaggacaaaaggaaaagcctaaaaggacaaaaggaaaagcctaaaaggacaaaaggaaaagcctaaaaggacaaaaggaaaagcctaaaaggacaaaaggaaaagactaaaaggacaaaaggaaaagcctaaaaggacaaaaggaaaagcctaaaaggacaaaaggaaaagcctataaggacaaaaggaaaagacttaaaggacaaaaggaaaagactaaaaggacaaaaggaaaagcctaaaaggacaaaaggaaaagactaaaaggacaaaaggaaaagcctnaaaggacaaaaggaaaagcctaanaggacaaaaggaaaagcctaaaaggacaaaaggaaaagcctanaaagacaaaaggaaaag

SEQ ID NO: 24707 - DNA, 974 bp, Heterodera glycines
tcgacaaatacaatttaaaaagaataaaaaatatttcctctagagctcaatttttaattatgcacaagaacaacgaacctagaggtttaattaatttgaccagaaaaaatattagcttaataaattgtaacaaaaaattaaaaccaaaactgataaagccatgaaacgctgatatggattatttaattaaatgggaggactaaaccttaaactcgaaaacatgtaacagagttatgttctatgtaaataaaaatattaaattagcaatgacattcaaaaattaaacatagctacaaacaaagctgttaattataattatatactaaaagtccttaaaaacataaaattaatagattgtttaatttattaatttaaacaaagcaatgatattatttgctatataaatgaaattctatgagtagtaaaaacaatttagtcttgcacacacacgaatcggttaaaaataaatgacacattttaaatcttacaaattctaagcacatgtatcggctaacataacatactaatataaaattataaggaaaatgctttaaatgattgataaatttcaagtgaacccaaataaaaggacttatggagagggatttggaccaaaatagttaattagcgcatggtattgacaaatcaagcatctgcacaaatcatcaagtaattaacctacactttaaacaaataaatttaaaattttgtgacccatattatacgctgtaagtagctatgtacggagatatcgaatacaataagaaaacaaagaatttggtattcaagggattaaaaataaattaataatttaaaataattgaatattaaaaaaggaaaacgaaaggagaggaaaatagaaacataaatgatcattttaaaccttttaaatttttattaggagtttaaattgaaaaagtcataacgaccacaaattaaataaaaaatgagttatttattagtaaattattaaa

SEQ ID NO: 24708 - DNA, 1273 bp, Heterodera glycines
  misc_feature (13)..(13): n is a, c, g, or t
  misc_feature (97)..(98): n is a, c, g, or t
  misc_feature (149)..(150): n is a, c, g, or t
ttttcgtcacatncgatttttcaaaaaataattttttgatgaaaatatttttttatgactatagtaattatttttaatgatttcttaaattttattnntaaatggagaaacaaaaaaatcaatgcaaaaagacgcacaaaattcttgcnnccggggaggggggtcggtcgtgttccttaaaattttttccgacgccgtgccctccactcacagaaaaccttaaaaaatagctcaacaaaattacaatttcgaaaatttcttctagtcctgctcttataacatatttgcgattttcataaaaaagaaccgtcctaatgtcattcataaaagattgtcaataataactaccgtgagattaagaagaaatttaaagctagcaaagaaattaaattaaaatcactcgctactttaaataactaatcccaagctaaaatgtaagattaagcaatttttcatttttaattcagtccttaaattttgaaaaaagcttgggcccgattgggactccggtctaattcacgggacactctgttgcttttttgaaacctatctataaggccgagcacgggccttttagaattgatgtctctaatcaaaatctttaaattattttatttaataaacttcaattaaattaataaataatgaaatatttgcacgacaggaaagccaatttattattctcgttacaagattatttgattcgggcaaataaattcaaaataaatttatgaaatcgttaccaatattttttaataaaactttaggcgcttcatattcaaccctgtaaaatattataaaaaatttacagttaatttatcaatgaatatctgaattaatttacataatctattttataaccatcctttttttcgctaacataaaaagaattcggatttaaaagatttattccgctaatatttaaaaaattaacattgtaaatatttttaatgcgttttactaaaataaaactgaatatatagaggaaaataattacataaacttaattttaattatcgaaataacattgttaatgaaatattttgatttcaccaaatttatcaaataataaaaattgtgtaaattcaattggattaacaacagggctggacgtaattacggattacgtattacggattacggaaattacggcctttttgcagttacggattacggattacgggttacggatttttggatttttccgtaattttgatacgtaactggctttttagattatttttcgagacgatttcttgcaagattatttttt

SEQ ID NO: 24709 - DNA, 1326 bp, Heterodera glycines
  misc_feature (936)..(936): n is a, c, g, or t
  misc_feature (950)..(950): n is a, c, g, or t
atgcggaaaaacatacttttattaaattctttcagcactttcataaaggaaattgcaaaatcttttgtcacagtcaagtcgtttttgaaatttatttatgtaacatacatcatggttatagcaacaacggtcaactatatttaaatattaagctaaacaattttctcctttataaccttgtttaaaattgcaaaaccatatcacgggtgctatcaaacaagaatcgaataatgaagttccacaatatgtacaacaatatttttttggaatttataaaggaaaagcatttataatattaaggattataccaactcgtacttttcatgtgtaataagatttgaaaagtcaaacgcgctactatccgtgttcactctaaatcttaatgttttggagtagtacgagttggcttaatttagttagttggcttttgcctgatattaatactgacacctaaatgtgaaagaaaaaattaatttatcttttgtggttgtttgatgagttcaaaatgttggccatgaaaataaagaaatattgatggtgaagacttcttctgactcacgttcgaaagcttaaaattcataataaaacaaatattttacaaagtctaaccgaagtttccaaatctgctggtgaatacatttgccaacgataaacttctttcttaacgagctcacatacaataacatttattcgaaacattttgctgactgctgctaaatctaaattgctcatccattcttcgatttcatgagcaccagcagcgggtgcaattgctttttcgatatgctcttgaatgctttctatactatcaaaaagtactgaaataaaagttatgtttttgataaatttataaaattcgtaatacttacaccaccattcattttcatttacatttaaatgtgcgtgttctgatatatagcttcttccaaaaactcnaataacatctctcncgaatttctgtgtgattccattcacttccggttaaagccagagagatgctacgccacccaagtttccatcaccaattatttcttttatttctccaggtccatattcatgagatgaaaattcaaattcatttgcataaattatattttctgtgcctaagatatttaatttattttttaactgattttctattttaaaattactaaaggtgtaaagccaagtttcgcacatttcttcccgttgatcttcattaagaggattaaataaaaaactcattgtagtacgcgccattgttttaatattctcgactatacgagaaaaaattttaatttttaatataaaaattattttatttaaaatttaattatgaattatttt

SEQ ID NO: 24710 - DNA, 1266 bp, Heterodera glycines
agcgagccatgccgcgcaagggcgacgtggcacgcgccttttgaagcggcgacgccaattgggaggaaggcgccgagcgatgaaagggcccgacggcacttgccaaggacgaacgtggcggaaagaacggacggacagagtccgctagcaacaaaccgcgcgaagcaaacggtcgatgtctgttcattttggtcaaatgattcgtatggaagcaaaagattgtcaaaggacagatggaaaggaaaggaacgaaagccaaatactaaattggaagtgaaaggggaggggaatcggagaagaaaaaatttaaaatttgtattttggggaggggggggcgacgtgggaaatttggtggggtgggggggaaggaggggaagggaggggactttgttgcgttttggttgacatggatattgttgtggtggaaaggatggcattggccggtcaatacaaatggggggggggagttaaggggtattagtggtccttcaaatggcaatgtgtgtttaataaacaatgaatgaccacggaaagggggggggacaatgggaaagttgccgagtgattagtgggaatggacaattttggcactttttggggaaagtgagtgagtgggtgggtatttgcggatgttccttttggagagagtttcaaaaattaattggcacattctctcccccgtcccttcggttattggcacttttaagagtttcgtctgctgaagaataaagcggaacattgttgctgtttttaaatttacataacacgcaaatgggaaactgagaagagttaaaatggatggacattttggcactccgcccaatgccaatgctttaatattcaaatgctaatgcattttttatgtttgtcaatgctttccccgcgcccgcttcccatcacagagaaccaaaccttcgttataatcgtcgaaaacgttgtaatatctgttggtgatgccaacgcttgatcttcgtctaattacgcgcgggtaataatgacggaaattttcgactcggacgcgcggactctccaaaaccatcgaaaggaagaggcgaataattaacggggcaaaaggagaaacggaaaacgaaggggaggataaagcggataaagggatggataaagcggaaaaaggggaaacaattgggcaaagattggagttttgaagagggcatggacagagggacgacagctgaggataattcggcctggggagaattcgacaccttccgtcgacagatggaccacggcggggagggggggggg

SEQ ID NO: 24711 - DNA, 1810 bp, Heterodera glycines
atttcaaaatatttttataaatatacattaagcatttttatttccacgaaatttcaaataaactttgcgcaggctttggatcgccatgaaacggtggccagcgatgggctcatttggcacgcggtacagcggcctctcaaaacaatcgtggtccgatggaagccgcgtgaactacggtagggcggagagagacgcgaccatctcaggccctggcggaccgtgggcaccattacagccaagttggtggtgtttggcaattcaacaattatatttctggcataatcgttgccactttcaattattttaaggttacaacgtaacgcccattgagacttgtgtgatgagttacgcattcagtgattattttggtaatttcggactcgagcacataggattaattaattatttaaatgagaatttcatctgtctcggtcgagtttggcattccaatctcgaaccaagaaggcattttcggtctcgaatttaccaaatttcccctacagtaaacccgtacaagttgacggaagaacgactgtacaacaaatggaatgacattgtgtgtgggcccgagacggtgacctttatcccgggggacgggcggcacatcaccggcacattggtgcaaggattgtgcaagaagcgggcggtgccgtgcaaagatggcgaggaggaggaagaggtggaagaatagcatgataaaaaggaggaggaagacaaaaatgtaatcgaatggacaggaacaggaaaatttgattaaaaaatgaccaaattttgtgataagtgtaccaaaactgcgactttttcttaaatgctggcacaaaaattgtattaacgagattccgattgaattttttgaaatttcaaatacagaatgccaaatattaattgaataaatttagaataattaaatgaaagtcaggttatttttctcccaactccaattcaaaatgtcattaaaaacaaatgcgggcaaaaatgagtagcgttttactagaaaattttcaatagtcagtcactctctcttccccaacccctttctctctctctctttctctttcgctctcttttattctctccttttctctatgttctattaacacaattttttatgtcctcatgttctctatcttgcatctctctttttctctctcactctgtttctttcccttcctccttttatctctctctatttctctctctttcctcactctatctctctctgactctctgttgctattttttgccagcaaaatgacacacaaaacgacgcccatccatcgcaccattggcatttaatcaattaaataattgttgattatttatcattttgttaactttctttaaatctaagcaaattttttgttttctcctattgtaaccttaatcaaattttgagctttcgaaaggagaccaaaaattcgatttcgaaaattacaattttcaaatttcacaaaggaaatgagctgaaagtcatcagcagggttgcaaaaaatatgcaatgcatttttttcctggattctacatagtctaattagtaagaaaaacatattctttttggtatttgcatataaaactaaggacttttatttgcatatttcatccatattttgccatttttcgtcaagattttccggtttgaaaatcattacgaaaaactttgattatgcctaaaattatttccaaatctgatggatgcgcgaaataggtcaacagtgagcttcactgacgaaaatcttgagaaatttttgtttgaaattacaaaaacaaccgataaaatttatgaggaataaaattttttaattaatttgca

SEQ ID NO: 24712 - DNA, 1116 bp, Heterodera glycines
tctagagtcaccatcgccgattctcgcattttgactcttttttgctttttggtctcagccgcacttattacgcttctaagccgggaggaggtggcgcgagagcgtacgccccgtccgcgtcccaacagaaagcggaattattcagagagagcggcaaaagggagcaaaagccacaagtgcagccacggctttcacaaatgaattcggatgcttacagaagcaattcggcagagcgagcgggtaattataatgccatcagttaattatgacaaatgggagaaaggagaacttattttaagattttaaatgcttgttaattgagttaagggcaaaaagcattaattaattattggttttatggccacatgcccttttaggttaagacattcaaatgattagccaaattagcgccccacccctaaagtgccattctcgtaattcaccatcggcaggtgtcaccgtcgtgccaattcgtcgcgacttcactctcccaactcgtcgctccgagtggagaacggccgaatggaaattgcggagtccaaacatgagccaatttgaggacagtaaaaaggaaggcgaagagttcaccagttttgaccgtgctgtccgctacaaccatcagcgaacggtttggccaccgcccccgaggggcccttttgggtacggcagaaaaacggagagaatggaaatggcgggggcaccgcggagggtcagcggcaacctttactacccggactcggcaacagcggaatattcgtcgaggaaaagccatcaggtggaacgcaaaacaagaattaagcaaaccaaaaaaatattagacgggaagcgatgcggcgtacagagaacatttccaaaacggacaccaacaacggcaccaccgagcacatcgagaatggcactcgggagcagaaaacgaccattacggaacaaggcggaatggcacggaacagtatcaacactatggaagagagaaagaggggacagcagcagggagggcggggtactatcagcagcgattccgggaggagagggacatgcgcagaatgggacggggcggaagcggacaggccgagtactcaaatgggtggggcggcgagtcggcgcaccattacgcgg

SEQ ID NO: 24713 - DNA, 1316 bp, Heterodera glycines
  misc_feature (70)..(70): n is a, c, g, or t
  misc_feature (84)..(84): n is a, c, g, or t
atttaagtaaaccaagttaaacattcagaaaagaaaagggaaaataaagacgaggacggagaaggacatncggaagaaggagancagagggaccaaaagcaggtgaaggggggaagaaaggggactgaaaaaggggaggaaggaaaaagaaagcggggggagagaaataaggggatttgaaggagggcgcattcgccctggggcgcgcgtcccgtttggatactgactgatcagcccacccgaccccttcccctgaaaaggaccatctccggcacctttttggtcttccgcccatccgtcccgcctatccgccgcccctcgcgccgtccgccgttctcttccgctcgccgttgtccctctcttccccgtgctcttccgcttcgtcctcttccgcctcccacgtcgaattggtgccttcctcctttgtgccccctccttttctccctccccctgcccactatcttttccctccgccgccctttcactccctttttcccactcccccaccaattcactcactgatgcttcagcaacagcatcagttcaaaagaacagcagaaggacgaggagagggatcagcattaacaagtgaatggggggggaagggatttgggatttgaaagataatggatgaattaattagtgaattaattaatgaatgatccgaaaagtgagaaaatggcctagagggagaattaagctatttaaacatttcctttcgctttccccggtagtgccaatgtgtaattttgcggttgcaatgaatgccgcgatgaacgcggctgcttttgcagcaatgaaacacaacgattcagcaacggcatttacaacaaatatggcgaataaaatggacaacggcaaaaataaccaaaaggagggcggcaaattcgacaatatccgccgccattcgccacccaatcggtcggcaattcttcagataaacgaattgcaaaattatttttagcccatttcatgcgaattttgttcaaaatgaattggacgaccaaaggaccgatcagtcaaaagtttcgtcaattgtcgtctctgtgaattcgccaatgtccgatcggatattctcagattcgactttggtaagtttctcccccctaaattcatttgtgaatttgttgctcttttactcagatgtctccgaatggcgaaggaaattgcgccaatagcgaaagatcatccgccagtccaaagcaacgcaaaagcgacagcagtggaagcggcgccaaaggcggaactttgacatgcgccgtctgtggggacgtgtacaagcggcagacattacggtaaagagaacgaagaaacgg

SEQ ID NO: 24714 - DNA, 862 bp, Heterodera glycines
  misc_feature (73)..(73): n is a, c, g, or t
  misc_feature (82)..(82): n is a, c, g, or t
ccataaatctggcgcatcgttcggggggactgcccgaaacaaaaaataaatcgatttttcaagtgtccgttgngggtactcnaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaaataaaagtacaggctatagggaagctattcccgaaggattcggtctccccataaatctggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaagattcggtctccccataaatctgggcgcatcggttcggggggactgccccgaaaac

SEQ ID NO: 24715 - DNA, 1383 bp, Heterodera glycines
  misc_feature (146)..(146): n is a, c, g, or t
gcttttattatgcaattagaacatgcaattaacgaaataattgaataattatttcatttcttttggacgtctttctccaggctgaccgactcggatcggccggcgccgacgaagtcaatgccgacggccaatacctgggggaattnagcagttgcagttgattggataattaattaattagttagttcgggaaacgaatgaaaaaacatgttcaattcagcaaaaaaattataaaaacaatgatgccgcataattttttcacctcggggaagacttgcaactcccaacatatttgggattggaatggcgattcacgaatacccttttatccttttccaccccctcctattgttgtccaacttttccactgattttgatcctgatcggaaagtttccactcagattgactgattgaactccttcttgattgatctgatcaaccgatcactgtctctcattcggatcagatcatccagtaaataaatgaaggcattaatgtgcataattagggggtgataaatgataattgataaattggaaagaatggacggctaatgaaaaggcagtcaccaaaataagaatgtaaaagagattaacagaatgaaatgccgaaatccaattaaacattagtgcatgaagtcgatttttcaaagtaaaattggtccataaaaaagttaatgtgcttttatgcttttagtaattactgttcattttttgaaattttatttttcactttttgaaggaatgaattttcggcaaattgcaaaattcacacaccaattcagaaaggaaacgcctcgtattaataatatagaaaataatttagtgcgcaaaatgattatgctttatgcagattttgtgagaaaaaaatttgaggaatatttaaattttactcattttgccaaattcagaagaaatttgttgagctccgatcaatttattctttgatttttttgtgcgacagaacaatccaacgaaattttgcacaaatacaaaaataacattgagaattgtccgatcagcgttttggaaatgccaaaatgatcgggaaaatggtgagagacgaaaggacagcagcctcgtggatcatcagtgggggttcttctccaattctcgatggtcgactgatcacactcagtagccgggggcggtgcggggcggtgggcaatggtctgaaagtcgaacaattttagaaaaatggattttggatttgctaaatccactcacagcattggccgctggatccctgtgctccgggctgtccgggctcgccgttgcctccggggttgccgggttggccggggcttccgccgtcgccagggtatccttgcgggccggggtttccaggctggccgggatgtcacgttctcgccgggatgtccg

SEQ ID NO: 24716 - DNA, 1586 bp, Heterodera glycines
ggcgatggtgcccggtggtcacggaaaggcgaagcggacacttttgagcaatcatttgcggacgatggtggtcaaaagcatatggcattgaaggtggtggcaaaaactgttgttcgttatgccgagatggggcaaaaatttgagttggaattgggcacggtgagtagtccgatgatgaagagcagcattttggcatgggaatggccacacactgaatgaaagttttaatcgcaaaatttactaaaaaaattttctctggcgggctgtaaaatgacaaaatttattcaaaaaagtaacaaaattaggctagatcaatattagataaaaagttttaaaatccaaaattcttgtcaaaaaatagaaaaataaatttaaaaggatttttgatgaaattttcattaaaaaacctaaaaattggagccctattgctaacctgatgctgaagagaggctgttaaagtttgaattggaatttgagactgtgctgaatggtcagcagccgatgaggagggcattggcacggaacttgttattggcaatagcacactagcagaaggcatccgcggcgaagaaacagttggcgatggcacaatgtttgatggcacgaactgttgttgtcgagtacggtagaagagacggcacagtaggcacatcacaatgacaacgattatcaaaatgcaaaagagcaagataatgatgccaacatcgaacccggaagagactgttgttggcgaagcgattgttaccaatgatggagtcaatggctgtgttggagccggtgccaccaaaacatttgtagggctcatttttggcgattgtgacgggctgtgaattgattaatgacaataaagttcgaatggcatccgagactgataattagcatctatttcgaaaatgttatagcacgtttaaagcgagagaaggtcctatgcttaagccttttattgatataatttctagatttgtcagcccgtgttttagtgtttcataattttttggactaaatttattatgtaaaaaaataactttaacttactggccagtcacaattatgccctctttcttcttttctactttgatggaaaaactaagtccaaataaaagaatgattaaaacggaaggtgcaagcacccttaaaattttaatctttttatcgcgattgtttttaagaagaaaagggataaataaaaaataaaagtacaaaaattctgtggtaaatagggatacgatttaaagatagaagagagagagagagagagagagagagagagacagaatgagagagacagaataagagagagagcgaggagcgagagagagaaagaacgagcgagagaagagagagagagagagagcgagagagagagttttaagcattaatagtcaattaattaaactcaaaaagcgacccgaaaatttagtacaagaaaattaaaaattaatttgataaaagttttaactaaactttctaattctaaacagataaaaagaatccgacaattaattcaccacataattaattaaatggataggcctaaaattttaaaggaaatgcaattagaattttattattcgaaaaatgataaa

SEQ ID NO: 24717 - DNA, 1533 bp, Heterodera glycines
aggaaatttttaaccaataaataatttaatattatcaacattaattaataattagggcgttttttattgttaatatatattttaatccaaaaacgttctattttctttcttcgggcccttaattctccaaaaatctccaaattattaaagtcacttaaattttggaaaaatttgaaaacaaaataggtcatttgttgggcaaaatcataattggggcaaaatcattaaaaaaagaatcaaaataaataatatttgtcgtccccttgctttagcaacattggcattggcattgtgccacgatcaatgtcattggacacatgggttggtcgctatccggaaacatacggctatttcgatggtggcaaaatttatggacacaacaccggcttcttcgatggatttcccgagttttcaagcggtgacgtcgtcggatgtggtgtcgattgtgcgacccatgagatcatttacacaaagaacggagaacgattgagtgagtgtgggaaacgaagagaaagagaaaaagggggagagaaagtgaggtggtaaagagagtaggacgagatagagagagaaaagacgaagaaaagggagaaaagaaagagagaatgattttgtttaaatattaaaaaaaaaattaatgataatttttttttaaatttttaaacaattttctataaattttcaattaacaaaatatttttagttagcgaaaaagccatatttaacgtgttgtgtaaacaatagtagtgattcgatgttcgaaaccaaaaattcaacaaaaccgagactcgacccacccgagactcaagagatagagaccgaaaaaatacgagacccgagactttttaacaaattttttgttcacttcaaaatcgattaaaactttcaataaatttttaggttatgtcaaaaaatgctattttagattgtggactgattttataatattttaaagaaattaagatccgctgaaaaaatcgtgcttttttaatgagagtgctaagaaaatacgaaaaattttaaccctccttatctgacaattttagtaaaataaaaataaaaactacttggagatcaatcatttcaataaaatggttaattaattccatatttcttaaataaaagacgtagccccccagaccctttggcttcgggagagactacttgaaatttttattggaaagcagaaattttgtttaaaactttttcttaaggaaaatggattgcttttcagaaatttattaatttttgtcaaaaaaatttctttttcttttttttgctttcgcgggggagcctttagccccctcagcccctctccaccctgataagcttttgcgttaatttccaccggaatttttaattttgtttttcaaaccttttcttcttccttatgagcatttttaacgtcaattaagttcataaatatgttttttttttgttgccggtggtgatggaaagcggctgtgttgacagccaatgggaaattttgaaagtttaatgagttaagttaattgatttaacccgaaaattttg

SEQ ID NO: 24718 - DNA, 2091 bp, Heterodera glycines
cgagaatggccccgtcgacgtgtcccttccgcgcgctctctaattttgtgtgccggtggtactcgccgaatttggcaccctatcagcggcaaggcaaacgcaccagtggctagaaaacctacagtctgtgcaaatcaaaatgttgatttgtgtggggagacatttaaaaagtgccaatcgaagggacgaaataatggccaaattacacttggaaaaaatgatggccattttggaggaggaaaatgatgaaaccgatgggccattcaaaggcattctgatcaatcacagtgagtgatcggtttattatcgctgttttgggaccaaagtttcctttcttagtgaagtgaaaaaataatcgttttaatatatttttttctgattcttataaatattcggaaaaagtaaattcagaaaaaatgaaggggaaaagtaccataaaagcgaatgttttccccaaaattattggacaataaatgacaaattaaaaacatttagaagaatcattcggcacaattctcaacaaggacggtattcaaaagatcaatgaatggctaaaccttgaagtaaataaaatacaaaacaaatacattaaaacaaagtaattataaaagagctaggatttttaagcgcaatcacccaaagaatagaccacaaaactcgaaaaataggaaaaataaacaccagcgtaaactttacagttttaatatgtttcaaaataaatttaaaaatccggcccgtctttaattattttattattacaaatttagacaaaatatttttcgttgaatgaaaagttttcatcggctgcttcttcttccgatgacgaacaaagattcaaagatgcgaattatgatgaacaaattgatgaagataatgagagtaataatccaaatgatagtgataaattagagaggaacaaacaaaaagaaatggaaaattcgagggaaaatttaaaaaatgaaaattttgaaatgaattattttatgggtggacaaaatcaggaagaaaataaatgcaaaaaagaaaagtgcaaatggagcaaaaaagaaagtgaaaaaatggaaaaagaaaagagaaacgggaaaaaagagacggaaagggaggaaaatagtgaagaaaaagaagaaaaagaaaacaaagggatggaaaggaaagaaaatagcgaacaaataggagagaaacaaaatgaaaagaaaagatggcgagaaaaggaagaaataaaaaggaaaaaattgctggaaaaaaaggaaagagaaaaagaagaaagaagtaaaaaatggatggaaaaagaaaaagaggaaagagtgatcaaacggaagaaaaacttaagaaaatcagaaaaaggagaaaattatcgctttttgtcaaaagaaagtgttaaagcaatgaagcaaataaaaattgaaaattattcaggtgaatattaaataaattatgtaaaatataattgttaagatttattaaatgaaaaatatttggccaaattttacgacaaatttttattaaatgaattggaagaagagaattgtgtgatatatttgcatgttgcagcatttgttagagcgattcattcaaaatcaaaattcatcaaaattcgaacaaaaaatcacgaaacgaaaatttcgaaaagttttgaggaaaaatggcgcacttttgcaaaaaatgcaatgccaaccgaaggcgaacaaatggaaattgaattgcaaaagttattttcattggacatcgcacttaatgagataatatatgggtaattaatgtataataattaactaattaatgataattattaattgtattaagaccaattgaacaaaaacaaatggaaaaagcaattgaaatgcttgaggaaaagcgaaagggcaaaagcaaaaacaaattgggaacatataaaaggggggaaattgaaaacattttagagcaattgcacctccaaatttttgggattttatgtgctaaaaaattgacaaattttgtggaaaatgaaaaaataataatcggagaaagaattaaactaattatgagaaaagaaaatggagaaaaagaattttaaaaaaatacgtagctgaaatggaaacaatgctaaaacag

SEQ ID NO: 24719 - DNA, 977 bp, Heterodera glycines
gccgtgatagttaagcaaagtctgtgatgacgatccgtcgacagaagcggcggagaaagatggaaatggacctacaatttgaaaatatttgttaagttttaattgaatcaccagcacgattataaaaattggagccgtgatagttaagcaaagtctgtgatgacgatccggcgacagaagcggcggagaaagatggaaatggacctacaatttgaaaatatttgttaagttttaattgaatcaccagcacgattataaaaattggagccgtgatagttaagcaaagtctgtgatgacgatccggcgacagaagcggcggagaaagatggaaatggacctacaatttgaaaatatttgttaagttttaggtgaatcaccgcacgtagaaaaatgacccggaatggtgttccaaaactgcaccgccaatgagggaggttcggcgttagctggtgggaatgtggcaaaatgagtaccttaaatttgaaagcatttggtaaacattggatcgaaatgcaatagaataaaatgaccgcggccgttccccggatgcattcctctggaatacgggttgaaccgttgatactgatggccgacattttctgaaaacggttgggatgtatacaaaattagacgcagtaaatatttattttaatggacactgcctggcagaaatcgacacgcttcacaatatttataaaaattttcagattttaaataagccatacgaatttgccgtcgaagtttcgtattttctcctcgaagctgcgcgatttgtccaccttgacgggcgatttctcccctaagctgcgcgatttgttgttgttgttgggcgataagttcactttgtccggcgataagttcgtcttgctgcgaaatccgcgttcgtagcgctccaatttccaaacggtggaaattttgaatggaatcaagcgctgacgtgaatgctccaagcacttaaacaaaaggaattttgtctt

SEQ ID NO: 24720 - DNA, 1641 bp, Heterodera glycines
aaaaatttcgggtcgattcttaggagtttattttttgaaaacatttttaggtcgattcttaggggtttattttttgaaaaatttttaaatcgattcttagggggtatatttttcgtttttattgcatttctgttaataattttggtcaacatgccaaaataggttaaaatatgtttttaaaattttttttagtaaaaacctagaaaatatgtgctaataactcaaaaagtagcttaacaacccccccccccccgcccaaaaaacatgtttttcgtgcatttcagatcatagggagctcaggaaaaaaggtaaaaacttaaaaatattagccctactaatgatacaaatacaaactgagttatgactaatacttcactttcaatgtttctttggacttttataaatatttctttgctttttaggctaaatttcattagtattataaatatatctaaatataaatcaatttagaatatatatttggtgaaattcgctgtcgaaagatctattttgggttagtaggcgaaaggttcgatttttggttagtagtcgaaataaacgtccgattttgggttagtaggcgaaatgtcgaataggcgaaatgtcagtaggcgagaagtccagaggcgaaatgtccgtacacccttttttctgccccctttttgagcaaagtctgatcagacgttttcagtcgagattttaaatttaaattttacaaattttaattatcttgagtcaagactttattccatcattgtatgacttcatttttggctcacatttttaatacactcgtgttttttaaaaatttatcggtgctgtcgaaatcactctttgtcgagtccacaatgtcgaaatcaatccctgtcgagatctatcattgtcgaaatcacctggcacgtgctggaacatatccctgggtggcaacatcaaagggttgcaccacttaaatgggtgcgggaaagcccaaaataagttaattaattaaaacataccatttttaaaactttgtactataaaaaattagatcatagcaatcaatgattaatttatttggctacttatgccataaggattaagcgttttgtcaaaatttccatttgtgcttttttgagtaatgcccattttgggtagttttgtagtaacgacccaacaccaataaaagcatgtattcctatattaaataaaaattagacaagaaatttgatttatttaaatttgtttataaaaaagttgaacatttccaaataattaatttatttgcatttaaaaatgaaaaaaaaagttaaaaaccccaaaaatttgtttcatatggttcatcagcagctcattaattcattcattctccgtcaatcctgcttaaatattccgccaaattcatcccatttacacagcatttttcaaattcttcgctcgctgcaattgcgtgactgcccaaaaagatggagtggcgacgccatggactgctaagcacctataaagcaaagatttattaattatacaataaattacacttaaattatgggatcatgcatttcaaatgtgccaaattatttcgattaaataatttgtaacatcgatttagcaattttttttgttttttattaaagaaaaatcgcagaaatgtcattaacttactac

SEQ ID NO: 24721 - DNA, 1482 bp, Heterodera glycines
  misc_feature (1104)..(1104): n is a, c, g, or t
  misc_feature (1396)..(1397): n is a, c, g, or t
  misc_feature (1429)..(1429): n is a, c, g, or t
  misc_feature (1467)..(1467): n is a, c, g, or t
ttttctcaggttggactcctttgatgtacgccgcctatttgggccatcgcgaactgtgccaactgttggttctgaggggggccgacgtggaggcagccaacgagcgcaatcaaacgggggtaaatgagaggaaaatggaggagggggggggggggggacggaccctgagggaaagcccaattaatgttgtaatactaaatgccgaaatgtaacagattatgttggcagcctcttgtggtgccattgacgtggtaagtttttgctgagagacaaaagagaatttgggagtaggcaaaagttgcgagagtctcgagtccgacaaatttctcattgtttttttttggtctcagtctcgattctcggattaatttgtccgtctccgtaaaaatcttttctcgcacatcctggaatgcccagaataatcaaaattaaatgataattaaaatacattttgtacaattgtcccgccaagaaaggttcgaattttgttggacttttctgccgattgcaacagacaagaccaatacggacggagcagtctccattatgctgtgtaaaaatagttattatgttttaataacaaatattggtagaggccaggaattttgaaaaaaggtccggaagtctcgagaaaatgccggtgggaccccggccccattcggatatcattaaatatattcaaatttcatatattaattatggaaattgaatttagaaaatattatcatgccccggtggtacagttactgcttgaaaacggcgcagacccaaacttaccgggtgaaaaataattttggttgagattttctgtaattaatttgtcagatttcaatgactcgacgccgcttttggccgcgtgtgaaaatggagacgaaaaaattttggccttccttttggaaaaggtaaaaccacagatcattttgaataaatatattttttaatttttttttttttgacgggatgataatgataattaattaatgataagcggatgggaaatatttaatttttgtgtctttcgaatgaattatccatcaaattcaataagcagtagagctcgattgaacgacctggaaatgaagctttttcgctcctaacttgggncctgagttttttcattttcgacctggatttcctagacaaaaatccaggaaagccccaggcctttgtccatggccagcaggtcgtgctctaacaatgactgcttctctcatttgtggtgtttgttctctgttaagaaaggcgacccttcccgttgcaacaaacaaggccaaaacgcattcacaataaatgcggacgaaaaactgcaaattgttctgaaggtgaggtgaaaagcaattgggaaacgtttaaaagggaaggaaaagcatttccattggccagaaatatcggaaannaggattcggagttggacaaggtgctttgccangtggaaatgcagaaatattggccgaattttgcgagggngcggaatttggtagg

SEQ ID NO: 24722 - DNA, 1602 bp, Heterodera glycines
  misc_feature (1585)..(1585): n is a, c, g, or t
cgtgagaaaatcttgacgccgaaatttaaaaaaaattgttccctgaaattttcaagaaaaaaatcttggaaaatttttataataaatatctaattacgcataattggattataaattttagcatccataattcggaatgcgacgcagcaacagctcgcaaatgttggccctgccgcgcaaactgctgacatggacatagtgcatgtggtcacttcgcagcaacggcagacgcaacattatgcgactccaccgatggtacaaagatacaacatgtggcattttgcgatatttactaatgctttttcatttcccgtaaagccgctctacacgccctatttgtacgccgccatggcaccgccccatccccaatacaatccatacgcgtattactacgcccccgttgccgctccttccgccgcttcgtcatcgtcctccgctgtgccgccgttcctccaccatccgccaccgccccatgtccatttgatgccggcaccgccaccgcctccggcaatgtttgcgccattgtcggcaaattccgcagccggcacttctgctgccaacaacacagcgtcgaccagcaattacaacaacgccacgggcacttccaattttgggtttgactgtccgcccgtcgactccaatccgtcccgttggtccgccgaaacgctgtgccggtggctgactgcggccggactcgccgactgtgcccagcgtttgctcaatgaggtgggaaggcggagggcacggaaacattattgggttgctgttttggcaaggacaatccaagctttggaccgaagaatttcacaaccttttcaggaagtggacggcgcctgccttttgctctttacgcccatcaactaccaaaatttgggactgaaattgggtccaatggtgagtacggttgtttttttgaactgaataccaaacattttttgtaaattaaggtaaaacttcagcaaatagcggaggtaaatgaatgaaaaaattttgattaattttcatttgtttttgtttacagtatctgcgacagttcacatttgccgacaaccgctaaaaagattaaaaattggagaaaaacagttttttggacgcttttttttgttaattcaaaattttctgaatttagcactttcattttatttatttaccgataaagaatttgccatcggaaggtcggtgaccattttttgcttatttgttagactgattttatgtgttattctaatatagaaaaatttggctccaataagatttatacgtcctacatatcaatcgaaaatgataacaaacaaagaacaactggtattgtggttcttaatttaaaagttcgaactccgtgaaagaattttaacaaaaagttgaaattttttataatatccattgaaatcaatcaaattttgccaagttgagaatttttatcgaattagcattgttttgcatcaaaataaattgatgttagatcaattcacagctttttaccccgcaacaatgcatattttgaaaaaaattcaactttgttgagttcggtctggggttcagaatcgggtaaatcagaacaggttcgcaatcaccaactcaatgngaaaccataaacaaatt

SEQ ID NO: 24723 - DNA, 828 bp, Heterodera glycines
cccctccctttctttccccccattatttattattcatccatcgcccattgagtggagaaatgggagaacaaaataacaacggtcgggcagacagaagaaagacaaaatagattttattatacttttatacgaaagaaattttgaaatgccaaaggcaaaaaaaggaggaaaaaagaggcgaaggaattgtcgccactttcaaagtgttaattaattgtggcgcctgactcattaaatatgtccatttgacaaatggggggagggcatgggcatttacagttgcattggcattggcactcgtgacaatgtcaaaaaaacggatagaacaaacaaataaatggggaaaaagtgtggggaaaaggggggggggtataggcaaattgggaccaaaatatgcaaaaatgttcaatagcaaatgaattgctttttctataaatatttcccattaaatattatttgtcttaattaatgattttttcggttaaataaaacggaaaaagcatttgaagagaaagggaattaaaaagaacattttgctagggcagtgaagtgcttttaatttctcttttaatttctaaatttgtttttgtccattcgattggattaattgggggaaaaagcgaattttgaggggaacgaacgaaagcaaaggcaaatggcaattccacttgaattgcgcggacaatttgggatttttgaaagagggcgacggaatttgagagaccaaaaaccaaattaaattgctaaagaataaatggggaggggggggggggttctaaacttagtaggagattgccatttttctcgcttatttctcgactttcttta

SEQ ID NO: 24724 - DNA, 948 bp, Heterodera glycines
taaaattattgcccttagtacgtaattgccttccgttttgccctttatttgatataactgctgtgtttctacgacgttaagatgtttatgctcgaaaaatgaaatatttttattctccggtatgttttttgttaatttttctttttttgctactgtaattttaatgtttggagccatggtagtagttataatattggcagttgcttttattattttctgttgggtcttcagaggtggcacagttaatatagctacagtcggtttgggtatagtatttaccattattgttgtaacatttagcacattttgagatgaggtggaatttgagttgaccaaaatagactcattttgttgtttttgtacatttttctgttttaattgtgctttttgtttaaacggtcttcccttttttgagacttccactttttccattatttcccttttttgcttctttgacaaagaatgaattaatataaaaacatcgtttgacattttgtacgcttcttccggtaccccaataatcccttcacgctcctctgcggtttctttttcaaagaaaaaaacgctctgctcactctcaaccacaattgcatcatccgtaatttctgaaaaaaaatcgcccactggaaaatgagtagcccaataattttcgcttggttccggtatttcccataaaaatgtttgtctttgcatttcttcccaaccattatatgggttgagtttgtacccaaacgaagttattaatgaaaagtccaaaattcccccttgtcctttctccaaataatcattaactgtggtttcacaacgttcacctgcccatgcatattcaattttctcgggtttttcagtggcccacaaattttcgctaaaccttttcatttgagtgtccattgcatttttaaattttcggcatctttccgcaccgacacccttcataactttttcctg

SEQ ID NO: 24725 - DNA, 1577 bp, Heterodera glycines
taggtgccgatcgcccagcaagcactcggtccaaccatcatcccgcaagtcactcaagcacgcggtcgggccgtcctgcttgctctacgtgccgctctactcactcccgcaacgtctcccactctgttccgaggtcgatcgcgcatttgatgggccgattttacattgaaatcactctcgtcataccgattccctttttatccaaatgtatcctaaattattaatatataaactcgatcttttgtaaatataatcgccatgatttgtactaaaatgcagtagttattccaaaatgttggtagttataacaaaatctttataaacatatctgagtctgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgtaatgaaatgtgacatttaaattatgggcgcaccgttgggaattgaacccaaacttcgggttattagagacccgcgtgctacccattccaccacggtgcccccaacatcaccgctgttatttgagcaaataaagaaagaaaaaaaatatgtgatttattcttcatcattgctgatttcgttgtcaaggacaagcaaaagtgcattattttcggggtcaataacaaatgaacgcatccaaacagcacatctatttcgacgcatcaaccattcccgagcgcgatgttaaatgataaaaatgttggcgaggaagttccgtggcattcaaggatcccaaagtaaatccaatctggcacacaacgcatctttcatcattttggagcatttgttggttcacttccaggttgggcaaaatactatcgcattgttgagcgagttagaccccctccaatctcaaaagtaggagtgggttcccttcttcttcgacgtagttgggtccgaattggttgggttctaattgcaacggactggtttcgtctcacggttggcggtgccccctaatattaaacacacacgtacacgtgtcgctcaaaatttattgaaaaataaaatatttggtgaaggaagtttttttttcttttgttttctcaaccatttctcaccgattcaacgggattttcacgattagtggttccacgtccgagaattgttgttgtttcgacggcgccgaacaaccggttggttctttaaaagaactgcattgaagtatttaataaaccataatgcttaccggtgtt

SEQ ID NO: 24726 - DNA, 1234 bp, Heterodera glycines
  misc_feature (1186)..(1186): n is a, c, g, or t
agtgagagagcaaatgcttttgttgctgcgccaggttctttctgaaccatgtgacgcgtaatggtaaggtgtccaactcgttgaaagcaggtgtcaatgacaccaatcggacgatgcgcactgctcgaatatgcggctaaacgaaagcgaattgacagtgaggctattttaatgtgaacaaaattgtacactcatttagttcaattcttttgcatttcatacaaagtgaatttgtgtaattcattggcgtgctgatcaccattttgcgccaagtcccttttttgccacgagcatttctttccgtcccatttgaatcatgtcctgctttctgagtgtggcacataaaaattgaacacaccgaaacagttttaaaaagcataccaacgagtacacttcgaagtcgcaagaaaagtctggagaaagtcccgaaatagagataagatgcgagaattcgatgaagccacttctgatgccctggtcacttgaagacaaagttgtgtgaaagacatgttcgccgcatctgatcagcacaatgaagtaatagagactggtgtctgaagagaatgacttttaattcaagcgaagtaatcagcggtttttactcgaatggttttgggtaaatttggcaatgtattcacgggacaatctgatggcaattgcggaaaaagtcaacgtccctttcaggtcagtttctgttgccaaatagcgaccatttatgacattttcacgctctatcaacaaagcctttcgtctctccgtcgatatcagcaaagcccgttgagcatcaatctgaacaggcaataagacaaatttgaataatggccttcttatacttcttcacggctccctaggaatcgctcattttgtctacaaaaagccaatgcccttgatgcttgacagatttggtcttgttgaacgacgacggcctcatgaagtcgtttcaaaatagtctccctttccatatttgatctctgtgccatttgttgatttgcacttccatcgaaatgatcaatttttgtgtccgtttgtttcgaaatcactcccctttccaacgaaagatcggctctctgacgtttttccggaagcattgacaatgaatctaaaattgagaatttcttattgttttccactaaaaaattgatgccatattcaatccttgagaacagcagtccttttttctcattanaagtaagccactgaaaaatttactgaccatgtgatgaactgaatgctc

SEQ ID NO: 24727 - DNA, 1295 bp, Heterodera glycines
cagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttag

SEQ ID NO: 24728 - DNA, 1354 bp, Heterodera glycines
catatatatgtttcaaaaacaaaccccaaaatacgtgctaaaaacccccaaaaaagccaaaatatttgccaaaaactgaaaaaaactgcttaataaatacatgaattttgcataaaagtctcattttcatccatttcgctagcaaaatgcttattttcggattttttttctttaaaagttaaattttgccataaaaataaaaaaatcatgaaaaaggtcaaaaaataaaaaattttgaaaacttttaattttaccaagaatttgggtgccaaaaaaggaattttcttaaaaaaaaaattcaaaatattaaaaaaaatcgccaaaatatgtgctaaaaactgtcaaaccataaaaatatgtttttattcgccaaaagctcaaaatatgtttttatacatgctaaaaactcgctttcatgcgatggcatatgcgcaaaaaaacatgtaaaaacatataaatccgttccctggttattgaatatatattttttattgtgacgacgcgtttctagccaaattatagaaaatatttgttcattaatatctttatattttcataagggacattttgaactcattagacagcgacaaaaagttaaattggttttttctattaaatttccttgaaagttgcaaggaaattttgtggtacctattgtgccacctcacaattttatccatgtatgatagtgcctataacagggtttcggtctcaaaattttgaaaatcctcatttcagccataaaaatcctcatttgccactaaaatacctcaaaaaatactcatttggaatgaaaaatcctcatttttttaaacatcataaaattgcgaacaaatcagttaactgtcatatttttcgcttgaaacaatcaaattcatcaatttcttgtcatttataagcattttatggaagtctgagcacgaaagatccaaattgcacttcatctcttaaatttttttgcttttaaattgctctttttgtggcgcggtttcccaaaaaactttttgggaatattggggaagggggtccggcagtgccgataggcgctgccggaaaaaatttggaattttgagtgcgatttgttaacaaatttgtcaaaaaaatgattttggctgagcatttttcgaaaaaatgtttttaagatttgaagaaaaagttcgaatattttgccaaatatacctaatttaaaaaaaaaaatcatgcgtttttgtcacttttttatcaaaaaatcacaaaaatcctcaaatttctcaaaagaccacaaaaatacgcaaatcctcatttttcaaaaaaatcctgtttgaccctctaaaagaccacaaaatgagtaaaaatactcagatatcgaaaccct

SEQ ID NO: 24729 - DNA, 1167 bp, Heterodera glycines
aaaaaataattatgaaattaatttttgcaaaaaataaataaattagtgaacctttaaaaattcataggaaatttaaattcataggtactactgctaaatcaacgcagagacgcctttccttgacctttttaggctcctgcaaaacctggtgcacttctgatcactactcgtaaaattatgagtgattgaattttcactaaaaagttaagcctaaactttttgactgtttaaaaagtaattaaaaattttaaaaaattttaatcatcagagagccttatttaacttgtaaatagaatttggtgcgtttcagagcatttctgaaaaaaataattatgaattaatttttcaaaaaattggaaaagtacgcaatattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttggcttgtttaaagaggaattaaaaattttaaaaattttattcatcttcctttttgatagaaaaagcatcagagagccttatttaacatgtaaataaaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgtaaaattatgagtgattgaattttcactaaaaagttaagcctaaactttttggcctgcttaaaaagtaattaaaaattttaaaaatttttaatcatcttcccttttgagaaaaagcatcattatttaacttgtaaatagaatttggtgcgtttaagagcactttctgaaaaaaataattatgaattaattttgcaaaaaattggaaaagtacgcaaaattgcaatgtctaaaatttttaaagaaatattatgggacagttaaataattatatgaataagcattcttctcagctgttaccctgcaaatcctggtgcgcttctgagcactactcgaaaaatgag

SEQ ID NO: 24730 - DNA, 1284 bp, Heterodera glycines
  misc_feature (220)..(220): n is a, c, g, or t
ttttattttttttctatctcttctctgaaaggagttataacaatttttcacaccagttttgcattaccagacacattctaaaatttctaattagtatagtagtccaagcctattattatttttttgactagtctctgaatggggttatcccagttttagtatcctttttgaaaaacaaaaaattttaataactgatacggtagcccaacatccattgccncaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctctctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaaggagtataaaaatttttcacaacagttttgcatttaacagacacattctaaaatttctaattagtatagtagtccacctctattattattttttgtgtatactctctgagtggggatatcc

SEQ ID NO: 24731 - DNA, 1528 bp, Heterodera glycines
  misc_feature (1494)..(1494): n is a, c, g, or t
ctctctctctctctctttatctctctctcactctctctccccctctttctctctctatctctctctctatctctctttatctctctctctctctctctctctttatctctacaccaggggtgggcgtaattacggattacggaaattatggcctttttggaccccgtcatgatggattacggcttacggatttttgggatttttcagtaattttaatccgtaattgggtttttggattatttttcgagacgatttcctgcaagattatttttttataaaacaattttttctgtttttatttaaagggctaccgtatttcatgatttatttaagaaaaaattcacttattcttgataatttgtagtattattaaggctacaccctaatttgttttagcctacaaagtagggcgtattttgtaaatttaaaactaatgtagttttggtaactttttgctccatttgcttgtttatatgcgtggtctagtgggttgtgctcttggtattttattcatttttgcgttgatcagttccccttcaagtagttatttttcttctaattttcaaatttattcttttttcggtgtgaattaaatcacaattttaacaattaaaatcataaaatattgttatttttggactaaatttgttcacaaattgcaattaaaaattcaaaattttccccggcggcacctatcggcaccgccggcaccccaaacctcatttttataaaatgttggctcaaaaccgcaaaaattcggacattttttgggctaaatctgttaacaaattgcactcaaattttcaaaattttgccaggcggcgcctatcgacaccgccggagttccaaaattccctttattttttaaattgctcaaaaaccgcgaaaacaaattgcgtttttggattgattatggtacctaattgaatcataattaaaaaaacaaacaaaaatttgttaagaaatacgcaaaaaatttttttaaccatttttaagcgaataagaaaattttttgaaaaaagtctcgggtttttggtctcggggttttgggcttggtctcgagtcccggggtcgagtctcggtctcggtctcgagtcccgggaaatttttggtctcggacagcactaccattttgacgcaaaatcttttacaaattgcacttaaatcttcaaaattttcctctatggcgtctatccgcactttcggtcacgccaaatctttttaatatgcttttaaattgcttataaaattattgaatttttaaaataaaaatttgaaaattattttaaaaaaattaaaattttgaaaattacggattacgggttacggattacggaaaattacggggttttttgacccccgtcatgacggattacggaattccgtaattgagaaaatcgctgtaattacggattacggatttccgtaattgaaaatccagttacgcccagtcctactctacactctcctcctccaacccaccttaactagagntcggaaatttcaaatttttggatcccgcccgcta

SEQ ID NO: 24732 - DNA, 1408 bp, Heterodera glycines
gggacgggggtgaggccaaaaaacctgtcccgcccccggcgggggcgggggtgacggggtccgaaccctattaattatagacacaaaaagaaattccgcacttttgaattaaactgatgattttctccactcacaaatcagtgatcagttggccaactcttgcattattcgtcgactattacttttaattatcatgctgtcttttaaactcttttgatattgagccgtcggtcttcgaatcgaaacgacggctctccgtctgacctaaaaaacaaaaatattttcaactgatcgacggaagcgcgaagtgatcaaaatgccaatttttgtcaaattcaaatttagagaggaatatatcgtcgtcctattttatatgggtgattacaagggcgtagggctgacgccccccccccccgaaacccaaaaagtaaaaaattttcagtaaatttttttgaaatttttaagcaattttcttaacaaaattgcattaaaatactcaaaaattttcccggcggcgcctaccggcaccgccggattttagcgttttggcatctaaaatagtttacaacctattttggcatttttcgaatttttagcacctattttgggatgttcccagaaatttcatagtaaaaatgcaataaaaacaaaaatacaccccctaagaatcgatcccaaaaaatttaaaaaatatacccctaaaaattgaccaaaatttcagaaaatattcccctaagaaatgaaaaattaattttctcaaaaattcgtctccaaaatttatttatttattttcttgaccagttgcaattgtgcgggcgaaattgataaaaaattagtcacattttgaattttttacataaaaacactggatttttcaatttttaacacctattttggcctttttggggctttttagcacctattttgcacttttttagcacctattttagtacctattttaggatttttagcacccaaaaatcccagccctaattatatgtgcatggctgatcgctgtctgtattgcaacataaatataaagacaaaaaacaaatcgggaagcatccgttgttttcctcggtcgtttcgtaatcgcctacggtggagaaaaaaaagaaaaatggcaaatacataaaaaataaaatcaatggcataaaaataaaacaccaatgcattcaaaaaagaaaaaacattttcattattttttgccattttatacaagggcgtagccagacccttggctttgggggggggggtgaagtcaaaaattcgattattaggggtgtatttttcttttttcagtcgatttttaggggtgtatttttcttttttcagtcgatttttaggggtgtatttttgttttttttaaatcccgaattagggggtgtattttacaaaaattttcgcc

SEQ ID NO: 24733 - DNA, 514 bp, Heterodera glycines
taatcccatcggctggtgctgctcgaaaatcagctactctgccgttcccacatttcatcttcttccaccaattttcgcacaaaagaactgagtcgtgtgttgcctttgagatgtgagttccaaatgccgtgccatccctcaaccaaacaacaattttaaataatacgcactcgaaaacctcgaatgaattatttgtgcgaccgtgaccctcagcgatacggtcgaccatattccacagaggggggaaaagagcattgcatacaaatgtattatagttcatatgaaattataattagttcatatcacttgcgtttttgaatttattttaatttttgataggtaaattttttttaaaaattatttctcactgacgaaatcacttactgacgaaatcacttctgacgaaatcacttctgacgaaatcaaccactgacgaaatcacttctgacgaaatcacttctgacgaaatcaaccactgacgaaatcacttctgacgaaatcacatggcaccgat

SEQ ID NO: 24734 - DNA, 1024 bp, Heterodera glycines
aataccgcgcgatttgcacggcgaatttgcaattgtccagcagtgtttagcatttttgttgtggacgccattttacgattggaccggtataaaatgatgaaaaacgaaatgccactgattgtgttcaaaatggcacaaaatgcccgccagccgaggtacaattggacggaagtgccaagaatgcatccaaaaatttcacattctaatcttttaaaaatgaattattaggaccaatcggtaaataaatttaaatttctatctaaacatgccaatcttttggttttcattaaaaattttaattttactattttataaaataagtgagaaataaatatattggtgatatttctgataaattgttgatgatttcattaattgtggatgaattattaataaattaaacaaactttcacttataaattaaaccatttttattttaaaaatttgcaagaaaattggagtttgcgacggaacaattaagaaaattaagaaacaatttaagtggtagcatttttttattactacaatttataatacggacgaataaaaatatttcggtatttttacgtactaattccaaaagttttctttatttcttttccatttcttatatcatattatcactcatttttggattttctctttttatttgcgaataaactttcatttttcccattttttcattctccgttattcttttcttgctaatgccaaattgtttcttccatctgttaattgttccatggcttactcggattttcttacaaatttcggcataattttgtttccattctttttcagaatattttcttttttgcttatattcatttgacattttaataaatttttgcacaattacaattttttcttcatcactttttgatttatagcttttatgtatttgtttttgaagaccaaattctttaatccatttataaattttgtgtcgatttgtcccccaatttcttcgctatttttgagttaattttatcccattcttttgttgagtattttcttccttttt

SEQ ID NO: 24735 - DNA, 1864 bp, Heterodera glycines
tcaaaaaattattcgaattctccaattttgtttccataattcgcgaatgttattcggtatcataatgccaaaccaaaacgaattcgttataagatattcttttctggactttgacttggtctctcaatatcgaagcttttctctccgcaatttctaaaacgcttataccaaaccctagatttttggttccgatcggtttcagaaaaaatcccttgtggtgcaaacatatttcacatttcacttcataattttttgagttctgcacggatcgagaccgggataagaccattggaaagagcagctcgagctctacaagaagctatagaaagaaaaaatcgacatttcagggacttttcagaaatcatgtttaattccccaatggggccccattttgggtcctcagctacagccccatgcttctcccaattttaagtcttggatttgtcaaataaattaaagatttcgaattaataataaaaaattctattataaatttttttttgtagagggaaaaattctgaaccaaactactattttgaaacccaatcaaaactgggaaaaaatttgaagtcaaaaaattattcgaattctccaattttgtttccataatttccgaatgttattcggtatcataatgccaaaccaaacgaattcgttttaagatattcttttctggacttgacttggtttctcaatatcgaagcttttttctccgcaatttctaaaacgcttataccaaaccctagatttttggttccgatgggtttcagaaaaaatcccttgtggtgcaaacatatttcacatttcacttcataactttttgagttctgcacggatcgagaccgggatatgaccattggaaagagcagctcgagctctacaagaagctatggaaagaaaaaatcgacatttcagggacttttcagaaatcatgtttaattccccaatggggccccattttgggtcctcagctacagccccatgcttctcccaattgtggcgaaaacaatatttcacatttcacttcataactttttgagttctgcacggatcgagaccgggataagaccattggaaagagcagctcgagctctacaagaagctatagaaagaaaaaatcgacatttcagggacttttcagaaatcatgtttaattccccaatggggccccattttgggtcctcagctacagccccatgcttctcccaattttaagtcttggatttgtcaaataaattaaagatttcgaattaataataaaaaattctattataaatttttttttgtagagggaaaaattctgaaccaaactactattttaaaacccaatcaaaactgggaaaaaatttgaagtcaaaaaattaatcgaattctccaattttgtttccataatttccgaatgttattcggtatcataaagccaaaccaaaacgaattcgttttaagctattcttttctggacttgacttggtttctcaatatcgaagcttttttctccgcaatttctaaaacgcttataccaaaccctagatttttggttccgatcggtttcagaaaaaatcccttgtggtgcaaacatatttcacatttcacttcataactttttgagttctgcacggatcgagaccgggataagaccattggaaagagcagctcgagctctacaagaagctatggaaagaaaaaatcgacatttcagggacttttcagaaatcatgtttaattccccaatggggccccattttgggtcctcagctacagccccatgcttctcccaattgtggcgaaaacaatatttcacatttcacttcataactttttgagagaaggacggatcgagaccgggataagaccatggaaagag

SEQ ID NO: 24736 - DNA, 996 bp, Heterodera glycines
ttttctgctgtaacgaccagcaaccaccgttttttctcgccaacaatgttcttttactgtgcgttcgcaaaccgccaaccatcatggtcaaatgaccaggttagatgaccatgaacccgtggttgctcatttgctacgggtaaaccatgatggttgtggttatttaaccataaccaccttctttgactacggccccagctaataagggaaaaatgcattttttggcaagacttgagaaagcaaaaagtatatttccaaaacaatattttcataatagtcttatcattttctgatttttcctcccgtcactaattacgcctttgtcgccaataagggggaaataattgtggcgattactccgccaaaatcgaaatcacgcactttgaatagtcagccccttcggctttttgggctcctccgctgtgtcctccagcacatgttcctgccgcactgccggttccgttgtttcaccattttccgcttcggtcgccgttgctggcggtgccaattccgcgacgaccactcgcgtgccaaagtcagtgttgccctccggcggcggcgtcgacgacaccaaaaacaatggcaaattggcgtccaaatggccttgggcaattgcgcgacgaatgactaaaataactcatgccaatacaccacggagatgcttaatctaacgctaacaaataaaactagagcaataagaacccataaaatcagccaacacggacttttttaataatttccaatctcggttttttacttcaaaactcaaacttaattaattattcgtttatttcgtatattgcttaattttcgatatagataaattcaaataaaaaataattttaatatttgtttaaaaatgaccaatcgggtttagttttagttagtttggaatgttcagattataaataaaaattaaaaatattgatgtacttgtaaaataagatcgtttttcgtagaataaaaaggaaagtcaaaaaatacaataattaattt

SEQ ID NO: 24737 - DNA, 2032 bp, Heterodera glycines
  misc_feature (1944)..(1945): n is a, c, g, or t
  misc_feature (1955)..(1956): n is a, c, g, or t
  misc_feature (2007)..(2007): n is a, c, g, or t
cagacatttttcaacatatgttactcctctgaatatcccttaaatattttagataaagttttctttaatatgaaatcttggtttagattaattattattttgtatttttattttacatttagagtcgaaattccgatttcagaaaaaaagtcgctctgattcttttaagtaattaattaaaaattgatttgaggtatttttcaggagtattttcaaaagaaaatttttacaagaaatttctataaattttcaaaagttctcaaaaatatgtataaaaaatatgcaaaatttgtcgaaatttggatttttgaggattaccaaaaatttccgaaaaaaatcttaaatatttataaaaatgaagattaagaaaaagtcaaatatgtagcatcagagatgaatatgattcgataattaaaattaatgattagtttgactaactgtatttatttttaaatctcacgtgctaaagataccgaaagaggccaacaggaaaattttcagtatttatgatttcctcaatttataaattgaataaattttcattcatcacattagtatgaataaaaaattttatcataattttcggaaaattaatttacataaaatcttatttataattttgtatatgatttttcacttttattcaaaaataattgttaccccatatcaaggtgatatttaataaatatgtttaatttattttaatctactaattttatattttaattagctatattccaaaacggaaaaccttaagccggaaaataataaatacaaaaataaaatattgttttttgtaaaaatataaagttgaactcttaaaaacaaagtgttccataaagaatcaattaaataataagattaagatacaataaaaaaccgaacaggcgttggagaatataatgagcatacttatttaccgcagtgaacgatttgtaaggatattgaaatttaaaaattaaaaaaatatttaattaacagaggtaaatttaattaataaagaaatttttacatatttagtcacataaaaagctatttaaataaatgaacgaatttaaaattaaatctattggatatcaggcaataaaaagaattatattcaagaattatagtaacttattataaaacaaattaaatgaataatttaagcaaacacctaaacaaaaacttaaaagaaaatcacataaattattttttaacaagtcttaataagcaatttaaaaaaatcgaagataatatttgttgtagaactcaaataaagccaaaatgaatcaatgctaaaaactacaagtacaaacattttctaattcagtttattttcaaccaatagcgtataaaattcccacaatacaccccaaagaatcgactaaaaatttttcaaaaaaatatccctaagtatcgctcctaaatttaaaaaaaatacacataaaaaatgaaatcaatctacaaaattttggccaataaccgaatatcagcagttcgtccccttccaacaaaattttatttgtattaagttgaatatttattcactgggccggtttggcattttacggcaaaaagagcaaaatttgtgtcttttcgaaaggtattttaataattataaaaagatttaataaaaatgaaatcatcaataaattaaataatgacattagcttatcgaataattgtcggaatttccattccgatcgccaatcaatgatcggcgaattaagagggagggcgccccttcaccaactccccccgccgcgcgacgggttttaaccgttccatccctctgtccctcttccattcaaattgttaattgtttttctgtgttcctccttcgcaccgcgcacaaattaatcaacaattcattaaaccgcaacttttcgcccccgtccccaatttggcgaatgcgactccaaagaacgatgaacgcccaaatttcccgtttatcgccaattnntgtcattcgnntcatttgtgcactgtttttcatttcatggtacatttttcggccccatttcngtctgctcattttttgcacttttta

SEQ ID NO: 24738 - DNA, 1106 bp, Heterodera glycines
caaaaatatttcaccaaaagagtattttttaaatgcggccttccgccaattccataccaaaatcgattagaatacctgcaactgccaacacttgagaataggcgaaagctgtttgatctgttcatggcgcataaaattgtttatggccgaacagatctgaaactattatctatttttaatccctcaacgcgctttaacatccccttttacagatttaacacaaaatataaactgggcaaaatattcattccctttgctgggagggtaacaaaattgtggaataaacttgacaaagaactaataaaaacaaattccttgaatcaatttaaaacaaaacataaaaattcattagggtaataaccggaaaagcaaaaacagaattaatttttaagtgatttggcatttatactgtcgatctcaattgactttgacctcattttattaatatattttgattttatttttggtcatccatatatttatcacttactctacgacatattatctgaacagtcgtcagagtaagtggttttgcccttctgataactttttttttattcatgaataaataaatacgtaatgtgttttatgaatatatagtccatgaaagttctgcaaaaagcgagaagaatgtaaagcaaaaggcataaacccgtgatcaaaaaagagaacaaagttcaaaagcattgattagaattgaaaagcaaaaaaggcgaaagaagggagagaaagagagtgggattcattcgcaaaataacgttaatccgcgacaccgtatttccaggcgcgaagaatgtgctcaaacactcgttgcgcgacgtgtttagcaccgaattgcacaattttgcctttgacattggcatctttggaagagaaaaacaaaaacccccttttctccttcttcagcctgagcttaatgcctaaaaatggaatcatatggacattcttatgtttaattgccaaccaaatttcccatttgagcccactcgagtcggccttttgagttcggcgtatttcgggttccaagttgcattccaattacccgttagtttgtgttgccgagcctcaatgatgtgcctaagaatgaatgggttgtggtacacttt

SEQ ID NO: 24739 - DNA, 1127 bp, Heterodera glycines
cccccccccccccatcagaaagcccagctggtggaccagtgcaaattcgaatgtgaccaaattgcggtgcccggcggcgtgtatttggccgattggacattggccattctgtccgcccaacaccaaaccgttcacatggtcggcattgaccggcacagcgggcactttgtgccgttgatgcaaattgggcacagtgtgcttgccgacgaccagctgatcagcggggcggcacagctgatcagtgcgcggacggagcgctgcttcaccggtagcaaatgaaaatatattaaaatatttatctttaactaaattaaaaatgccgagagagggcagttgtatatatatacatcatctgtcattctttttttgtttgacaattctctttaaaaatttttgcggcactaataaaaaatataatctgagcctaaaaaatggattttgaagaccatttatcatacataaaaaagggggggggggtggggtcggaaaaattttttgcaaaggggggtcggccgccgatgaccttttttttttgcttttcaaaaagcgtctttcggcgcgctttttccaaaaaaatgtataccatttatgaaaacccccaaaattttggtatttcaaaatgaaatgcattaaatgtgcaaatttttagtcgttttatacttttttgacgtctcaaaaacaatttgtcatttgtcaatgctcttttattcgcacaccaattgttggcgagatcattttccgatcactttgcacctgatcaactcgttttagtttaatctaatcatttttcgaacaaatttccgtttcccattttttaattaaaatgtaattaatttatttttgctcttttttttgcagcattccgtcagcgttttctcacctttctgtacagagagttccaacggaagggccaaatccaacagtttttgcaccatttcgacctctttcgacatgtcaaaatgcgcaagctgcaatttgttgggcccgagctgctgctgattcgaatggagcagccgaagggcgacagtaaggggaaacgaaaacgattttcatgtcctagtggtctgtggcgttggccaccaaaatgagggagattgggttccagtccccttcacgttgctcgcaga

SEQ ID NO: 24740 - DNA, 1087 bp, Heterodera glycines
acaatgactatcattatagacaggacgattttgccactctcactagaaatcccaaacattttgctgcgaatggactcactcccttgctcccattgttcagacagagtcttaccgtgtcctcacttttaagttggaatgtgagttcactttctcttgcgaaattggcgtcgtaaaactggccaataaagtcagacacattcactagggcaaggtgaagaaaggaatggcgagcataagtcggtgccaatgacagattaaggctgaaaccgtcaatgcgattggcattcacctgtttgacctgagcatcgatttgatcaacttcataaagagaaccacgcacaaaaatgagctgtttgcggtattctgagcatggtgccagtctcgcgtcggagctcaaaatcattgtccttgggtcaataaatgccattcttttgttgtccttcactcggaatttaattggaattttgtcaaagcattcgaattcggagtccgctgagttcccaattttggcaaatttgtagtcatgtgcttgcaattcgatgcatggccacactttaatcaattcgggcccggccacttttgccaccagtttaccagattggaataattttctggcaaaagttgttggatctgagagaagtgccgtcgctgcccatcttctcgtctccaacatataatcacaaatcgatttaattgtctgagaaaaggaaagagtcagcatttctcttacttgttcatccaaatagcccaatttggagttcatttccgattcggtgacccaactttcaagtgatctcgtctttctgcttctctttgaggatttgttgctatcgtcggaaggcaagtcttgtacagcaaatccttcctccgattttatcaaattcagaccacatgagttgactttctttgtgttgttcaaaaatgtcaaacgaaaactgacctcatccgaaatccaaatattgtcaagttgtagtcctttccatgtgccaattttcgaaaattcacatgcacgagtagtgttggtgtcccacataagcaatgtcttgtcttccatctcacattggcctgccttgaattggcaattgtt

SEQ ID NO: 24741 - DNA, 934 bp, Heterodera glycines
acgcttgcgcaattgttcattttcggcacgcagtcgcgtcatttcgttgttgaagtcggttaattttttttgcgtagatttcaacagcttctccaccatgtccatccgtgtgaccttctcgttggattcatccagctcacgctgcaacactttgttgtgttcctccaacttcttcaccttgtccaacagttcctgtgaaagaaaatggaggattaaaatgcacaaagggaaggattggattatcaatgatcaatttgcatgttttttgatcagtgatcacgttgatcagagttaatgaactcaattttccaggttatttgatcaaaaccaatttgtaatatcagtataagtccaaattattcctatggtagcacgttcgaccacttaatcaagttcagtttgtgtttgtgttgttccccacctgcttctccttcatcaattggtccattcggcgacgcaaactgttgtccgccccggcaccgccgccctctccggcaccaaccgctgcacggattgcagaaagtgcgccagcagcaattgccccaggtacagtgccggacaaagttggcgggacaggagaacgcggctccccagcagctgaagtgtctgcagacaaagcggcggcggtggtttccagcgctgaagcggcggactgttcacggagacgcaccaattcctcgtttttgctcttcaaatcggcctaaaaatggaatttaaaaagaaaaaaaacttttaatttctaaaaaattgtccacctccaactccttcttctccaactccaatttgttgcgctcatcgcggaatttgcgtgcaaacgttttgacagccgacaattcggaagtgagcttgtcactcttcgttttcagttcagccaactcggtgctaaaatatttaaaaaatggtgccaaaataaatcattcaaaaaacaaaaacc

SEQ ID NO: 24742 - DNA, 1002 bp, Heterodera glycines
tttttcagtgtccgttgtggggtactcaaacaattatcggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaatatttaagaattaattttgcaaaaaataataaaacgaaagactcagattttcgaaaattttttgagcagctagctcg

SEQ ID NO: 24743 - DNA, 639 bp, Heterodera glycines
gtctgcagcaattcaaataaccactgatctgccccccgcctaccctcagaggtcaatgttttccctctgccctctcgaattttcatcccctcctctcttccctacccctgccggctaaccccaaagtccactcccaccaaagcggatcggcccgaccagtgctaatttgggatgctaaagcgccctgatgagctgggccggaccattattctccctccgccgattgtttgtgaatgatgaagctctctctcacacaccgcaagggtcccttccccccccccctcccctcccctccccccgttccaggctgatagtctgcccaaccaaataacctctcaaatttcccattaaatttaaaaaacgcgctgaaattaataacaaaatgaaaattttaaaaagaatttttaaagaatgaatgaaaggcaataaaaaaaacaactgcacattatgagacatcgaaaaatgaccacaatttccttacaattagcaaagagaaaaggacacagcccaattgagaagatgggtcaaccacaagcacataatctcacaagatcctcccttggacagcggagaaggtcaatagcaattggaatgatcgaatgagacgaccaaacaatgggaaagggggggggaggggga

SEQ ID NO: 24744 - DNA, 981 bp, Heterodera glycines
ttatgctaaatgatttacagttccttctggcgttttgacaatggaggaatttgtcggaatttatcagttccattgccatccaaacttttccggcgtttccgggctttatccgcttcaattttcaagccgtgggcgcatttctgaccggaagaaagggcgacttatgttggacattgaaaaattttctgaatttgcgcaattatctgctgggagttgcaagcgattcctcgaggactatgtgtacattgggggactcccgtggataataatggcaaaaataaatacgcaaattgaaagcactgaaaaatggatggactttttcctatggtgcattggtccaaaacaaggtcggattgaaatgtgaaattatgaacagggaacggatttatatgtttttacatatttttttgcgcatatgctatcgcatgaaaagctcaaaaatagcatttttacctgttttcctttcaaacagagcgtgttttagcattgtgctagcgaaattgataaaaaacgagacttttttgagaaattaacttattttttgaccagtttttcttcatgttttggcacatattttggcctttttggggtttttaggacatattttgagggtttttttggcacatatatatatgtacatatttggcgttttttagcacatataaatcgttccctgattatgaaatatttaattaaattaaaattttaaattatgaattatttattcacactatgacaataattagggtttcaaaaaattttcattttattataaactttttatttattgataaatagggcttccttttttaggcacaaaaaatcgcgaaataggcattaaaataggcaaataaaaattttgtattaacgtttttaggtaacaaaacacgttaaaacttaaatatttcaattgaaatgaaatataaaatattttaaagttttttttccaatatgaacaaatttttaaaccaaaaaattttt

SEQ ID NO: 24745 - DNA, 937 bp, Heterodera glycines
ctaacgacgaaggaaacgagaaaatgaagaagcgatgacaatgaatggcaccaccattccccaaaatttgtgagggagagaagagaattacgtggaaaatgccaaatattaattagtgagaggcacacaaccaatatgatgtaagtaataggaggggggggggaaatttgaaaggaaaaaaacgaaaattcgtgaaaattcgaagccttacccccgtaatgggaaagagaagagagctgtccttttaaaatttgaagaaatggcctcttcaaaaactgaacattttgctaaatggccaattgaaagcagagagggtagaggagagaaatttatgaaagactaaacaaaaaattcgaagaaaaaatacccctttgaaatttcaaaaaaaagttcataacccctccaatacgttccggggggatggatacaaacgacagatatttgttggctcattaggcaatggcccgttaattcgtcttaaaaatttggaagggccaaaaggaaggaccacgggaaaagagaacaaaggcaaaaagagttacataatgtcatatatatatgcatatgtatttgcacaaaaagtattctcttcgccatttttgtcaagcgtttgaaaatattaaaaattattaattattattaattatcccccacgggtgtccccccgcgttataaatggaaccaccaaaccagcaacaggggtagcagcaggaggggagaaagaataacagagatgaaaaaagtagaagaatgtgtccccccattcccccgccccgtcccaatgcaaacggaccccagaaaaatactggtatgtggatgggtaaataaaaaaatatttttagggcggggagtcccctgcccccccccccccccgggcgatgccggtgtgacccctcgagggttcgttgttcccaccttttaaggtgggcggcggggg

SEQ ID NO: 24746 - DNA, 838 bp, Heterodera glycines
atgccttttaataaaggcaagtttaaagataaaaatacttcctgaaaaatttatgcaatataaacaaatttcagtggtgcataaatcaatgccttttgttgtttttaatatcgcacgaatttctttcataacaattttttgaaagttactttcgtttcaaaaaaaacacattttttcattcgaaaaagcattatttttcggaaagacattctcaaataatataatagactagcgcaggcgcgctcgcttcgctcgcgcaccccgcgctagtcaaaatttaaaaagtttatcttattcctataaatgtttctcttcctctctttctctctctccctctctttcccccatccccctccctatctctttgtcgctcttttttcttctttctctctttctctctctctctctctcttccccactcttctccttctctgtttctccttttctctctttctccccccatccttttctatcttctctctaacttttttattctctctcacccttctctcttcctttctccatcttctccattttttcttctctcactcccatctcacatcctctctcccacctctctctattccccactctctcttttctctctctctctcgtattctcccacctctctctttctctttttcgccaagaggccatggtcaagcggaggcactgacatatacaacatcccaaagacatcaccggcaaaaacaaaatggggaggaggacagaggcgcgagcggaaaaaatatgagaggaaatctgaaaatgggggcaaatggacggaacgcggcaaaattattttccaaaaaccatcgaatttgggggaaaaaaaaa

SEQ ID NO: 24747 - DNA, 1210 bp, Heterodera glycines
  misc_feature (1151)..(1151): n is a, c, g, or t
  misc_feature (1174)..(1174): n is a, c, g, or t
  misc_feature (1195)..(1195): n is a, c, g, or t
aatcattcgtttcattgcgtcatcagctcgttaaacatcaattcattcgccattttactgtttctgttctcacagtccgcaaactaaaagcagcatttccctgtttcttctgtttcagccgatcagaatttgttgatgttgttttttgtatagttttttttgattttggcgatttttttggcatttatcgcatcggcggaaacattccaatgagtgcggcttcagcttcatcaacagttgcattttgtggcgaaaaaaggtgctgtctatagggtttcattttaattgttgaaaatataaattgataaaaattccaattgtgatttctgatcaaacatttttgtccattttataattttataatgtccaaaattagaaaatgtccttcttccttttactaatgttcttttttcgcttattttcacacaataactgacgaaaacacctttgcacgcaatttttttactaattgttaaaattaataataatcatttgacaaacctttttccccaatcaattacatttttattaaattcataacaaacaaattcaatttgtttaaatctaattatctaactaattactatttagtataagaaatcattatcataaaaatgaaaagatttataggtcaataatagtttcatcaatttgattttatttttcgatttatattttctataaatttatttgtgctaaatattttctttattttttcatcaaatggccccaaatttcgccttctcaatgctccgtcgaactgcttgaacagtcgaaacagcaaaggccgccaaaacatccggaacaacagccgacttcgtcctcctccccctcctcatcatcggcttaaaagcgatttaaatattatgaaacaataaattatttattatttttataagtgtttaattactagtaatgaataattaccactaattagtctaacaatttattaataattttttttttgggtctttcgttgacctgcagttgatgaattgaatgagtatgacggatttatggactggtaatgcgatgattgtggcagttctcaaatgcattttaataaataaaaaaaattaattaattttagggccatgtcatttaagcttttactcttatggatttgaaataaatggaaattcttttgttanatatcaattttttggcttttatnttgaatctaaaactaagattntcaaacacatattcc

SEQ ID NO: 24748 - DNA, 1491 bp, Heterodera glycines
  misc_feature (102)..(102): n is a, c, g, or t
taaaaaaaaattatcggtattaagcgtttttttgtgcagtcaaccccattttccgactcattttttagcaaatttttagttttgaactttctttagaagtancatagtcttgttagtaaaaaataatattgattttccactgttgttggattaaattacccccgcccctttttgtgtgtatccgtttcaccgtttgaatgcctttgtcaatgctcacatgcgatgccatcgtccatcacaggccggcatcgatggcgccaaaacgcctgctgaacagtccacaatttacattaaaaaattcgctgaaatttaaaattggacgctgatctgatttttttgggggaacaggcggagtccggcggtgccgaaaagtgccgtttttgagggaccggatcccactcactgcatggacggtaaaaaaacaaaaaaaaaatttgtcaaacatttttttatggataattatagaatctggccttctgttactttttctttttatgtttcaattgtatgtactacagtcatagtcatatgtttagcatcagtgctaataattggctaaaattttataaatttatccataaaatcttttaacagagaaaaatgccacgtatatgataccgatcgatagtatattcaagcggctttcaaattataccaaaaaggtgcaaatccattaccttcagctaatatgcgatcaggcaaattgtaccttggtaacccaacttttgatactgatcaaaaaattttttttataccaacttgatcagaccactccttcatggtgatctgaaaagccaaaaatggcttgaaacccggaaaattttcgaaaaaaattacaagaggtttgaggattttttttttggtaattttgagtaggcccattggaacgagcactgaattatctaccgaattgacttttgttttttttaattcagcacaatttggagcgcaaaaccgtgagagtttcaatgtttagatttattttggaattgacatttaaagttaaatcttcagcaaacattttaattaatttattcaattttacatttagataattgacttttttaaattttccagaaattaaattgtcagttttttataataattatgaagtttttgaatgaaaaagaaataataaaatataattaatcgtttaatttaatattattttgtatatattctttggcacttttagaacacaaatgctttttgttatttcaaaaacattttatctttttattatgctttacatgtcaactttttgccatttgtcatctgattaatcgtagaaaatgcactttaaataagttttttttcaaaataattttagtgttcatttgacggatggcagtggtggattcaaagaaatacaaattcatactttggcacaatgccatgccaataatggaccaaaagaaaatgtatttaagccttacggaattgaatttcgtctgactcggcaatgcggaaattgcgaggatgggtgaaaaa

SEQ ID NO: 24749 - DNA, 988 bp, Heterodera glycines
attgcaaatttgcccaccattttttaggttggcgttgtcgtcaaacatcgccataatccttttttgaggtgccaatgcctttgtctcatgtctcatgatttccttttcagtgcccgaattcaaaagttaggtttccgcatgtgcaaactgatgttcgaaatggaagtccgtgcccacatggattcggtggcggtccgtgcctcccccacggctgtcagttttctgaccgaattcaatgccaaactcgcggaacaacagcagggaaaggtcggtccgtacaattcatacatattcaattttgcataaatcaagcagaaccaaccaaacgaggaaaacgaccgtacggcattgcgcgaataccccaactattgggatcagaaacggattgaccggtccgtctattggtggttcagaccgatgaagagcaccagcggaacggacgcgataaacatgacgaaattgtcgaacaatttgcgcaaagcggcggaattgaagcggaaattttcggaaatggtttgtctgtccatttggtcgcccattgaggaaagctttcggttttctgccactttttaggccgaattttcaatccgtcactgtctgatcactgtggaagccggggttcgtgatgttacgcggccaatgattttgattgaaagttctgtcaccggtactgctcggaattggtccagcacattgactgcggtacgaactcacgcaaaatcatttctgataattccgttgaattttcagaaatgtgagactcatctgattgtctcctatttcaatgaattattcaacgtttgggagccggtcattgaacccgttttgcacaaggacaaaggctggcaaaactggaaattggcattgaaagtgctttctttcttccattagcttgtcacatacgtgtgcaagggggggggggggggtcatagaaaagggtcgtgcgtttcggcgatgcccccccccccctcccctaaggggggggggg

SEQ ID NO: 24750 - DNA, 867 bp, Heterodera glycines
tttttttttatgggcatgccctaaataaagaaatacaaaaaaaatcaaaaatgtttcaattttgtacaaaatgatgatgaaatcatgtgactatcacgcgaccccaatttttgcactcggggaaaaaatgaagcaagcaaaaaccacgtgttttgggcttctcagcttgaataattttctcgcccactcatccaaaggatgggaagtgaaatttggcaacaaaaaaaaggtggcattttttgttggccatttttgcatggaaataatggcactcttacatatacatatatgtccttttgtcagtttttttttacaaacttaccgatttttcagggttttccctgatttatttaagggggaggggagggaggtggggtatgttcaaagcacaatttgtactgtaagaaatgggtctaaaaattgtatcggtcaattttcaaatttatagaaattttcaaaagaaaaatcatccccgggcaagggcgtagccagagccttggcttcaggagggctgaagtcaaaaattcgatttctaggggtgtttttccgttttttgttaaactccaaattagtgggtgtattttacaaaatttttcgccgttttagccaaaaattactattttttgccattttgatctccattttacaaaaatatggtaaaatgggggtccggcggtgccgatagtcgccgccggaaaaattttttgagtattaacgcaattttgttaagaaaattgcttaaaatttcaaaaaaaaaattactgaaatttttttactttttaaatgctctagggatgggagccttaactccaaaaaaaaaatttcgatgaaaaacgtaattttgaggacttatgtagtcaaaaatcg

SEQ ID NO: 24751 - DNA, 1100 bp, Heterodera glycines
aaaaagtttagcaatgattcatcgcattttttaagcctagaaaaaacaccttcaaaacttttaacatttttttcgccggacgccaattcttgaccattgccgttaattttttagccttggtcgtcctttacatgctttaccttctgttcggtcgttgggctcagctggcgtgtaacatcaccggctttctctacccagcgtaatttaattttttcaattcggtattatataattaaaactgaaacacgcaaacaatttagttacatctcaataaaagcgattgaaagtcaccagaaggaggacgacacccaatggcttacctactgggtaacttcttttttcgtctcaattgcctcgagaattgatgcattccttcagattttggtgtttttttattcaaatcattatttaggtggtttttgcgctgcttaatgttgtggaattcttctccaacaccattctgtactacttccctttctattggttgatgaaggttctattaaatttttaattgtttttaccctaatataatttttttttcatcctcattactcttgcagtgtgctctgctgttgtggctgtacttgcccagcactttgggtgctcagctgttgtacacgcgcatcattcgtccgttccatcttcaacagcacaagaacattgacagcatgtacaacaaattggctgggggtgagccttttagcaaatgaaactacctaaatctccaaatttccttaatggttaatggtaccatgtgtcagagccaaataggaaaaaaagttaacaaaaaaaaacaaaattcagatttcgctgtaaaaattgaaaaagcattttttgcgggtcaactcattgttgggtcgaatttagtttatcggatcctttttctgtttttttcggtgccatttccaccggatttttcacattgaaaatttcccgctttgttggatcagtttattttggtacattttccccccttttcaggtgcacaaaaggcatacgaagagcacgtgaaagagacatgaacaatcgtcagaacaagaagatgaagaagtacactgggaggcatcacctctctctctgatttcgtatattacaattct

SEQ ID NO: 24752 - DNA, 1061 bp, Heterodera glycines
gttttcgcgcccctccgtcaccaaccaattcggaagcattgaatgccctgccccctggttcaattgaacttgaagaaatccgaaccgttttgaacgacttggttagtcgtgccgacccccctcgtactttccgttctaacccccctcacgcgtaaacacagaatttagatgaaaaagagaaagggtgctaaattacaattgtccgctttgaatagtattcgttcttatttaaatattgaccaaattctcgaaattaactcctcttcacattccacaaccccaggtgattcagaaaacgaaatggaagcctccctgagtctctcatccacaccccttaatcccataatcgtttcctcgttgcctcctgacactcttggccttaccactaattctggcactacgaattccccgccaatttgcaccgaaccaacccctgtcaccgacatttccccgtcaaattgtgaccacctcccttgctctgataattgcccaccaccttgcactaatcttgccaaacacaccgaacattctccacaaattgacaccgacatcaacgacgcctcgagtatgccaaaatgtccagcctctccgactttcgtcgtgttggtcgatgactcggcacacccctctgtcaacattggaccacccgaacaaatggcgaacacacccactcctgtcagtccaccggttgtttcactttctaacccaattcaggtcattaccggggtggtaggacataccaaggggaaacaaattcacacttttaaacccaagtgtcaaatcacacaatcacacccttctcgcacgcccactgttcactctaaactcggacacgcatcattggccacacacatgcacaatcacacttcccaaacaccggcacgcggacaaccgatgatggtcaaccgaacgcgaatcatggactcaggacgaatcgaacagctgtcttccgttaaagaatggaaggaatttgccaaactaggaaagcccgtgccgttgaaccaaattcgtttcacaaccaccgcttgtcccattcctccttttttggccgtctcatccaa

SEQ ID NO: 24753 - DNA, 415 bp, Heterodera glycines
gggaaaaaggtacaccatgggggaaagaggtccatccggggggaaggggttcaacaacgggggaagaggtacatccacgggggaagaggtccacccacgggggaagaggtacaacaacggggaaagaggtacaaccacgggggaagaggtacaaccagggggaagaggtacaacaccgggggaagaggtacacccacggggaagaggtacaacacgggggaagaggtacaaccacgggggaagaggtacaacaacgggggaagaggtacaaccacggggaagaggtacaaccacgggggaagaggtacaaccacggggaagaggtacaaccacgggggaagaggtacaacaacgggggaagaggtacaaccacggggaagaggtacaacaacgggggaagaggtacaaccacggg

SEQ ID NO: 24754 - DNA, 1389 bp, Heterodera glycines
agccatcgattatcattaaattaaattaatcccagtacctccctggaaaattcgcaaagaaattcatttgattattgagcgatttcaaattgtgtcttaagtagcaattaggtaccatgaaccttttaattctcttaagtaccgtattcatagggatttgacaaatccacgagggataaccgcttgaggcgtggaaatgaaagtttatatgaaaatttctgatttatattccaaaatctccgaatttgtcctccatgtttatgccgcctggattgtttttctccggcttagagcaaggccaaattgggcggcgcgggagccaaatgacgcttaggtggaggacgcgttgcagccgagcgttgccgcgtctttctaggaaagtgccatttgcggaggcggcacattgtcgggcaatgccgacggcgatggaataatggcacgggaatagaaagaagactcaataggaattttgaattttccaaccaaattcctttcacttcaattcgaattggggggaggatggagttcgaacgcacaatgataaagccaaacaatatttattttaaagtccgaggagatcgatgagcaatttgagaatcaatttagaaagaaaatttgggagacaaatttaagatgagaataatgagaagtgaaaatgaaaaaagtacaaaacataaattaaagaggtcaacaaacataaaataaatagagacaaaatgccatgataatttaaaattaaaacaaatatcttaattaaattaaaatctccaacaactccaacatattttagtatatttattttgttgcataatttattttcgaattaatttgatttttatttcattttataacttttcattaagaatgttattataccattctttcatggacaaaatccgtattttttgtcacaataattttaccaattttattttgattactttttgggaattaaatttttgtctctctcttaaatttggataagccaaaaaaaaaaattaaaaaactcattttttcgatatttttgaaacgaagcattcatccattttcatccatttcatttaattgtaatgtttttttcaaatgctttctttttccatccctccagcggcaacacgtcttttatctgatcggccaaggaatgcgaaaaaggatgggttggtcggtcggctggtggagaaatccttggccaataccgtacacacaacacccactacagtattcaaccgcaagtgcaaatttaactcttgacaaatatctttttttatgaattgtgtacatatgatttaacttttatcggaccaaaattacttttaaattttttaatgtgccgatttgtggggaatacacacactgatcaaatcacataacattacatcaaagagttta

SEQ ID NO: 24755 - DNA, 787 bp, Heterodera glycines
actagaacctttaataattgtacaaatttccaaaaatctcttaagttttatcttcaaactttgaactaaagacatttcgccaaattaattgtaattttcaaatttggcgttttttcacttgtgacatttagtcccgtttgtcactgcccaactagccaggccggggccgggattttgaaaatggaccgtggcggggtcccgggacagtcactcccgtttttccaggactctcccggtcccggtggtttatcataaaaaaacaaaggccggggccggaaatcccggaaaaatcccagcggttccacggtcccgtccaggctctaatattaatactcgttgaatattaatttaatcagctttgattcaattacatttattttggacgttcaacttggacccaacagaatttgccttacaatttcgaagcacagcaacaaaaaaaaaacagatatttccaattcaagtaaaaatactaattttgagcactcaaaggtggagggctttcattaatcactgttgcccttttagaaatgttcaatcaaataaattttgatcaaatgacgctaaaaagaaacgttgaagggtccgttgtacagcaatggacaaacgcaacaaaggtaaacattgaataaaaagtgggtaaaaatatccatcataggtcccagactcaaaattgcataaaaacactcataggttttcttaggtgctgaaaacgcctaaaccatcaaaaaacggcgcggcaaagcgtttaaaccggtgtttgaaccgatttaaaactcgaaaaatt

SEQ ID NO: 24756 - DNA, 1053 bp, Heterodera glycines
gtcgggaaaaacgtgggacattgggcggattgtgccgccatcccaaaaaagtaaattaaacaaatttttaaaacaaacaaattaactatattattaattgaaacaaatttaaaaaaaaaattattttaattgtttttgttaattactctaacgaaattttaaagttcaattttgggatttatcgaggcgtaaatttctaaggcgcagttcgtgtgtataaaatactaatgcgcttcatcagacattaattagggctaataataagcgagtgggcgcaaaggcctaaggcgcaaattttcgggtgcattttcaattaagcaatttcaagcaaaaataaatttatgtcatgtcgcgtcgcatcaattacttaccccaccatcaattatcattatcagcatttaaatttttctttcatggacactttacgatttttttaatattttttgaaatggccctgctgttcttctgctgtttgctgttgctaatggatgggaagaaaaaaaaacaaaataattattgttttcagcgcccctttggggcgcgggcgccagacgacggggtgggcggtgcggttttgatgtttttttattatggtggcggcgacggccgccgcgggcgacgacgtaaacaaaagccaaccaacagcagcagcagaagagcagaaacagcccataaaattggggatgggcacacacacagcacgggaagacaggaaaatattatttgtaaaattttggaattttctggctgttttgcaaaaatttagcccacgcacgccaaaaaaaacacaacccttggctatttactgtttaccggaaatttatctggtaacggtaatcattgattaagaaggtagactacagggatatgttggaatgccaatttccgacatttttgggctaaatttccgatttccgaaatttttgaggtaaattataatgcagaaatttgtaagtgttcctctgatttttcatatttaaaccatcatccgctttatagatatcaaatttttaagcctagaaacccatttaaaaatgaccagcttttctgagt

SEQ ID NO: 24757 - DNA, 1630 bp, Heterodera glycines
tctagagtcaatgtctttaaaaaacccccggggcattactttcaagcctcacaattcgaacttttttttgttaaattttaaatggcgccgtaattatggaacaaaaattatgtcattaagaagggatggggtcacggtggagaggggaacaaagaacaaagaatatgcccgtgatattagctaatggcttaattttcgcattcgttgcctcaggggacattttcaattttctaacaaaaaaaaaaattttgtgtagcaaacaaagaccaaaaaactttgattgtgtccaaaagctgatgatgatgatgtatgggtaagaaaatgagtggggccaaaaattgggatgcccataaaaaggggtggcgtggcacacacaccaaccaccccatatcgatttcgtcgtccccggagggctaaatttggttgcattgtaatagatggataatgatgatatggggtggcattgggatggatggaaggcaatttgtgcctctcttctgctgggacatgttagatggatgaactttggtccaaatttggccaacaatgtttatgtatgtggtgatgtaaagtcccaaaaaacagtgtcacattattatcatgacagtctcctctgtacagacagaattttccagggtccaggacccgggtgtccggtatgtgtgtgtgaagaatgaaaaaggacccgccggagtcctgtcagaacaggaatcttttgcactgaatcctgtccgggtccatatcggaaatccgggtcccaggttttttttttgaagtccggtctctaatgaatttgaaaatttcccagttgtctttttcgactttttttttgtcccctccggacccgttccccctgggaaacgaagtgaaccacggtgtcggtccaaaaaatgcgtataaagactatgggcacataaaatggtgccaaatttcggatttataaaaaaaaaatttgttttaataatttaaattaattatttattcattttctatgctcactcagtgaatgcggtgctgtgccgtgagctgtatttgttcggcgtgtagtcgtcggttagtccgtcgtcataaacaatcatttgcacgtgttcttcgccgccaaaagacactctttaaaaatgggggaggggagaaattaatttgggcaaattaaataaataaaaaaatgataataaaaattttcatcaaaattatcactgacacctttcggatttgcacccccgtccgagttaaatctattaattataggataatttgggccgctaatcaatggagcccgggattttgaaaagtcggggtcgagattggcaccagtccgggataagatattatcgggattgaagtctcggttttgcgatcctgatttgtcgtgatcccgatcccgggaaaatccgggcgggataccgatagactggctctactaattactacatttttctggcataaatatcactcaatttgacctgctgggtttgcgctttaaattaacttttgtttaaaaaattaaacctattaggacagaaacgaaaacaaaaaattaaatatgttaaaaaagagatgatcgggtccgttttctgatcatttttactataaacgagcataggcagagaaggtgttgttgtttatgaat

SEQ ID NO: 24758 - DNA, 1950 bp, Heterodera glycines
  misc_feature (29)..(29): n is a, c, g, or t
tgatttgccccccccccccctcaaaattntttcgcgtcagcttactaagactatccaaaaccttatagtgtctatttttagagctccgaggaggtgttcaaatagcttaatgaacctttttctttttctgcacaaaaacgtatgatatatttcatcaaatgtcactttttatgttacgatatggttatatgacatttgcggtcagacatttgcggccacagccaaaaacgacatttgcggctcaatttttcgaccccaacaaaatataaacctcagaaaaaaactatattcaatttaaccgatttttatgctctttctaataagccgattcacaagtcttctaaaaaaaatttctaacccccacccaactggaagcaacgaagaggaggaaaatttatcagcgaaacatggagaaagaagtatggacattattaggaaatctcagatctctacactatcaactggccgatacaagagttggtagactgcctagctaaagctctggtggggttttgacaagcctaattattgaaaaagaatcggcatacattttaagattgataaatgaatcctattttggtgcggtcgaaaaaatcgggccgcaaatatctttttggaattaaaaagtgataatttggcgttccgttggcttggccgcaaatgtccaatttccagcaggccgcaaatgtccgaaaatggcccttaagaaatggccgcaaatgtcttaacacgtacgatatttcgcttttttgacggactaccctcaaaaaaaaaaaaatttttttttaagttcaaaaacatgctttactaatgcttaaaacagatgattcgcacttcgttggacgttgcccgtctcttccccttctcactgttcatcattgttccattcatggagttgttgttgccattctacatcaaattgtttccccggatgatgccttctacgtttcaggacacctccgattcggttttttattttttatgatcgaaattcatatatatatatatatatagttaaaacttgctttaaccaaaaaaaaaaaaaaaatttcaatgcaaaaatataacattcacgcaattttctcgcttacggtttggacgcaaaagaaattcaaaaaaaaacgctgaaagcttttcaaaaaaaacatttttttacttataaaaaatgactgtccaatttttttcacaggaacaacagtacaagaggcagctgaaagccaagaatgagacggccaaatttttgcaagattcgctggaagaaattgcgctggctcgccaggagcaagggcatgcccacggggcgcaagcaatcgaatttgctcaattccttaaaaaggttttttttgcacaaagtgccaaaaattttaaaaaataagcaatcctttgaatatttttttttacaaattttaaaaattgccaagtttttcaaaaaaaaatttttttttattcgtactattttccccctatttattgtcaggttcgtacgggtgagggcggctatgtgaacaaccaggagctgttcaagttcagcaagttgttcgaggacgaactgacgctggacaatctgagcatggtccatctgcgagcgttgtgccgtctgttgggcattgctcagtttggaacgccggaaattttgcgatttcgtctgcgcatgaaactgcgcgagttgaaggcggatgaccaagtaattgtgtctgtctattaccaattttatctaatttatttttttttaatttttcgttttttgaccccctaaaaatctgcaactttttagctcattgaacgggagggcggtgttgaagtgctttctgcccaagagttgcaggcggcgtgccgcgcacgcggaatgcgagcgcttgggctcagcgaagaacgacttcggcaacaggttggttgggatggatgagcattgagcgaggtccctaaaagcctcccccccccccccccccc

SEQ ID NO: 24759 - DNA, 1020 bp, Heterodera glycines
tgaattcaattgattccaatgaactgttccccgatggctccactgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagccatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaatgattgaataattctatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagaaagcaacattcaaatcaaaggcaagctttcgtgcattgaaacgtgcatcgatcggtgagaattaccaaatccgga

SEQ ID NO: 24760 - DNA, 1194 bp, Heterodera glycines
ataccaataatttataattgcttatgaatcggtgcagattctcgacaggccgagaacggcaaaggctattcacgttcgaccacagctactggtcccatgatggctttcgtgtgtccaatgatgggcatttagtgccagaaacgagggattatgctgatcaggtgaataattagtgggaaaagaaagaaacatctctgatgagttagtgatcagtgtcatcatttttatttttctttcaaaattcaattttattttttgatcgatcatattcttccaattattgtcattacttccccaatttgtcgttcattttcatccttccttcagaaacgcgtgttcgatgacctcggagcgcaagtgttgcgcaacgcctgggccggcttcaattgcgcgttggcattttcgttggcttaaatcactttattaaaaaaaaaaattttcgaatcaaaaaccaaaaagggtaaaccaaagtcaccttcactcacaattcactgtttatgcctattttttgcttagtctctttgcctatggtcagaccgggtccggcaaaagttactccatgggtttgttttttttaattttttgaaattccgccttggcgtttattagttggccttggcaaaaaccgtggcctggttccgatgatatgcgacgaaatgtttcacagcatagaggcggaaaagacgcgcaaaggaaccacagcgaaatttcaggcattttgggacaaaataccgtaattaaagtaaaaatacatccaattcaaaggttactgtatcgatgttcgaaatttattgtgagaaagtgcgcgaccttttgaggtgtaagtgcccaaaatgaaaaggcgacgaaattagtcattttcagaaaagccgactcaaattgcacttgattttatctttggcattgtcagtgccaatccgacaaataaagggcccataaaagtgagggaacatccgaagaacggattctacggtaagagagggggcggggtatggtagggagtacggtaaaggtgatgctcccaaatgaaaatgcagtggagggactgtcgagttggcctgtggcttcctaccgtgcggtggagaaactgttaaacgaaggcacacgggcgaggacaatcgcagcaacggtgagcaatggaaaaagggaaagggaaaggagagaaaatggagcagtacaaatagggagaagaag

SEQ ID NO: 24761 - DNA, 692 bp, Heterodera glycines
cggtattaattaccaaccgccgacggtatccaacaaggggcgatttggtctaagtgtaaaggggcgtttgttttttgtagaataagaagggaatcgttggtgaattggaaatgaatgaattggaatttttttatattttagtttctttgttaaaagaagattggattggattggaccacaaattcgatctgatgtattccaaaagggcctttgtccattggtacgtcggagaagtgagcgaacagaagcaaaaccaaagaaaacattaattaattgaatttaattgccaagggaatggaagagggcgaattttcagaggcacgggaagacatggcggcattggagaaggttttttgggggagggaatgaatcaaaacggacggcaaaaacaactgcttaataaaggactacgaagaagtggcaattgactcgcatgacgaagaatattaagcgcagaaagaaacgaactttgaaatgaatgaatgaccaacaaaacaattcgatgctttaaatatttttcattttaatccattggcattttcgcaaaaacagaaaaaaagatcattgatcagaaggaaaaaataaaaaatgaggagagagaggagcgaaagttgtgcattttagaattatggggaagggaggacgattatggccatcttcgaattggcggatcaatggggcgggaggggggg

SEQ ID NO: 24762 - DNA, 1048 bp, Heterodera glycines
tgaaacgcaccaaattttatttacatgttagttttcctccccccatactttttctatcaaaaagggagatgaataaaatctttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcatgtccccccgaaccgatgcgcccagattttatggggagacctaatctttccggaatagcttccctatagcctgtacattaattctgcgttggatttttgctcccccataattgtttgag

SEQ ID NO: 24763 - DNA, 124 bp, Heterodera glycines
gcgatggattcttccccggcatattatcaatctttaattgaatagccgttcccgatcgcaacatctcaccgagtgtgaattggggagaaaggcgttgctcgaggtcaacaggggttggatttcg

SEQ ID NO: 24764 - DNA, 781 bp, Heterodera glycines
aaaagcggaaaatttgtcatgtttttggaccaaaaaaaaaagacaaaattttgccatttttggggtccaattttctcattgacaggtttggaccagtaaatgtgccaaaagtgtgggcgagttggcggttgaactggttgattactatgcccgctttgacccttggaccaccgcaatttccatcgccaacggacgcaccatttccgtgttccgacaactgcacgcggaacgcccggcgctcaaagtgatggagccgttcagcagagcgtcggtgagttgcggggcgacagggggtaacgggagggtacactacgtttcctctccccccccccccggaaaatcttttaaaaattttcaaaaatagaaatttttcaaggaaaaatctcttagaaaatttaaagaaaaaaattttacatttgaattttttataataaaatttcactatacaaacgttttttttatcaaaaacagtaaattcataaaattttgaaaaaattgctagaaggttctatcttctaaaaaattcattagtagggctgctaattttatgtaaatacatatttttttcctagattctccatagcctaattagtaggaaaaacactttcttttttgtgtttgcgaacaaaagttgggacttttatttacatatttttgcatattttgggatttttctacatattacatatgtacatatttttatacatattttggactttttcgtacatatttcgcaatttttcgtacatatttttcatttttttacatattttgaggattt

SEQ ID NO: 24765 - DNA, 1163 bp, Heterodera glycines
tgagccaactgcacccaatacttcatacagccggacgggatggtgaccgaatccgtgatgtcatgccgagtctcggacaagaacagctgccgcatctttaccataccatgggccaggatttggacatcttcaatttttttgttatttttgcatgtttttttttcaaaaattgtacctgtcttgcagtagtccgcgatgacttcactgagctcaaaaccagtttcccggttctcgtcgtaccactgctcaaactttgcacgctctgccgggaagagtccacctgggtaatagttctcaattggtggcagggtgtccagcacagtgccataattttccgcctaagattgtattaatttttatttttattttttttttataaattcctcttaccttattgaatttgtgtggaaaatatttcttgttttccacgccctcaatttctaggccaaacgtcttgacaaaattggcaagttttattgggatcaacttgtaactaaagtgatcaaaaattttaaaaatatttaatattcaaaatatttacctgtcccggaaaacggtggttgtgtagactcctgttttgcgggtcttcatttccaggagatggtttccctggcggatgagttcagggcggacacccatgcgcagcatttcaccataaatcagcacatgatcgtagcgggaacctttaaattttatttcttccaagttttttttaaataattccaaaattaccggcgtgggcgtacgcgtatgttgtcaccgactccggcttctccccggcttcttcgtaccccagcatccagttgttctcggcgtcctcatctacggcatcctcttcttcttcttcgcattccatagcctcgccgtgggtgttttcggcattcttcctttttgtgcgcttcttcgcaccgggctgcatgacgaggaatatagtttcgaagttcaatacgcaattggtgaaggcagtcagtgggtcttagacgacctagaggcattaacacaaccgagtgacagaattaggacggcgatcaggcttaagttaagattcgattccaaggacatcatgcattatgccattgacaaagtcctgaaagtgatcattttgctgggaagatacaaataaaaggacataataaaagaagaccaggacaaagtgacgaaag

SEQ ID NO: 24766 - DNA, 574 bp, Heterodera glycines
tgcgaaaatatatttcttttcccgttcttttttgttttttttcattttaccagaaaaaatatcattttaataaaataatattatttatttcacctatgttaaaatttggtctttttcaataaaaattcagattttttcttacaatggaaattttttgcctttttccccctattttttacaattttattccgttttgcacaccggatcattttgaaacaaaatataatgttccaaattttcgtcaaaactctcaccgggaagaccatcacccttgaagtcgaggcgagcgaccccatcgagaatgtgaaagcgaagatccaggacaaggagggaattccgccggaccaacagcgcctcattttcgcgggtacatccgcttgatatgccaggatattaaatgtttcacgtaatccttgtttttagggaaacagctcgaggacgcacgcaccatggccgactacaacatccagaaggagtcgacgcttcagctttgtcttaagcttttcgggggcgcaaggacgggcaaaacagcacactactctcggagcgtaagtcatgattatcataaaaggcc

SEQ ID NO: 24767 - DNA, 869 bp, Heterodera glycines
tttatacaaagagaattgggaatctgtggggaaggaagggttcggcggtgtcgatatgcgccgccgggaaacattttgtaatttttaatgtaaattgttaacaaattttgtccaaaaaaatggaaaatttagcgattttgagcaaattttcaagaaaattaagtttttttttgagtccggcggtgccgataggtgccgtcggaaaaaaaaattgaaaatttctatgcaatttattaacataaattgtacaaaaattgctaattttttgaaaaaaaactcaaaaaaattccgacttttcatcaaaaatttcggaagtcggaattccgaggccccaaaaaggcagcaaaatccataaagcacttattttgcgtgacttatacagtatatgagagccttattaaggtaaaatgacctttcattcaataaatatttctttaaattgattaaaaatgatacagcgcaataaaataaaaggagcagcaacacaggacagtgtttttcctgttaagcgtatgttgaagagacaatgtatggatgaaaattcgatttattcgcctttttttcgtccaaaagtgaaaattcaataaatatatagttttaatttttcgctttacaccaagaaattgagccgaattggaaggaacaccacggacgtgctcaacttcgcactgctaacaccaactcgggaaaacgatttggcagtacacagaatgaagctcgaagaagtcttttcatttccacttatcccgaggtcatccatataaattcagcttaagaaatggctcagaataacaatgtccgttaatcgggtatttaattcattagcctaataggttaaaagacaaccccatttagtttttaggggccta

SEQ ID NO: 24768 - DNA, 891 bp, Heterodera glycines
  misc_feature (14)..(14): n is a, c, g, or t
  misc_feature (673)..(673): n is a, c, g, or t
  misc_feature (814)..(814): n is a, c, g, or t
  misc_feature (830)..(831): n is a, c, g, or t
  misc_feature (834)..(835): n is a, c, g, or t
aaaaaaatcgattnttttcaaggtgtccggtttggggtactcaaacaattatgggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaanattttttggataaaaattatttaaatgaactgactagataatatttaaaataggttatttctcttcctttcagtatccctgcaaagtttggtgcgcttctgatcagtttctgaaaaaaaagttaagcctaaactttttggnctgttttaaaaggaanntannaaattttaaaattttatttcatctcctttttgatagaaaaagcatcagagtgccta

SEQ ID NO: 24769 - DNA, 1591 bp, Heterodera glycines
  misc_feature (15)..(15): n is a, c, g, or t
  misc_feature (27)..(27): n is a, c, g, or t
  misc_feature (1521)..(1522): n is a, c, g, or t
ccatgtatttttcancaataatatttntgataaaagctctcactgtaaaatatttttcgttcccgggaacaattctgtcaatgtggattgcttcaaccgtggttacaaaacaggcccatttgaattttactaaattcgtaaatagtttttgcttaacataaaataaatataaaaaccagtagaaaaggtaaaaaataaaataaacataatttaacaaaatttatcatactactcagtaataaaaggtaacaaaatttttctgaaaggagcgaggcaatttctggaactcctttgacacttttatgtcttttgatatttgtcgtttacagaactctttgagggtcgaagcacgcatgcagaaaaaacaccatgttttgttcatttctctgtaaaataataatgataataaaaaaagaaaaagaaaaatacctttcaaagagacaaacaaataattctatgattatttgagcaaatgacgacaatctacctttgaccaaataagtcgtaataatctcgtcaaagtctatttccgtcctcataagccacccttgataagaagaaggggctcgatattttccttccccttcctgatagaaatagatgaaaatacgcggttttttcttatccgtagatacaatttgtaccagtccgttaatgtagcggtaaaacttggtaaccgggcagtgaattcgtcttgagatatgtttaaaaaaatcccacgaaagacgataatcaccatcacggatcagaaaagagaaaagattttttcgaaatcgtctgcttttaggaatgctcgaaaaagggtggttgttatccttatgaacggcaacactatacggactagcatttgccattcgttttttgaggtctttacgatttttattccaataaaaggactcctaaaagtcgttatatgattggtgacgcaaaacaaaaataccttttctagctcctctcggaaatatttagtgaacggacccattctaaaaacctttccatacatatagccagtaaattaaaattaaaataaaaaaaacgatcaaacattttattagaagtttaaaacataatcaatttttttattaaaaacgtgtaaataattttttaaaaacatatgggaacgttcgaaattcttccaaagctttctcattctcagaaatgcttttggtgcatatatcttttagtgaagggacacgtatgttgagaagtttccacgcttcttgcatttcactgaaaatattgatttattacaccactaactcgaaacctaccggtcgacaatgctaaagaagccatctataattaggctaaccggcgaaacaagccattcacgaatactgagcaaatgtacaatcgttctggaccgtaatttgacacggtacagagggcttaaatagaactgaaacttatcataacgatgttcaccttctcgaaaaaagtaaatggtaactgatacgtcgtcaatatatacaacaccgttaagatatagattgtaactccctatagtgtccttaacattanncacacacattcgtacatttttttcataaatcagaaacgaaaaaacataactagccctaaacgatcgacc

SEQ ID NO: 24770 - DNA, 1045 bp, Heterodera glycines
  misc_feature (1040)..(1040): n is a, c, g, or t
aattaaaacattcccgcaccttacttaaaatagcgaaaacaattttatttaattgtatttcaaaaatttatgattttaaaaatttcgggaaattattataacggaattatttatttatttaaatatatcacagttaattaaaagcatattttttaattacgaatttaaattattctgacatgataaatattacacctctttaaatcatttttctattatttatgaaatttcaaatattttatcatttccattctaaaatattttctataagtaaattaaactgataaataacgaatttgacgacagaatatttatattgtgataacattttaaaataagattttggtatatttaatctagaatagactattattattgttttaaataatttacaaaattgtttttctaattcatctaaaattttgcatgtaaatttattatctaattaaacttattttcactcattaacttttttaaatccctccaatttttcttgttgaggcttacgattcgttgtggcaaagttgtgactttacaataaatcgacttttgatgtgcaaaattgagaaatgtgaattaaaattttttttcgaaataaaataaattattttttgtttaatttgatataagatcacaaaaatgtatatttttaaatataaataatatttctatttacgttttggattgtttcaattttacaaataattttaaagtttgccttataaagtaatgtttttagattttaaacttattttattctgattcattttgtccataataaaatagcatttatctgacatatttataacttatccatgctacaaagacgaacattattgataataaaattttccaacattgcgatgtttcgtttagagattttttgattcacttattttaaaatacatgtgaagatttattgttgtaaatttattccaacattcttttgtttaaaatatgaatataaaaagttttttcaatttaaaagagaattaattgtaaaatttttttatctttataattttatctctttatcccanaatat

SEQ ID NO: 24771 - DNA, 899 bp, Heterodera glycines
ttctgatcgcaaaaaatacaatttgctagaaaaaagatttaaaatatttgttaatttcaaattgagataaactaaattactaatgttgggaatggagggcattattttaaataatatgataaaattttaaataaaaaatcaaaaataaataaactatccaattaaaatagacgtaaatattataatacaaactataaaagtaaaaagaaataaattcaagaactttaaaattaattagcggtactacaaacaaagagtttactaattatttaataaatcaaataaatgattactcggagttttgaattggtcgaaatgaatgtcagaatcattttttcttaaaaacagttttgtacaacaaatgtgaaatgtggtgtaaaatgttttttaatttttgttcgagtccgcattcggggttcgaaaaatgtcaaatgatctcttattgaaggattgatggttttcagttaaacgatttgaagaaaccctaattttacaaataaatgaaaataaaaaactgtaaataaaataaaccgtcatgaaaataattgataaaagaagcaaaataattttacttataatattttttccttgtagaagaaatgatctctgaaattgagttggctttatatgccaagagttaaaagaaaattaatttcttatatttattaagtctaattaaaaacaattgaatgaataaattaataaaaacaaaataccaattctctaaatagtaaaaacaaatttaaacacattgaaacatataaaatagttgtgaattatttgtagttgcatgattacaattaataaaaaatagaaataggcttatatacactattatttaacaaataattgaaatacagataaaattaaatattgaccaaacaaattgtgaacataca

SEQ ID NO: 24772 - DNA, 1370 bp, Heterodera glycines
ttcgaacgacaccaacaatgttggatttaatttacaaagaaaaaagttatagccaaaaacatgctggcgccgaaacgggagcgccgaaacgcagtggacccttcgaatgataccaatttagagtttgttcgtacatgaacaaagttattacataaaaaccaggtattgtcaattgattggactcataaagtgcactagagccaacagttgcacttacgccgttatcttcctcaatctgttccagcagctcgctcaccacgtcgatggcttttcccgagcccgacgaatgggtgatcagaaaaacgctgttctgcaataatgaggggtactaattggaaggcaatttcatctgggtagccaaactcatacaggtgccccatttttgtggacattgctcagaattagtgatgttcgagaccgaaaatttcccgagactcgagaccgagacttgaccccgagacccgaccccgagactgaaaaccccgagaccgagacccaaaaaacccgagactcgagacttttttcaaaaaattttcctattcgcttaaaaatcgtttaaaaaattttttgactctattcttaactaatttttggttttttttattttgattcaatttggtacaatatttatcatttcaaaaaagcacaaagcaaaaaattagtttgtttttttcgcagtttttgtgtcaatttaaaaaaataaagggtattttggagctccggcggtgccgataggcgccgccggggaaaatttttaaaatttgagtgcaatttgtgaacaaatttagtactaaaaatgacaatattttatgattttaatttgattagattcacttaaaaaggaataattttgaaaaattagaagaaaaaataactacttggaggggtactgatccaacgctaaaaagaagacatgaccaagaacacaacccactgagccacgcacactattaaggtgatggagcaaaaatataccaaaagtatatttatttctaacttacaaaaagccgatcattaggggtgtaaaaaagtctcggtctcgagtctcgaaagtctcaaagaccgagaccgagactgaaaacccgagaccgagactcgagaccaaaaaaaaccgagacttttctcgagtcgagaccgagactctcgaacatcactagtatctgcagataaaataatcttcagctacagatagttagcgctagcattatgaatacggattttatctgcagatttttttatctgcagctaccctatccgcatatccttagctgcagataactatccttagcattatgaatagcagcatgagcaatttcggcttaaaatgagaaatttatacatttccgaaacatctaattttaagattttaa

SEQ ID NO: 24773 - DNA, 1114 bp, Heterodera glycines
tactgtgcgatttgcccggcaaaatttcaagaccctctggcgcaatgagaacgcccggcgctgtttcagtcttggaaagttagaggatgaaacaattaaaagatgttcgagactcttgacttaggaaatactcaggagtggcgggcacactaaaccatgcccgcgaaatagagaagaaaatctttaaaaattcaccatctgtgcttgtttgtccttgagcaagatccctacagggtatctggattgagaccaagcatcatttatttgattcggaacccgctacaataccatgattgcggattggatctacaaaagccagtggttctgggttcgagaaaggaacccggatggatatggacacaaattcgagatttccagggactataaccggggataattgaaatgtaatcattaatatgtcggaaagtcgctagacgaatttaccgagacaagagtcgagactcaaaaatcaaaaattcaagatgaaaaataccgagaatctcgaatggcaccaaaaaatgccaccttgggatggtccacttccagttgaacagtggcgtcatgaagttggagcacttcctggcgaataatcaaccgaatttcggctgtcccagtcggcaactgtacagtttggccactctgcagatgaccatcgtcaagccgacgcatgcgcaatgaacgcagatcaattggaggagtgagcagtgccttaaaatgtcattaaaattcaaaaattaatgatcggattaaaaccctattgtgcttttgtcaaaaactaagattagacgggatcgagcgggattccaactgggattgggccggaatctataggttctttttatctcgatccctgttttcaaatcgtattttgctatagccaaaaatagcgttagccgggtcgggatcccgaccgggattggtccaggaatgccgggaaatatttaatttttgtccactttctgacagacttttcttatccatctaaatccaggtcctaatttttcccataccgatcctggctaataatacatgaatttatacaatgtaatttaaattttgttgtcgaattttttaaacggtttttgcgccttcctaccgttccatctctgctgag

SEQ ID NO: 24774 - DNA, 838 bp, Heterodera glycines
caaagattcgcaacgcgtgctgagcgaggacgagacaaagcgcttggcatgcgcaaccgcactgttcctggcatggccaactgttgaggcagaaaaatgtggcctaaccctactcaaagtcaatggcacaaatccaacaaccactccaacaacaacaagcatggttcaaactgaccatggtgccaaccaagttgcagcagctgatcaggtgcttgttgatgacgatgaactgcttggtgctgcgttacaaacgttggacaatgttggcgccaacaaggcgttgctgcttgacgagaacggcggcggcacaattgctccgtcattagcggtgccgacaacattgttgaacaactcggcgatcgtttcgctagcattggcacctgtctgcaacagcaacaggctgccgaccggcttaaacatgacgacttttccatcctcgacgccaacaacgatgctgaactcgatcccggttgtcagcaatttcaattcggtccccattcagtcgttggtcagtttgaacaccaatttggcaccaccccatgccaatgccatccgcatgatgttgccctcggctgctgttatggccgcccccccccccctccgtatcagttcgtcatataaaaaattaaaaaaattttcaaacttaaaatgtttcaaaaaaatttatgaaattttaaaaaatttgaaaaacttttcaataagttttcaaaagtttatggtgaattactaagttttttttcaaaagtttctctaaaaatcactgtatgttttaaaaaaatatattctcttgcttttttcttataaaataatttcctagattttttgaaaaatttctgag

SEQ ID NO: 24775 - DNA, 1038 bp, Heterodera glycines
gcaaaatgagtcattatatgcaaattataccatacccagaagtaaacttcaaaaaatttaaactttcgactatgttagaactttggtccggggttcggaattggtccaaatggatatcttattcgtgtgatcagcgaccttgaaaaactcaggaaagacttttatttagataaaaaaaaaattatttttaagtaaaaaaatttaaaaaattgtttgaatccgggttcggggttcgaaacaaagtcaaaaaagatcaaattcgtgctcagcgcatcaaataacccctaaaatatgttttttttttggatttttattctttttttttgtgggaccaataatcttcacaattgccaacttccttgcctttttaaggtgtgcaatttgttgcaaaaaaacggagcagcagcgacggatcaatttaaaggacaaacaaaaatggcaaaaatgccgacggtggtcagtaaaatcacaaaatattacctcaaattttgtatttttaaggcgactattgagccgaaaaatacgaaaagggacggaagagcggcagaaaatgagaagacttggatttgtgagaagtgagtgccgaaaggggggcgggagagtgatgaccgaataatgccgactctctcccccccccccccatggaaggtgtcgcaagcgcaactcaatcctccgttatgagtgccaaagctgcgaaaagggacacccaacggaagcccagcgcgaggcaatcggtcgagcattgacgggagtttggctgtgtttcaagtgagtggtccaagacaaacgaatggggcggggttaagggatggaataactccgagaaaaaatattggtgtgaaaaagggtcctcaccaggcagcggtacccctccaagccaaaatcctaggattttctctgctgctggagattttagaaatctattaaaaatgaaatcatctgccgatttacagttgtaaaaagatcaatggtcgacttaacaaagtgtgcttcgaatgtgccacaaaaaggcctttgaaaatggcaggtaaaaataaa

SEQ ID NO: 24776 - DNA, 2347 bp, Heterodera glycines
  misc_feature (2340)..(2340): n is a, c, g, or t
atatttaataaattttcttgaaaaattttgtccaaaaacttctccccactgatttttgagcaccttttgcctttcacatcatgctctcattcagtttttcaaaatctcttcaaattttttcaatgactatggtatgaatagaataaattgctcattagtagggctacaatttttaggtgctaaaaactgcaaaaatagttagtttttaggttctaaaaaaacctcaaaaataggtgctaaaaaggaaacaggtgccaaaaaccttcaaatttaagggaaaaccgtaaaattttatccaaaaagcaacaaaattaagcaaaatcagtattaactttaaataaaaaatttttataaagaaaaaaaagaaaaattttgaagacgaattttggaatttttttaggggtgtatttttgaaaatttcggatcgtttcttagggatgtatttttcgttttcagttaataattttggccaaaacgccaaaatagttaaagagttttttaaaaactttttagatgctaaaaactagaaaatagttgctaataataacccgctaatcgcgccttatgaacaaaaaaaaatgttttttcttattttctcttaggcaaaaagtgcttttccgtcagcccctttatttgtttgaatgtgttcatttggtttattcaatcattcataaatttaatcttaatttaatctttgtttaattctaaaaaaataggcaaaatgaattcaatttgagagttttctttctaattttggcaatttaatacatttgttcgccgattattaaattaataaatgttttcatttcgtttcttttgattattaaattaatttttgttttatttttgccaataattgaattttataacgaagaaacgaaaaccgactaaacaaattgcttatttatttggtccgttggcactgatttctgtcaaatatgttcatattattgtttttaatagaagaaacaaactcgaaataagaaatatgaattaaataataattagtaataattaattaaattagttaaatgaattttagataacttcgcatcaatgaatgtaactgttggcattgaaattctttacgtgccatttggaatttcgatttttggtcttcttggcaatacggtcgctttcttaacaattattctctctgatcttcgaaaggtatttaaaagcacgatgaaactcttttgcatttgaaaaaaggaaataatttaaaaaaattatttgttacaaaaaaggaaataaaattttaaaatttatctttttatataatgctctgcaaatgaaacacaattatccaacccctaacctattgttttaaattttcggaagctcatttccttgtggacaaaaggtcgtccttggttcaaatattcctattaattaattactaattaaattttaaatttcaaatgttaattgcttttctttctcagaattacgtgaacatttaccttttggtgctgctctgctccgactctgtgcttcttctcgacattttcgttcagcctttgttccgtttcgacgtgctcactttttggacatgcgcaatcaccgaatatttgttcaatgcttccgcttttgtgagcagttttgcgatcatttcactcaccggcgaacgctttttctccatcattttccctctccgacatttaaaggtccatttttatttagattcatttatttatatttaaattcatttatttatatttttaaattaatttaaaagttttccacttttctttttaactaattttaatattttttgatataataaggtttttaaaaatcgaattatacatttatcttttatatattttttccaccttggattatatttttatcatatatttttactagggttgagcggtaccggtaccggtaccggtactggccggtaattaccggtttttttggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacatatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcatttttttacaaattctgttaacaaatcgcattanaaataca

SEQ ID NO: 24777 - DNA, 1876 bp, Heterodera glycines
tttccagaaattctggaataacttttttttttttctgataaaaaactcaaataaatcccataaaattctccttatttttctctatttttaaggatttattcctgtaaaattgatcaacccttcgatttgttatgaattatcaaatagttcgcccaaaatcccgaggaccaaaaaattgccacaaaataaagaatttttaagaaattccaaaaattttgaaacgaaaaataaacatcatattcgtgctcagcaccttaatttaccccaggaaaaattttttccacccccattttcaacacaaaaaaaattttcgaaaatttctagggggcctagctcgaaaaattttgaaaatttccgaaaatgtagtacaccattcgatagagcttaaaaagctctacaaatttgccctaagtcaattttttcgctaaaatcaacccctgacgagttataggcccgggactcaaatgtcccgctcaggccaaaatttttttctatttccgggaaaaaatcgaaaattttccgaaaaaaattaccaatcgatagagctcgaaaaactatgttttggaagtggtctccgtttctctgggaaaattcgttaaaaattcctaaaattcaaaaacccgaaaaccgttttttaggcctagctcgaaaaattttgaaaattttcgaaattttaaaaactggaaaaatccagctcattgaactctacaataagtctgctggtaactccccgcccagatcaaaccctaatgagttattcaaccgggactgaactggacaaagttggtactgaaaaagtccacgaacctacagcctttcctattgcagatagaggcttggaattttttttgttttttagaaaacacttcaacttagccccctcacagcagacattttttgatttgggttttataaaaaaagttacgggcccccaaatgcacgaaaaaatgagaaatccgtccctgggactcagtcgtccgcgctaaatttttttctatagttttcccggattctcctcaaaaagttgtaagacccttccactactttcagggcgctcccggccttcggccgggagattttgtttttgcaaacgaaactccttgtcaatataacgtatatactagcgggtgcgtgaaccgtcggctatttagctgggaaaaagcgcttcgcgctttcggagcttcgctacctaggctgtgaagtgattcaaattgatcgaatttgttggagagattttattacaactgtgattagaagaggtacaaaagtgattagaagaggtacaacagtgattagaagaggtacaacagtgattagaagaggtacaacagtgattagaagaggtaaacatttgatgaagaggttaaagaatttttaaaaaattccaaaaattatgaaacttaaaatagacatcatattcgtactcagcaccttattttaccccagaaaaatatttttcacccccattttcgtccgaaaaaaaatttccgaaaatttctagggggcctagctcgaaaatttttgaaaattttacatcatgtagtacaccattcgatagcatttaaaatgctctacaaaaatgttctaagacaatttttcgctaaaatcaacccctgacgagttatgggcctgggactgaaatgtcccgctcaggccaaaaaaattttctatttcctggaaaaaatcgaaatttttccgcaaaaaataccagtcgatagagctcgaaaaactatgttttggaagtggtctccgtttttctgggaaaatcgttaaaaaatcctaaaattcaaaaacccgaaaaccgttttttaggcctagctcgaaaaaacggaagggaaagggacaacagtgatttgaagaggtacaaaagtgatca

SEQ ID NO: 24778 - DNA, 1381 bp, Heterodera glycines
  misc_feature (1310)..(1310): n is a, c, g, or t
  misc_feature (1318)..(1318): n is a, c, g, or t
tttttttaaatttttatataaaatatggtttatatattttttcctaagttattttaaattttttttaactaaataaatttttctattatatttgatcttcttaattcacaaattttttaaatttttatatatattatttttattaaagcccatagcattatataaatttctcgtaaatccttttttttaaataaatcttttctcatttttatttcgcttttttgccatccctcaaattggccacggcactcaccacattcattccattcaccaaagcccattttatgggccacaaaagcaccaccccaccacaccacaccacacgaccacttcacaaaattgcccagcagacggaaaacttttttattttttgccgaatttcattgtccgaaccgccaaaaaatcgttggttctttcctcatcatcatcagaagcagaagaaaatgaagaattccaaactcatttatttttttggcccatgccattcaatttttttacaggtcatatttatttagacaaaaatggatgcaaataaatttttcccattttcttttattattttgtttcagttttattttcaataatttaatttttttcaatttataaatttaaatatttttttaaattcgaaagatttaaattgttcattcttttttttaatatcctttattgatggccttttttgctacctattcttttttaattttaaaattttttaattaatttttatttttaaaagaattaccggtaaatttttcacattttgtcaaaatgtattattttggtttcggttttttgaaacaattaaatttttttaattacaaattaaacgttttttatattttttaaatgttaatttttattttaaattttttaaacctttttatcattggcattttctgctacatatttaaaatttttctttttacagttttcaaatcctcgcttcttttaaatacattttccctttttctattttattttccggagcccaactcattttgtgcccgcttggcctgcctttaaacatatgcatacactttgtggcacaaaatttgacaccgattggcaaacatttggccaaacattgcccaaatatattccacctctccccgccctcctcccccctcactctcacgcaaaattccattcccatcgatttcattgggtcgagagtgactctcggctacggggtgaacggggctaattacctccagattaacagtcataggtaatttgcttttaatttttgtctggattcgctttaattgtctagctttatgcccttttacataaaaaatgttttttanaaaaattntcgcattagcaaaattctcgagactttggcggcgcgcaatgccaagaaaaggaaataaaatcc

SEQ ID NO: 24779 - DNA, 1396 bp, Heterodera glycines
  misc_feature (1312)..(1312): n is a, c, g, or t
tcataaataatctacaaataaattatatattgaacttcgttatcatttaaatatatgctttttgttcacagcacttaatatgtgagctgtggaaaagaacgagccgtgaaagcgaagtgaaagaaaaggtcaaaaaatgaacaaatggccgaatgataagtgagataaaaggtacacgttttccatagaaagcaatcacagttaatcccacatcagtcaattctcaacgagcgatccttcagatcaatgccttcttcatccgggttcaattttccaagagcaatctattaaaaagtcaaaagtgacattagaatgtaagttaattatgtgcacctttgccaaattacgattctccaaatcggcatcgtcatttgccatccgttctaaacgctttcgaatgttttgcccgttgaattggtcgtcgaaatgattgtatcgggcgagaagacagaaatattggcgtacatttgcaacagctgagaaaaccaattatatgtgagacataaaatggacgaaccatcgtccgaaatacgcatgagatcattgtggaacaagtaataaaactgttcgtcgcctatcaatttgttctgtgaaagagaaaaaagcagacggccgaagctaaagtgccgaatgttttgcgcgacagttgcaatgtccacagtcagactgatcgtcacctttgccttctccgccagtgccgtgtctgccaaaacccaaagcgaatgtcagccaaaaggcgatcagtcaatggaagctgcggagagtcgtcggcacccgcactttcgtcctccgtcgtttccattggcgttgcttttccgttttcaccgttctgccaactttccatattatcagtcgaattgatcttcaatgtattgtcaagacagtcattgtttgtcattgttttgttccattcgtggtgaacaaaagcggctaacacaacggcaagcatttcaacaccgcaaattcggacttccgaaatacggtctgatgtgtaaaattaaataaataaatgcatgttaaaaaggcaccaataccggcagaaaatgcgagagcaaaaccactgaggtgacggttaatgtgagtgatcggaaagaattgaacaagtcgggtgagttgactggaaaggaacggatgatgaatgaaaggacgaaagacaaacccagcaaattggacacgttggcgccaagtgcgcgaatcccccgggtcaatggtcacttgatggctcaattctcggatcatactctcacgaaattcggcagaaagaatctgacaaatcataacagaaagtcagttaacaaccaaattaaaatgngaaatgatcaccttacaaaaggcggacaaatgctgtagcaacgcgaactgtacctcctgtgtgtcgcgcatataccgctgaaaa

SEQ ID NO: 24780 - DNA, 1280 bp, Heterodera glycines
cccccccccgcccttcaaaattttgaaaaaaaaataaaataataggagactcagaattttgaaaatttttttaaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagagcagtttctgtaaaaatacttatgaattaattatgcaaaagacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccgcgggggccttcggccccgccccccccccgcccttcaaaattttgaaaaaaaaataaaataataggagactcagaattttgaaaattttttataaaaactgatgacaagctaatgtgataaaacaggttaa

SEQ ID NO: 24781 - DNA, 1781 bp, Heterodera glycines
  misc_feature (1763)..(1763): n is a, c, g, or t
ttaaaaaacttgatttcaaaattaaataaacattgctatcacaatttttttttcagctacaattcatattggcaaaacgcgtcgaccccgcaaccggcgcatcattactacactggcgggaccggatcacttgtttactcaacaatcagtggtgacgcacattccatttgcaggtaggtgatcgctgatcatttggatcagcaaataaattatattttttgtgttcattatataattatttttaactgatttattagagctcgacctgattagcctctgctggttccagaggcctgggtttttcattaacctaggtccaggcacttttcgggccttctaggttttttggggtctaggttttcctgctatgctttttccagaaaaattagaccaatgtaaagtataactcataacttggcatgaattttattgagccttggtttttctcagaaatccaggctcaagtcctgcgttaaacaatacccaggccccggcatttaattcaattgccgaatacttagttaattagggttacacaaggttacggaatcgttaatcctctgggctgatcaccggattacagcagtaacgcggacgtgtccgcccgtctctccacccgtacccatcagttatcctcctcactgatccttgtgccaactccgccggccactcattatcagcatcatcatcattatccgaatcatcatcatcagcaacagatcaccgttgatccatcctacaataacaacattgtgtcaatgtcttcaccgtccggcacgggtgccattggtggtggtggcggtggtcacattggcatctatcatcaagcaaattccagtaaaaaagagcaattttcaatttgtgacagatagatgatgtccacttaggacttctaaatttactaaatttgcgttttcaaaattctagagttttaaaatcaaattttgaaatattttttagtgccaaagaatatgaaaaagtttctagatttcttccaaaaacaaaaaagaaatagtttaactttttaaatttattttttgtaataattcaaaacttttatcttgaaaaaaatcattttctttaaattttattgcgccttaattttaatactcttgataataataataataataaattaattgattgatttagcacaaaaatcaattaaaataattaattacagctgcagcggcggcaaatgtcagtgcggcaatcccggcaatgccattctgttgtgaatgccatgcaacggtaggtagtagtagccccattaaaatttaaatgaataatttaaaaattttttgaaaaaatttccagcaaaatcgttgcagcaatgacagttgtccctgttttgcgacacggcgcatgtgcgacgagcactgcgaatcggccaggtgtttttaggcgaaggcaaaattcatgtgcaacaaatttttgaattccgctaaaaaaagacgcatttttttttgtaaaattttcaaaaaatttttgaaaattaaattaaattagagctaattttgcataaaatttatgaattatatatatatatttcaaaaatgaaatggaattaaattcaccaaatttttcaactaaagccatttaaaaaataaaatattataatattttttaattgaaatttaaatttatgcaccattttgtaaaaaattataatataaaaatacatttttaaattcatcataatttttttttcagttaaaacattaaaaacacataaataaatgcgttctttaattattcattanatttcaacttataccatt

SEQ ID NO: 24782 - DNA, 1014 bp, Heterodera glycines
catcccatcatgagcgctaaaattatcagagtgccgaaaatcgcatgtgatttaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcatccaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacaattttagcgcttccaattccttctacaatcgcctttatacatccccattatgagcgctaaaatatcagagtgccgaaaatcgcatgtgatctaagcctagcaaaaaatggtctaagtgaaaatcgtaattacgct

SEQ ID NO: 24783 - DNA, 1464 bp, Heterodera glycines
  misc_feature (1435)..(1435): n is a, c, g, or t
tttgggatttttttataacacaccatttcttaaccatttccctcgtcttttcttgctttttggcattttcttacagtcaagcatttattaacattttctttgtcttttcttgacatttttggaaggtacggctcggccgcttcgcggcctcgcaccattctttcggcattttttatgcataacaaaaataaatattagtaaaattttctgaaattattttatttaatttaggtgaactatttcacttgaaaaaattgaatttttaaaatttttaaatttgatttagtaaaacttttgttaatgaacaattcaattttatttttctgctgcttggtgatcataaatttatttattgaaaattgaattcatttgcttaaatatgtaagaaataaagataaatatcggattgatatcagataagcacattcttttaacattttgaaatgttgataagcctcgctttaactttaatttgtacaattatttggtgatttgtcttttcactaactcgatttaataatggaattttctggaaaaattgtcagtatttttttttgttcataaattttatcagcactgaaggtttttcttcaaaaaaaaataatttaaatttgatcctaaatatttaaaataggtcatttttgggcaaaatttgttaaaaataattttttttcaatttttaaaaacttttcttaaatttttttttcgctgttgccagagatttaaaccagcaggcttcaaattttcaaaaaaattcagcttaaaacacgaaaattttttctcctcttctttatctctccttttgcattctctctctttcactctcccaaaattaatttacagacaattatcattaatcattttgtcacatgacactgccagcaagagaaaattctcgaatttttttatgcaatgcatccggccttgaaccatttgggcgcacaataacaaaactaaaatcactcagagaacagcagccaatcaaatacaaaaactggtccaaaaataatttaaaataattaattagcatttatttttggtgaaaatgcaagcgaaattcatgtgggcaacatcgatcaaaaaattggaaataataaataaaatataatttagttattatgaaaagggaaacagttacgtaattctcaaatcgaaacaaatattaattcattttattattagattagcttgctttctataaaatttatttcaatgaaaaaagatgtacctaaataaagttcaaaaaataaattatgctgagatcaattttcagtaatttcaaaaataatttgccaaattattttttcagaagctttttggtacatggaagaaatgccagttgtgccgataaacgcctcatggaaaattttgaagacatagtgtgtgtgatttgttaacttttgtcaaaaaataaccaaagcatttttatgaaatnttgggtccgacggtgactttaagcgcagc

SEQ ID NO: 24784 - DNA, 1194 bp, Heterodera glycines
  misc_feature (1119)..(1119): n is a, c, g, or t
tataattatgaacaattgcggagtaatggtaccctgctggtatttaagaaaattcttttatcataattccggttcaagggtgattgtgcctgtcatgagaaaaaaaaaacaaattctattacggtatgtcagaaaatccgcccaattttctaaattttttttattaaaaacttctttttctatgtctaatattggcacttttttgcagccagcaaattatgcccgctcactcttcgacagcgcttatatgtattttttggcactgaaccgaaccatggacaaatatggcatcagcaaggagattttgcggaatggcacactggtgatcaacgtcaccgcgagcgtgacatttaagggtaacccaaaaaaaattgagactgtaacaacatgtactgtacatcaaaaaacggtgcaatttatgaaagaatcaaacgaaaaaaactactgtaataaaagggctttaattaccgtcatccaaaaattaagctctctctgcttatcagagtgattagatcaggtgatcaggaaacagactaatcgataatgaatgacttttaaaaaaatgtacaaaaaaaaactttagaacaattttaaagaggtaaaacaaaaaataaaaaaaattactgtaacataaaggctttaatattgtaacccaaactctcttctctctctctctctctctctctctgcttatataattaaatcagatgaaaccagacaaaaatcaggcaaatagatttttgcttttcaaaaatgttctaaaacttactgcaatttaaaaatggaataatttatggtaaaatcaaaaaaaaaaaattactgtgtattaaataagctgtaattaccgtaagccaaaagccgagagctctctctgcttatagtaattaaatcagatgaatcctgacaaaaatcaggcaaatagatttttgcttttcaaaaatgttctaaaacttactgcaatttaaaaatggaataatttatggtaaaatcaaaaaaaaaattactgtgtattaaataagctgtaattaccgtaagccaaaagccgagagctctctctgcttatagtaattaaatcagatgaatcctgacaaaaatcaggcaaatagatttttgcttttncaaaaatgtacaaaaagcacttggtgcaatttaaatccccaatgagagaagagtatgtaaatatggagtatatgt

SEQ ID NO: 24785 - DNA, 1111 bp, Heterodera glycines
  misc_feature (8)..(8): n is a, c, g, or t
tctgctanttttgaaaaaaattattaacaaaaatgcaagaaaacgaaaaatacacccctgagaaatggaaaattttatcaaaaattcatattcaaaatttatttatttatttacttgactacatttttgattttttggctgcctttttcaattattttcccaacttatacaccattgatagagcttcaatagctctacaattttactcagaggtgatctttcgctttttctattgataaaaatggtttattgtttttttgggaaaagataaaaaattcaaaaaaaccgaaaccgaaacggtataccgaaaatttttcttcgggttttttcggctcggtttttttcggttttttaaccgaaaccgaccgaccgacaaatttttgagtttttcggtttcggtttttttcggtttttaaccgaaaccgaccctcttgtccggtctctaatttttattcagaaaacgagaataagttaggaatctagaaaagatatattatcttccttgctatattttttatggatttaagaaaatttaaccattcttatcgtttttcgaaatttttagattttttatgatcaatattgaggtcgacaccaaaaaagccgaaaatttacaatagcaaattactatgctcttaaaactggttttatagtgatttgaacacttcagttagaaattccctgttgagcaaaagagaaatgaactgggagcacaacttttaagaattaagagctcaaatggaatttattggaggaatttccatattggaattgtgcatcaaagcatagagataaaactgaaaaaagagagcagaacaacaacaggtgaagagaagagaaattgcagagggcaatgagcaaagaaggaaagggatggaaggacagagagagagagagagaaatggggaaaaacgccggggggggggcagaagagaggagagaaagggaaggagaggaagcactcattgtacacaaaactaatcaaacagacgggggggggggacgacagtcagtcactcatcatcatttcgtcctcctcccccttttttcttccctttgtctctttgccgatcgtttgtcgtcctttgaagacgaatgagtaagcgttgat

SEQ ID NO: 24786 - DNA, 1313 bp, Heterodera glycines
  misc_feature (107)..(107): n is a, c, g, or t
aattaaattttcgtggtacatatctagtgaaatgtttaaaatttaaagaataatagagaattcttaggctatcgatgatattagataagtttgcacaataacatttntaaaaagttctgtacaaaaattccgacttatgattttgtggaatttaataatgataacttttttatactattttttaaaattttaaaatttaatattctgatagagaacacatagtgatattgaatgacaccatgaaatattatttggttgaattgggccaagatatcaattaatatgtccttattttttattttctggacgatagcctggtttttggagcataacttttttcatagttagtttaattgaatgaatttattagcattcgataacatgccaaatttcgaaaattatgttaatttttagaaaacttatggcctaaaaacttagacaaacaaggttttccgaaaatttttgctataacttttctgaaacttaacaaaatttttcgaaatttggaatgctaatagataataattaggcctatcaaatgctattatggaatttaatttttgtattattttatttggaatgatttgctttagggttgctcccctaccccgagcccccgacccgacccgagacgttttttggacctatacccgacccgacccccgacatgtcgcctcccgaggtccccggtcgccgactttttgcccccgaccccccgacaataattcagggaattggggacttcgagcgttgtaaaaatttaaaaagttaattcaacaacgaaggggggaatgttgaaatttatgaaattttgaacaattttcttaataaaattaattaaaaattccgaaaattgtttcggcggcgtctatcggcaccgccgaccccccaaaatccaatttttttttgcaaaaaattcccaaaattgcaaaattaggtattttttaggaaaaatctgttaacaaattttaaaatgtaaaaaaaaaaaaaatttcctcgcggctcctaatagcatcgccgcccatcccccttctctgttgccctaagttttttgaaaaagagcgccgcaaaaaatggtggtcaaattggatgttcagaagggttcgcaaaaatttctgttaaactccctcccactttccatgtatttttaaacagggcttccaccatgaacaccaagcccgaaaaataagattttaggctcaaaaatatgaacaatttttttaaatcagttagtattaaattttatatttttagtctccctattatcatttttaacaattttgggaggaaataagcaaatcgtacatttaaat

SEQ ID NO: 24787 - DNA, 1029 bp, Heterodera glycines
aataatatatagaaaaggcaaaataaaaaaaatcacaagacaatattaatcaataaattaattatatggacagaatcaataatcaatatttgaaccaagccgagaaaaaaattaactattaattcctaaaaaagagccttacgaaataagagagaaaacagcatgcaaaaaaaaaaaataataattcataagaaataaaaacaaaagtcatttaaaattggaaataaaccaatgcttacttactctggtaaattttatttaaaaaataaaaatttacaaaagtttttactgcttgaaaaaataaataaaaattaatttaaaatttaacaaaagcaataatttataaaagagtaataataacgtaaaattattttatataaacaaaaaaaataaattacaaataaatatttaaatgcacatagcaccaacatgaaacgcaaacagtgtacgaaaccatgaggtaaatataattaaatattttataagatgtaatgaataaaaaattaactcaagattaattttttcaattaaagaattaaataaattttctcataaaatttttattaattttggaatttttttaaatatccaataaaacattcaaaataataataataattttggcagaagagacattttcacacaatgaatattataattgcttaaaatgttgaattgtatatatttttagagctcgttaaaaaataatttacgggagcgggagccgggagcgtgagttcgaagtcttacgggagcgggaatcccgtaaactcccgctcccgtgaaaatcccgtccatttttaacgggagtcccgggcgggagtaattcgaaaatttaattaaaaactcacaaaaatatttttaatgcacaaatttgaaggacaatctttttattaaaggaaaaatatgtaagcagaaaactagaaaaatcagattttgggttgaaaaccagaaaattttttcaaattagttcaaataaattttttttgggatattctaactaaaaaaattttaacattatattttcga

SEQ ID NO: 24788 - DNA, 1128 bp, Heterodera glycines
tgaggaataatgaagagagaatggagaatttaaaaaaaaggaaaaaaagattaaaggatgatttttgaaaaaatcacatttaaattttgaaattttccgtgcaaataaattaaaaaaactcatcatataaaaaaaaaaactttatttgccctgagagaaatggattaaaatattattaaatagaaaaaaccaaattgggatcatttttgatcaatctcatcatccatttcatgcaccatttggattgtctccgtcggcgctttcttaaaatttaactatagaaattttgtaaattaaaaattattcacttaccaaaggaaccaggcaacaaaaagtatgacgatcagtgcgatgcagaaccagctaagttggaactgtcgatggcgtgctcctcaaatatcaaaaccagaagcgacaaaactgttttttgaattttaaaaattgttttacattttcgaaatggtaatgttgctgctgtcttcgcgattgtcgtttgtagattggtaaaattgtcgattggcgagccattggaagaatttgcagaaaaaatgtaaaaagaaatgaatgagaagggcattctcgtcgtcgttgacggcatatgtttgctcttctccgttcgcgtctcgatctactcacaatatttattacgctgataagaaaaaggggccatctcaaaaaattatgcaaattatataaagctaaaaaaggatgaacggtcggcccggtatataaatggggacaaacaaatttagtttcattttgatcagattttcaaaaaaaaaatatgagtatcaacctccacgacaaaaagtcgctcatggacaacattttgccggtggttgagataaatcaaaccaccaatggcattacggttagcagtgaacgaattgcgataccacgaacgattcagttcgacattcttggcaaatgtcgagaatgtaagtcaaccgaatgtgagacggaatggtgcgtttccaaggaaggcgttaccatttggtgcacacgcttcaaaataagcccccgttttgtgccatttgatgtgatctacgatttgtctggttacacatttttcaaggtttgtttctgagttctgtgttttttgcatcaaaaaattatttactcaacaga

SEQ ID NO: 24789 - DNA, 1316 bp, Heterodera glycines
  misc_feature (1310)..(1310): n is a, c, g, or t
ataataaagttgagtgtttgtatgtatccgccttgctttgaattggcgtggcgttttgttattattttgcgttaaaaaatgatttgaaaatgaaaatgtttttgttttgttttgcgttaaaaaatgatttgaaaaatggaaatgtttggttttgatttttcaatttgttctgattaattaatgcatttgcatagtattttatgtctatgcttatagttagtctattattgtgctttagtctttgtctattttttatgatttagccaaaaatgaattgtttacttaatttgaattttctacaggtttgatatattgactttctctctgccgcttcggcatttttttttttcatcaacggccggtcggccatccatgtcttacccaatacttttgatgtgtgattttagttgaagtttgttttgtttggtttttatgcaaaattatgtttataaaatttagatatgacatgaagaactaaagttttatgatcgctcatggttttgtattcgttgtgaattcattcacaagtttgaaatctgccgtggccatcattcaacagcttgtccagattgagtttaagtgcctcatcaaagtttattgggattaatttgtttcgaattatattttgctttgttatgttaattattatgtaaaatttagaaatgaggaccatcatattgaagaaatgctgttggcttacaattggttgtgatttcatctctgaagtgttgaacctgtcggtcggccactcaactttttgctcactttcgagaaattcactacttcaactttggcggccccttttgtaagtgggttgggaagagttgtggtaaatttgccaaatagccaaatatctgataaaacatttgtgttcgttaatttgagtttagtgtgacacaattatgtgtgtcatgtttttgataaacattagtgtttgttatttgagtttagtgtgacacaattatgtgtgtcatgtttttgataaacattagtgttcgttatttgagtttagtgtgacacaattatgtgtgtcatgtctttgataaaacattagtgttcgttatttgagtttagtgtgacacaattatgtgtgtcatgtttttgataaaacattagtgtttgttctgtgacttaagtatgagacactaaagtctggcatgacattgataaaacattagtgtttgttttgtgacttaatgtgcttctcaaatttcagaaacccaaacaagcgtgaagcaatgaaacatgcacggtctcatcattggactttttaaattattttttgttttgtttatttgtttgcaaaatgntaaaaa

SEQ ID NO: 24790 - DNA, 1597 bp, Heterodera glycines
  misc_feature (55)..(55): n is a, c, g, or t
cattaaaaccagataatggggcgttcgctcttgccgttttgatgtcccgaccatnagagactctagggttacaaaaattacgcttacgttccaattatgggagcccctggtaaagagtagatcgaggaaagtattctgcatattaagcattaaatcgtcaagtatcagtaaaaggggtttttcctgttctttaatcttattcatgtccggaatcccgttaaaagtctcaacgccctccccgattaatcctaaaatactatcattcatctcaccataacaataaagaattttttcaggcgatggttcaattagattcttatgatgctttaaaaaccgtaatagccaacgggtcttaccactcccagtagcccccgagagaattagagtgaacggaccgcgaaacacttttaatgcatcttatttatttgacctatttatattttcatagggaacatgtttcgcgcatttggggcatagccagaaacacttaattttatgtggacagttcattttttcagtttaattttattttcggttgctatttatagaagggttatataaagggagtgaaaggacaatttgattggtacattgtatcaaaatgcaaaacccgataatcgtaaatataattgctctcgctaatctcggtaccggaattaaactaaactctctgacgatcaccgaatgcgaatttaagtataaccctagaaaattcaatgccgcagttatataatgcacagatcccatcaaagccacggcattattatgggaatccgggaaaatgatatgtctggggacgcaaagtctgatagactgtgaaaatgctattaaacaatttatagaaataattaagggctcggggtgtccgggggcttcttacaccggacacacggttgaaaatattgtttcgactttaaattcggacgtgaaattgaactgacgagtttcgaaaaaatcgtcgtgcattttatgaaccggaaatattttgtgggttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaagttagggagacgataaaaaatttttcatttattgggacggtcccccaatttatagttctgttgggtatttattttgttatcgattacttcgcgcggcgccggcatcgcggcgcaccggtggggcggagaggaaattcatggttttggcaaattttcaaaattcagaaaaatcatcataaaaaaaaaatctcaggatttgagaaaataaaaccggcccaaaaggtttgggatcaaaaagatttaaatttgcaaaagaaaaattgaatttccttcacctgtcacttttggtgacaggtggatgattgatgaccttcccgcggcgctgcgcggcgcgggtgaaaaaaaacacccgcaacaatttgaggaaatccccaaggcgacagagttcaaagaaaatctcataggctcaggatgtgagcgggcaacttcaaggggatgcacccctctcataggtttgcgattgtg

SEQ ID NO: 24791 - DNA, 958 bp, Heterodera glycines
aataattagcaaaatttgacaaagtataagctgctgctgctgctgttcaccacttagtgcaactgacacaacacaaataaatgttgacattgttcaaattggttgccgaattttggggggcctcccactgaatcatcgccgtctccccaattggacatcgcttcatcacccattggatagcccataaatcttcgcttgttttacacagtgtcagtttttcttgggtccgttcattcaccaattcaaatggcccaattggcacagatgtgggcacttcaaattgaattgtgtaacgggcagaagtggtggcacgaacaaatgtctaaacaatgggaaaatgcaaatataaattttttttgtaagaaaatttactaaaaaattaagaaattttcagtgatttcttggaaaatcctttaaaaaacttaataattcacattaaatttttaaaaaattgtttaaaaattttcaaaagtttttacttgaaattttctggtaaaatataataagatgtttttcctgaaatttttgcaattcttgagctaaaatttcaaaaactaaggtaaatgggcgtccggtggtgccggtaggcgctgccagggaattttaatgcgattagttaacagattttatccaaaaaatgatgactttggttaattttgcggctttttagtttgctcaaaaaaaagaatgaaaaaatttgaaagttttttatttgttataataaaatcagaaatacgaaatgttttggtttaaaaataataaattacaataaagttttaaatgaaaaaaaaaattggtcttgcggacctgcttgaaatcgttgatccatccagtgtctgtgtccatactggtaaatgtttggttgcagtagaatcgcttcggctgtccatcagtgcgcggtgcgtgcaaccatttggacaacgcttggccagcaaaagaagttgcagcatttggccca

SEQ ID NO: 24792 - DNA, 1608 bp, Heterodera glycines
agcatctataatctacccctattcatttccatcattcgctattgatgaggatgatatcattagcattaaacttgttaacccgaactatagattcctagacgacaaaaaatttgtgcatatagaactaaaggttccaagcatgcaattttcaagtgtagaacatttacggctcaccctgaacagcctcatacgtgaggtgtatcagcagcagcaattttcttctggccatgatagagctagccggacgaaacggcaggtcacagacctattttttcatgaaaatccagtggattattgggaaaagattggcgaattacgcaccaaacaagagcagtttgaaaaggaggtaaaacaggaggagagtgaactttcggcagacactacggatgtggagaggaaaaaactgctacaaagcgagcttccactaaaacggattcgtatgcagaggaaaaagtatgagctggaagagttggaacgtgctgctgaacgtcgtgatcaggaaagtccggagaatgagcaaagaaagattagcgatttttccaacatcatcccgaagattataacaaaaaattgaacgagtcaagacttatattcacccaacatctctcggggctgcaagaggtgatgagcaagtacattggtgaaaaagatataaataaaattcgtcagcttaacaccgaggttggcaaaatacgcacaaaaataaaacacatgcagcacaatttgaccatctttgaaaatgctgcgcttcagcgtgaccaccaaaaatctttgtcggaatatgaggagctcagccaccagcagaatagtgcatttgttgaggaattttttcaaaaacatcccacaaattattggcaaattattcacaacaattataggggtcttacagaacattttcagaagatagaacaactgcaagcaaaggcagtagggttaaaggataatgcgtctttcgaaaagcaaatagagcgagcaaaacagctgattgagtacagacgaaagagattcgctgcgctggaatttgaggcaaaaaagcgtgatgagcaacaacagtttgttgcagcagcagcaaatacaattactgcaccaactgcgtcggcattgatcggaagggaggcgttaaaaaaacgtacaggcatctctgccagtacggatggtgaagtaggtgataaagcagatgtcggtccacaaacagctaccacaacaacacatggggaggtattaaaagagaaaatactggagcagcaaaaacacacggacaaggatgataaagcagatgtcggtccacaaacagctaccacaacaacacatggggaggtattaaaagagaaaatactggagcagcaaaaacacacggacaacgatgataaagcagatgccggtccacaagcagctaccacaacgcatggggaggcagtacgtgagaaaatattggagcaacaaaagagcacggacgatgatgataaagcagctgtcggtcagcaaacaatcccaacagcaacaaaaacacatggtgagacgttaaaagaaaaaatatcgcaagagcagaagcacctagttgacgataaatcaaattctgccgatgcaaaacaagatgatggtagcggt

SEQ ID NO: 24793 - DNA, 1737 bp, Heterodera glycines
tcctcgttgagcactttctgtcgctgtggtttcgaggacattcggccctgggcaaagaacacaaaataagctaattaatcattttcaatgaaattcaaattgataaccaaaacaaaagccaactttttggtacattctcaaattacagtaattaattgttactaattgccttaccaaaatgcaaagaaaaggctgtgaatgaaaaggaagtgaaagacgttaaaataaaaactgcgcattgaccaaacgccggtgggcaaatcgatggaaaaatgcggggaaaggaacgaaagaatgtggggggaggggggaagaacgatgggaaatgaatgaatgatcaataggcatgggataatatggtgaaaaaaggaaaaagcggacagatatggtgggaaaagccatagggaagagacagacgattttgtaacagagagagaaagagagttagagagagagagagcgagaaagagagcgagagagagagagaaaagaaagagagatggcgggtgatactgatcaaagtttgtagagaaaaagagagtgagagaggtgtgattaccgatcaaatttggagagaccgagagaaagtgagaaagagatgaagagaataaagagagaactgatcaaagtttggagagaccgagagagagtgagagagagaaaaaaagagagaggagagggcgggtgattaccggtcaaatttggagagaaatcgagagagagttttaggagagtacggtagattcaaattgcccattagtgaagtctttcttttaccgctttttcagattttgcgttatcaatatttttgtgccgtttctttcttcttccatttccccccattatcattttcttcggttcctttgctaattcgccatttattttcttgcgcattttccctcttcacttcctccaaaattggattagcatcacacttttttgttcgctgtccttttaattaataggatattttgccaataatgcttcattcatttagagtgatgagtgaattttaaattaaatacttggcgaaggaatgtcagggccaaaaccgaccattaaaaatgccctgaaatggtatttcgcttttcttttcaaaataaagagagacgacagcgcataaaatctttcttctgcccctccctccgcgaaagtgccattcatggcatcattcaaatgcccatcttcaccatcggtgccatcagttttgactttggcaccccctaattatcaaaaagcagattctaatgagctaatgacaatttttggttgtgtgatgagggacgaatataaatgagagaattattattacacttcctgctccatttacataatgagctgaatggaaatccatctcaatcttttgccaaaaaggcgaaatgccagcggaaatgaatgaataactttgcattccgacgattaaattgcaaatctccgcgagttccacgggggtcactttcgaaatgccctcctccgccaccccctcaattcgtcttcttcacccccaccttccaaattccccctcccaccaaaatgagactttggcactctcaaaaacattctctccctttcgattggttgagaaaaacaattgcccttcatttatttctccgttttttatcacttaaagcgcaattcgccccttttgaagtacaatattttgtgcagaaccattgtcacctgacattgtcaaacatgcgatgtttgcctcaaattctgtccttttggctttgcttt

SEQ ID NO: 24794 - DNA, 1650 bp, Heterodera glycines
gttgttgcttcttatctcggcattgctcaacagccaaaaagtctccattacgcctttgccctataaaaagagtaagattgtacacactaattaatttttaattgtcttttttcgggctttctaattgtttcattttaatttgatttgtggttaataagtggtgctttttttccccagcattctcatatcattcgtatattttgttaataatcctgtggtggtgccttagcttattagatcacggcatttagtcaattattcgtgctgattaatgatgcatttatcgcccctccccttaccttaattatcacttcgcctcgactttccactgcgtaaccatcaaaattattgtgcagcagcatatacgtttctttggagatgtgaatttagttagctgaatatgtaaaaaagattcattaatggtttttaaacgaacggcttgaagagctttccatgcgcgaggcggtgtttaccgtgtcgccaaacagacagtagcggggcatggccaaccctaaattacaaccaataaaatttttgataggaaaatgaatcaaattctaaaattacccattttaatttaattacacaaaatgtgtttaaagaaatttttaccgacaacgcccgcgacacatgggccactgtgcagtccgatgcggagacgaatgcgctcaaaggaatggtccgaaattcggaaggtttccaacgctttcaaaaatttcaatgccctaatttaaaaaataaaaataaaatttttgaatttatttatgccatttcttacatgtcagcacactgtttggcatgtaaattgccatttcgattgggaaggccggacacgcacaaatagccatcgcctaaaggcatttagtaaaattaaatacataattagtgaataataaaaaaaatgttaaaaaaaatatatttttaaatcctaaaagacatttaaaaactcaaataataaaagtgaatcgattctttattaaaattatgacaattttttaatcgtaaattagctgaagcatatatccaccatttatccacatgcattatttccttctatatgttttgggaacaattttaaaattttcaactaccagcctagccccaaaattcaaaaatgtcatttgtctgcttttaattaaaaaaattcctcgccaattgattccactttgtacatgtcgtgttcgtcgatgatcgcgtcaaaaatggtgtacagttcgttcataagattgaccacctgcagcggtcgcatttggttggacagttccgcgaatttgacaatgtccgaaaagaacaccgtaacgcactcgaagtgctcgggctcaaccgactggccaagcttaagtcggtccgcaacttggcttaattgcgttttggtttttgaatcggctttacagtaagggcaataaaagaggggggtgtaatagagagggagagggccgcgtgagagaaaaaaaggcaatttttttaatcacttttgctttaattaccgtggcatcatgcggtagaggagtatttccgatttgcgcttttcttcctccaactcgcgcgtccgttcatgcacattctcctccaatttgttggcgtactgctccaacatgccgaacacatggtccattagattgatgcttctgcctgcattcatttgccgca

SEQ ID NO: 24795 - DNA, 1954 bp, Heterodera glycines
cctcttgcgttgcgcatatgtgctcaattttcgcgcttcttccttaagcttttttagaattttaaaaagatttgcaaagattatacaatttgttacttttaatcgccgaccagaagcatattaatgccagttttcttaaaatgttattattttcttattcaatcattgatcaattgttcccacccatatcattcattttatttttttcaatcactctgatcactgatcagttttgccgtttatcactcactcactgatcagtttgttctgtcgttgattttcactctgatcaccctctcactgatcagcagtttgtttctgtctttttcgctctcctccgatttcgccccatttttgctcagattgccctatccgttgcgctgttttttggcttccgtcgactgctgccttttcctccttttgcttatccttttctccacttccgtctccaatgttcttcaagtccttttctttctctctttttcgattaatttctttgattttttttagtccgctccgatcatcagctgtcaaatgaccatcattttggtcaatatcatcgccctttttctgctccttttgttcatcgctcgcattgtttgacatttatttttcattttcattcgtttattttctttctaattgctttaattgtccaatttttagacagaatacgagcgcaaagttgaagcttcatgcaatgtggcatttaagaatgaggagcgcgatgtgcagctgatgcaggacatcaacaagttgctgatcgagaacattttgccctcgagcgttgctgcgaaattcctatcgcatgagcagcgaaaaaaggacgtaagttgtaaaaggattggacaaagcaaaagcagacgatcagccgattgattacactgttttgagtgatcagactgatcagtaagcccgtatctaatcgataaaaatggaagaagaacgatcagtttaaatctggtgatcagtcaataataactttcaagacgagtgtggcataaaatagtctccccaaagcaatcgcaaaaaaaaaaaaattaatttgacccccctttttgtgttatttaggaattatacgctcgtgaccatgacaatgtgtgcgtgatgttcgcctccattccgaacttcaaaaactattggagcgagtgcgaccaagcacggaaattggagtgtttgcgactgctcaacgaaatcgtgtgcgaattcgacaaggtcattcattcatcattcattcacttgcttaataatttgtgatttaatttttaataaattttgtatttttaatttaaaatttgacaattgtaattttttattctaaattttgatttgggtttttccttttcagttgttgtccaaaccaaaattcagctgtatcgaaaaaatcaaaacggtggccagcacttacatggccggtaagagagggcgaataaggcaagcaattaaggtgcctgatgctgattgattatcccctcattagacattaattagcaaatatccattgaaaagcgggcggtgcacttctcccaaattagaaaataaattcatttttttggcaaaaaatatttaaatttcagccgccggtctcaccgattccgacaccgcggataacagtgtgagtttatcttttaagcacattttgcatgggagtgaataacgcgctgcaatttgttcttttagcccgaacggaattccaccgttgtaagtggggccaaactgtggccaaatgaggcgttaatttctgtccaaaagatggtcgaacttgcgcaagcgatggccgcggttttggaccaattgaacgtcgactcctttcagaatttccaacttcgaattggcaagtcaacgaatgaatgtttttggcacaattgtcgatgcccttttggtactcatttgtcaggtctcaatgttggccccgtcatcgccggcgttttgggccaaaagccacagtatgaca

SEQ ID NO: 24796 - DNA, 1125 bp, Heterodera glycines
tcaaggaaacagtgtcaataattattttagtccggataataaattataaatattttagtataattttcacgcaggtatttcttttttatatctcatatttattcttcttattagtccaatatttcggatatcagcggttttttaacgcacttcaaaaagatgcgaaaagtttcgctgatattaaagcattcaattaatcgcattttcatagtcataaaagcaattttttatataaagcgtcttgggttttttggagttctcaatatggacattattaaaagtagggcatgtgcaataacatcataaactttaaaaattaataattttaatgaaaataagaaaatgttttatatatgcttgaaaatttccttaagagcaatagactaggatttagaaaagaattgtttagacaatcatcgagaaattgtcggagtcaaggaaaagtgtcaataattattttagtccggataataaattataaatattttagtataattttcatgcaggtatttcttttttatatctcatatttattcttcttattgagtccaatatttcggatatcaacggttttttaacatgcttcaaaaatatacgaaaatgttttatatatgcttgaaaatttccttaagaccaatagactaggatttagaaaagaattgtttagacaatcatcgagaaattgtcggagtcaaggaaacagtgtcaataattattttagtccggataataaattataaatattttagtataattttcatgcaggtatttcttttttatatctcatatttattcttcttattagtccaatatttcggatatcagcggttttttaacgcacttcaaaaagatgcgaaaagtttcgctgatattaaagcattcaattaatcgcattttcatagtcataaaaaacaattttttatataaagcgtcttgggttttttggagttctcaatatggacattattaaaagtagggcatgtgcaataaataacatcataaactttaaaaattaataattttaatgaaaatacgaaaatgttttatatatgcttgaaaatttccttaagagcaatagactaggattaaaagaagaattgtttagacaatcatcgagaaatgtcg

SEQ ID NO: 24797 - DNA, 2368 bp, Heterodera glycines
ccccccagcaacagagttttttttttttgcgagaaataaaaaccccaaaaaattcaggtgatacttttttgtgcccaccgaattccatacgaaaaaatcctccaatgccttttgttctgttccaaaatatttttcgaattgcctttactaggttcttacgaagttttagggttgttcggaatcttcgaattccctaagataaaattggttggtgtattttcatttttttgagagtggggttcgtttaattgcgtccataaaaaagaaattaaattctcctataaattactctccgcctcactactgtacgacattacataattggtaatattttgtatccagcatggcatgctgtagaataatcagattgaagggcgcaatagactcggcggaatcgattcaaaagtatttccttcaaatgatcatcattcaaaaactacaacccgctccgcataatttcccagcgtgcagacaattccggtaactgaaaattattgggatcagaattgcctaaagcttccgagccatgagattataaaggaaaccatgtacttttacccagttttaccgactctccgcacatatatcatgatccttcaaaggatttcagcgcatacatcctagggcatcgatggcacatatacatgttcattaatgttctattgacgtcttaataagctcctggatccttccacgtatatatccgggtttttgactaaaactgcgaagtacgaaaaattgagttctcgaacttttgttcgagtccgggttcgagactgagccaaaataagaccggattcgtgctcggcgcctcagattacccctaaaaataattttcttaaattttatttaaaaaaaattttcggtaccaagaatctatacctttgccggcgggtttttcaatcaaataaaaaaacaaccaggcctaaaaaagtgagatgccgtccattctttttattaatgattcaaatatttttcctttttgtttatttttatttttttgtttaacttatttttttccatttaggtacagtagttatttttttgcaaagttggcttacgccaaagttaaaaatccatgaaaaatttcaatttttattcgagttcgggttagggattagaaattagtcaagatacatgtcagattcgtgattagcgacctttaaaaccccggataaaaaattatcatggttttttatattaaaaaaattttgcaaaacaaaagggtccccccttttgaaaaacttttcaaaaactgtcactttccatatagtgccaaataaaccttacaaattaaatatacaatttttataacctattgtcaataaatcaaaggctcacttcttttatttagataattctttgtaaaggcataccgatttttcattaactacatcctaacaaacaccctaaaataatgcaagaagattcgcgtacatcacttaacaatgcctttttgcttgcttataatactcgcatgaaaatggagcggtatataactaaaatattatacatatacagtaactcatgcctaatttagtgcgacgaatggtttccgcgaatgccttcagatgcttgcggcttacaagcagcgttcgcactgtaataatgcgcgtcagagtaagatgtcgctgtacaaaacgcaaatgtgccataatattcaaacgctgggcttttgcaagtttgtttaaatattaaaattgaagaaaatgccggtcagagccattttttgttttcttttagattcggttccgactgcttgtttgcccataacatgaaggaactgcgttcggtcccttcgaatctgccgaacactcctcagttctcaacggcttctaacgttccggtcttcgagttcgagtcggagttgttccagcacaaccacccgtgcaattctttgtctctcactgtgaatgccgcgttcggagatcaaacgtcgaacatgctcaaccgtagcttggtcgaggaggaattttataaacttacttcttaatcggaatgggcttttcacatttgtaacaattgtttttgtcatatactcatcaatcattgaggaattttaatatgaatgtaaaaccacttatccttgatatcctcttagttttagtatgatttctttaattgttctacgatatttatttatttttattacgtaaacgataaaaaatgatttaattcgaacgaattcatagtttttcatgaatgtttatttctatcattgaatttcttacttattttaaagcatcattatgtatattgagaattgagaaatattcaatcttaaattaacacttatcacgccagacatgttttcacctgattcaaataacgggattttcaatggaaatttaacaaacgacgaatgccg

SEQ ID NO: 24798 - DNA, 1634 bp, Heterodera glycines
attcgtggctcagctgcctcaaaacacccctagaaacgtgtcctcctaagttttagaaaaaaaatttaaagaaaaaattttcaggattaatgatctaggcgattgccggcggcgccaaaattggcatgaccccaaaaaaagaaaccttaaggtgctcaacccaccccaaaaaatttcataccgaaacctcgcgaatgcggatattgttgtaccttccctttttagcattttaaattagcgcataaatacccatttggcgttttgaactgaatacaaaaaaaagtaaaaaaaaaaaaaagtctcggagaaactttggtattcacacaaatcagtcgattttgtactcaattaactatagtagtcaaactattgaatacctagatgtgcaattgacctttcatatttcttaagggcttctgggttttttcctaaaatttccaacttgtttactaataatgcaacaagtggcgatcattggccataaatcattgctcggtgcccacctggtgaaggcgttcaatgacacgttgccagatgtcagaaagaatttgtgggactatggcataaacagcatggaaacgttgcccactgctttgcagaactgtgacctggtccgtttttggtcataattttgcatccaaaaaaataccaaaattgtagttgatcacttttactaataccatgggagtttttaggaatttcgggttgtctatttatggtagggtgccattttgactattttagaagccgaaatcaggcaagaaaacaacagaatccacaatttcagtaattaacagccctagtttcggtaatagtttaggtcttagatagtagcccgcttcaaattttcaaattattgcggtttggggctcttgtgcagtttaggccccatatacaaaattttttacattttagaataaaagaagccaatctataagttttcggggtcgctgatcgcgaatccggcatccatgtcggccaattccaaatcccggacccgaactcgaacaagaagtcgaaaaattaaaattttttatttttcatttttagtctaaaaatagtttaaatgatttttaattgaagcactgatgactttcagttcgtttccgtgtatttaaacaatgctgaccaataatatgaaaaccaaaaattttaattttcgactttttgttcgaattcgggtccgggatttggaattggacgaaatgaataccggattcgcgatcagcgaccacgaaaacctatagattggcatattttattctgaaatgtaaaaaatttttagtatatgggcctaaactgcacaagagcctatttatgtaccttcgccacaggaggacgcggcgggagtctgctgccaccagcagaagcattgatacgtttgaagtccttgccagcggccagttgctgttgtggattgtatcggatggctgtaccgacgcgaatcccaccaggcccggacacaacggccgcctccctccccttctcaccatcaatgatgtcaaattccaactgaaaatggaagaaccaataattttgttatcgacccgggctttacatcacaaagcatttggctggggtgacttgccttttgcccctcaatcagcacgaaatgcatttggacctttcgaaca

SEQ ID NO: 24799 - DNA, 1839 bp, Heterodera glycines
  misc_feature (1800)..(1800): n is a, c, g, or t
cagctgaacatcgtgctccaatcaaggccaatttcaccgtcgatgggctcaacactgttgttcttgcgctgatcattttctttgccattctttttgtcgttcaggtgccgtgcctttccttgccttatcttcaaaatgccattctccccactttttaatttaatttccactttaattcttgctcattttcagttgtgtttgttcgcctgtttggccctttttctgccctcaaaatcggtgccaatttccgactcggtcgacccatggacagcggcgcctgtggcaactgatcgggagaagatgacgacgatgtgccagaacaatggcatccaaacccacattttcattcccattgaagaacagaaattcgtttatttttaaggccattgaatttgcaaatgttcctctcttttaacccttaaaatttggcatctaaaaacggtgatattactaataaattcgtttttttattgtactgcatatatacacagattactgatgataaacatgattcaatctcttccccccgttgttcaacaccaaaaatttcggttgtttgttttagctagggttcgccccgctctgatctttttttccaaggatgcgttttttctagggtaaaagagcttctaaactggttttagcgtgtattttggaaaaaatttcaacttttcattcgaatccggggttcggaaatgggcaaacccgagttcagattcgtaatcagcaccctcgaaaacccgcgtgaactgtttttttgctcaacataaaaaaatttaaattagagagaccccctattctttaggattgcgcaagcgatcattttttgactgaatttaagcgttttgggaaaaaattgcatgttttaaacaacagtttttagcacatttgcttagagttaaggcccgaccctgagctccccatttcccgacctgaatttaaaaaatttgagctttttccaagaaactgcagtccggcgtgcgcccagcccaaaatttaggaccgggggtcccggaaaacgggctttttgtcctgttaagcccgttccggtccattttccaagtcactgcactgttcattttcaaaattccggctttaatttctcttattaatattatgactattttccgcttcatggggttaaaataattatgtatattctgaaaaaatgtattttatgaaataaaaaaaagttataatatttaatttttattagaggaatttaattagcaatttttgtgcatgttgatatacaataatttgatggaaaagctttactaacgtacaacagagggattgaaatttaaaaaaagagattaaaatgaacggaaaggattgaacattaatcccaacggcaacaacaaaaaagaatttgaccaaaaaaaaattggtgccgttgggtttaattaacattaattttattaataagagccaaattccattaaaatgggcagcggtttttttttggaggtggtgcacaacaaaaataagatgcttttgtgttaagtgaagcatgtgttgggttggagagcggtggtgcttttcgagactctcgagattttccgccgacatttcgagactggaaagttttcagtctcgaaaagcacgcggtaggtaaagccgggataaaaaacagtcacaaaaatattaggcaaatgaatgaataaacgatgaatacatttgaacagtactttggctggctgtgaatttgcgagaaaatggaattttgcgcataaaattaaatgaaaaaagggaaggagaggcggcgagggagtgaaataatgcaacgaatttctttgnaagacgcaaaattgagggggagagtaggcttatcaattc

SEQ ID NO: 24800 - DNA, 1562 bp, Heterodera glycines
  misc_feature (1265)..(1265): n is a, c, g, or t
gtgttttttttataaaaagttacctaaagtaattaataacaatttcactgagtgatttgggaggtcgcattttcaacgaaaatgcattgttcacattggcgattggtgtttgctgagacaaattggacgcaacagagaaattagaggagcccgttgacaaagtgttatgagccgatgagagcagtttcagaggaagtctgctgccagaagtgatttgctttgaggaggaaacggactgtggccgaggagtaaacggctgggggtgtgaaattggggcgtctgcctttgaaatccgtcgcgcaagaacattggcgaacgcagcttcattttgacgaggcttaatcaaatgaatttctgaaacatttgacaagcaaatgcaattcacaaatccgggcagagaagcgggcgttgaaggaattcgacttgcgggaacattcggaagttccccctccatttgcagctgtttggcagtccgtttaaagccaatgtcactcaaatgctggtaaatcagttgcaacagttccttttcattgaatttgatgtgtgtcttcgcgacaacggcagcccgccaaagatgctccttaataaataagtgtcttctatgcaatgttaacaaaaaaaacctgagtcattccaatggcaaagtcctgtaatttggtctgactgacacactcaattaactgacgcgcttgctcacaaaaacgactatgttcaatacgtttctcaagcagaataggagattggattaatgctagaaattaaagtgaataatcatacaaaatgagaaactcacttatcagttcattatttgcaattattggcaatttgctcaaaatttggcggatcggctcaaaccgagcgattccgttcagcgcgcggcaggccaattcccggatcgagtctgcttcagttgcgggttgttgcttatgcaacaaggtagtgagaacctaaaaaatattataaaaatcaaaattctcacatcttaccataattgcattattttgctgtgaacatttccaaataattttaagcaactgtataggggtgacaaataatcgcaaattttgttgtaagttcggaagcgaagaagctggaagatgcgcaccatcgcaagtgggcaaattggatgatggaaatttcattgagagttcgctgggaagaagatcacgttcgaaattggatgtaaaacgataatgaagacccaaacagccattggcctaaacaaaaagaaacatacataagacaaaattcacaatcagcatcancctggttggttggaccgcacaaacagttcgtcaaaacttcaagcgccaaacgttgcacttggatatcgttaatgagtataccttcagccaattccataatgaggctaataatgaatttgaaaaatgattttgaaatggttttttctttacctaatcccttgaattggcgatgaacgaattttcattgtttcgcaactgtccaattgaacttttggcgacacagtggccaaccgaaaaagctcaagcaatagtttcaacgtttcaaatttgttgacggaacctcccagctgttccagt

SEQ ID NO: 24801 - DNA, 921 bp, Heterodera glycines
  misc_feature (675)..(675): n is a, c, g, or t
tgccaaattttgccattttctgcagcattggcatttacagatagaacccccaaaccaacggcattcagtgccaaacattccaacttaaaatcctacctccaagcattttccgctcccgcttcttcccgcaaagttacaggcctccaaagacggacaaaaaaaatttcacgccgtttcagcgccgccggcgctgaaccgtccaccggagcggaaaacccatatttttcccagatgcgcctcaaaaagttgtaagacccttccaccactttcagacccctcccgacagccgttcgactcaaattagtttttaagacgagttgcaacttttctctatatatgtataaactagcgtgtggcgcagtagttgctcggtgtagacagtatgctttttgtatgtatggacgggcgctgacatgagcgcttcgcgcaaaggacttcgttgctagtgcatgcgcgattttgaaatgaatttatggatgtgataagggattttggtctacaggcatcgtgaggacgcattcataattttgtagaggactttcggccgcttcgcggcctcaaaatgtgctccgcgccttttttatatttaaggtttaattcggccgcctcgcggccttcaaggggcgctccgcgccctttttatatttaaggttatatattcggccgcttcgcggnctcaaagggcgctccgcgcctgacgcattcataattttgtggaggaacattcggccgcttcgcggctctaaggacgggcgcttcgcgccattttcataattttatggggatacattcgggccgctttcggcggcctcagggacgagcgctttcgcgcccatttcataattgcgcccgttttttaattttgcgggggacattcggccgcttcgcggcctcaggacgggcgctttgcgcacgtttttt

SEQ ID NO: 24802 - DNA, 1081 bp, Heterodera glycines
  misc_feature (1044)..(1044): n is a, c, g, or t
cgtcaacagcaggtggaccacggggatgatcacactggtgatgatgactcatttctctcccgccgtcctccgtcacgtcgtttaggcgcccaaaaatttttatttctttaaaatttggaagaattttaaaaatatgtttgttttggttaatggattcgatttttattggaacatcatttaatatatatatttttttattaattggccaatttgtggcagaacgttggccgtaaattattaaaacgagtgaatggtatttcaattttaaatcgttaggaaaagtggaagaaaagcaaaaattttatataaatgattttaaaaattatatatataattaaaatgattcaagggattaaaaataaattgtttaattttattggcgacaaaaagtgatcaaatcatctcaattataaaaaaatttaaaaagaaaatatttccttcgataaaaaagtgaagcaaaaatcaattttaacataggcaattatgcaaacaaagaaaaccctaaaagaatttataatgaaaaaataataattcttatttctgtacataaatataattattttcaaccaatttcatttaattgaaactcattaaacataattactaacagactgtttggcgaataataaagcaataaaaaattcaaccagtgagtaattaatcatgaattcattatcacatgccattaaccgaaaatagctatattgtatctcataagataatttataaaaaaaataatcaaaaaatatattaaatttttgtctccaatttatgagcttcagctaaatacataataaataacccaattcattaagcgataaaaacgaaatgactggaaatggcaagttcgctttgaccagcagtattgacaaattggacaccattaattaattaattaattaggtcctctttatctgtatgccgcccgtaaattgatgactatcggacaatgattgcctagccaatacataacacgtactcattctgatcatcgctatgcaccgtctgtcaataaatattaattttttttcatttaattgagtncaaaaaaatttattttatttttattttaggtttggat

SEQ ID NO: 24803 - DNA, 1153 bp, Heterodera glycines
  misc_feature (1138)..(1138): n is a, c, g, or t
ttttaaatttattcaaataaaagaatccaaaggaaggacaaaagccgcttacacatttggatatgtttagatctccaacagttttttaagtttgattctgtaactttgtatggaatttattgatgagaaatctattgttttgcttaattcttgtaagttttttgtagtacggttaataaaagaatgttcagttttagttattttagatttagtgattaatctgagaaaaggcgaatttcttctttgagataaattgtataattttagagggtttaggtgagtttcttgtttaataattttgaaggctgtgatcagatctaaatattttctcctattttccaaagtggaaatattaaggtattttaacctatctgaatattgtaaaaccggtaaatggcactttaagaaaacttttttggtaaaaaacttttgaaacttttcaaggcgaataatttcttttttaatgtgagggttccaattttcagatgaatattcaagtaagggcctaatatagcttttatagactttaatccatgtctttgatgatttagatttaattttttgaaaaagcgttctgcttctaaggtaggctttttgaagaatagatgaaatatgggatttaaaagtcagtttgttgtcaattaagattccaagatctcgaattgtttgggtctctttaatagtctttcattaaattggtagggaaccttaaaattgtccttgccgaggtacagagaagctgatttttctggtgaaaattgtagaccccacatttgggcccattggcagacgcaatgtaaggcttcgtttagttttttacgttgaaattcggtgtcataacacaagtaaattttagtatcgtcggcaaaaagttttagcgaaattccttcagggattactggggataaatcatttataaaaatcaaaaatagaattggccccaggacagatccctggggaacacctgatttgatgggaaattctttggaaaactgttgattaattctgaccttgaatgtcctgttggttaggaaatctttgagccaatttagaaggttgcccttaattccaattttttctattttataaattagcaattcatgagggactttgtcaaatgctttaattatgtccaaantaaatacagtcgatt

SEQ ID NO: 24804 - DNA, 933 bp, Heterodera glycines
actttaattctgcgttggatttttgctccccacatacgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttgggatttttgctccccataattgtttgagtaccccatacggacacttgaaaaaatcgatttttttgtgttcggggcagtcccctccgaccgatgcgc

SEQ ID NO: 24805 - DNA, 1405 bp, Heterodera glycines
  misc_feature (1344)..(1344): n is a, c, g, or t
  misc_feature (1355)..(1355): n is a, c, g, or t
agatgaaggaaaataatttttttatcaatattttatattaagttatgtttttgaattgattgaccctatcaaatgaccagtgatgcagttgtaaaatttttcggcttctcgcgcaaagtttttcctggactgtttctgacagattgttgagataatttttgcttgttttaggaatatttgagtatatttacaacaacaattttgcaatttctaaagatgaaggaaaataatttttttatcaatattttatattaagttatgtttttgaattgattgaccctatcaaatgaacagtgatgcagttgtaaaatttttcggcttctcgcgcaaagtttttcccggactgtttctgacagattgttgagataatttttctagatgtttgttcatatctcaatacattatttatcgcttttaaattgaatggaaatgaattgtcagtaacaaaaaaaatattttgtgaacatttataacaaaatttttttaagcattttctaaagaggctttttgacttcaatcataattatattgtcaattgtttgaaacgcatctgttgccgttggaagaggccgatggaaaatttttcggcttttcgcgaaaaagttttcccagaaaatggcgtgggacaaataaaaattgtacttttattatgagcaatatatatttcctatcaatttcgggtttgctttacacgtttgccaatgaaaaaatggagttttgtgaatgcaaattttaacggattttctttcgacgtgtcataagcgggttgtttcgggacaaatgcaaaccaatttgatgctattcgaatgagctaggcgcgctctaccctttcaaatgtatcaacaaagggtctaccgccactccctggcgagatatggccagtcaaagcagagtgggtctaataaaacaagaatttttaaaattttcggcatttgcccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttgggcaatttctaaagatgaaggaaaataatttttttatcaatattttatattaagttatgtttttgaattgattaaccctatcaaatgaacagtgatgcagttgtaaaatttttcggcttctcgcgcaaagtttttccctggactgtttctgacagattgttgagataatttttctagatgttngttcatatctncatacattatttatcgcttttaaattgaatggaaatgaattgtcagtaac

SEQ ID NO: 24806 - DNA, 1022 bp, Heterodera glycines
tattattttaaattaatatttgcttttcacatcacattctttcggcgtgctttttccaaaaaacttttgtggagaaaggggagaccggcggtgccgataggcgccgccgggggaaattttgaaatttgggtgtaatttgttaacagatttaaaaaaaaactatgaggcatcatattttctctataggaaacccacgagtatacaaaaaggaaattcaaaataatttaatttctgtagagggattgaaccaggggaaagaagaagggaaagtcaaggagactagccactaggccatttgcacacttagcagtattactgttaaagaatatattaattattattttttcctttgactataattttcatcactaatttcacacttatacccccattcttaccagtgcttgtttttcccggttcccggttgccctaccgggaccgggacctgagcttttcaaaatccgggaccgggaaccgggaccgggacctcggatgaccgggaattcccggcccggtcccggtcccgtggcactctaatcagaaccacttttcggaatatggcatcaattcattggcacaaaaaattttaaaataaaatgctttaaaaaatgaatgcgagggggagagacagactaattgtaatggattaggcagtgatgacacaagtgaaaagccaatagaaaagcatgagcgtacacatagattaagcctaaatttattaacaaataacaactacataacagagtggtttggcatgacaaagaaacacaatgcccgatggtagttactttggaccaacgacaattgcaacgccatcattacttacaacacctgcactcggcattatcggatccgccatcttcagcagccccagctttttcatcatctctaaccgaatccatcctcagatggtccaccaccgttttttctccattccgtcgggggttatcattactgccagccgcattgcaatggtgttaaaggggttattttgccggggggggggcacccaatttatttgg

SEQ ID NO: 24807 - DNA, 1764 bp, Heterodera glycines
tttttctcatcccatgggatatgatttacatttttgacccagtactcgttcacgctcggcatgcaccaggtcatcgaaggcatggacaggtggtgccaattgaaaattgatgacttttccctgggaggctaataaaatgcatattttgggataattaatcgttaacattgatccgaaggtgccattgttttgacccggaaatgccattgttttgatcaaactagacattataaattaatacgaatttcaatattttggaaaaatattttgaaataaaaatttaaatattacatttattttaaatttcgtatttacagagcaatgaccggcatgtgcattggagaaaaacgccgtgtgaccattcctggaaagttgggcttcggcgacggtgggcgaaagaggtaaaacaaattttaaaaaattaattaaaaattaaatttgaaaatatttttttttttcaaaaagggatggcatcaagtcggaccaggtgctgcattacattgtacaacttgtcgacctgtttcgtccgacgcccggcccacgatggcgcgaggaggacggcctcgaaattgaggtggttgggttggcacatttgaaggagcctcggaatggcaaaaacttttgagatttcaaatctttattttatcagtgttggaaaaattggaaatcaaccattgggtcgaaattttctcaacaatgaaaaggaaaagtcaaataacttagaggtcagctctaaaaactaagtaacatccaatacggattttaattaggattggtggaaaattccataaatttagtcctaaaaaacaatagtttttctaacaataagacaagaagtttgggtccaaaaaattttcggaatgactttcaaagaaaaacaaacccctatgtttttgtgtttattttccaaaaaaacaaacaaacaaataaccaaatttctaaaggccctaaacaaattgtgataaagccacacattcaatagtctctgttaaattaaataaagctgctggcgaaatcaaatgtccgtaaagttataattaccgagcgaaaattcaaaaaccgtaaccacatacataattacagtagctctccctagtttgctttaattatgcgcttgacagccgcgtagacgtaatcaatcaattcattaataaaataatataatttcatccgtcgacaggtgacccacaaaattgaggaaagcgcttgccgtcgttcggcacccggcgacaccattcaccagcactacacactgaacttggcggacggcacattcatcgactcgtccttctcacgcagcaaagtatgaagaagagaccatagcacgggagcagcttgccccccccgcccccgaaaaatttaaaaataaattgtaaaaagtttctagcgatttccaaaatttgaatgaatatgaaattttcaaaaaaaaataataaatttttcaaaaagatgctgaaaattttcaatttttttcttcttgatttctcataaaaaattttcaacgattttttgaaaaatttttaattgaaactttttttattttcagggggaaaatatacggggggaaaggcagggcgggtgacgggaaataaattcggtgaaaatatttctgttgctgttttcttacttgcaacaaatttcatccacgtcattttgaaaaatttgtcgggcatttgtgcccggtccacaacatttctttaccgaaggtcgggaaacaaactaatttcatccgtgatttgttccaacttaccgacccgaactttt

SEQ ID NO: 24808 - DNA, 1492 bp, Heterodera glycines
gaagctcagtgagctgctcacgcgcctgcttatatgcctgcgcagcaggatgatgcacttggatcatttgttctaagatctcaagagtctgctcatttagctggtgaccctgcacaaactcatcttcgtttgtgattttctccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctcgcaaattggaacaggttgttataacgcgacatgtgtcgcacaaattctttcccttcacgggattgcttattccccacaatcagctgtttgagctcatcaggatgcgggttaagcattggcagcacaactcttcccttccggcagcaaatgctactgtcttcatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcggggggcgtttcggcgccggtgaaggcgaacggctaacagaagctgaaagccttttttgaacgcgcattgatcgccttggtggcgtcttaggtctgatgaaaattacatcatcagcctgcgcaattggctcttgcgggatgcaagactccgacaccaaaccaagcgtgtcagcttggttttcaccggccacttgggcctgggtgagaatggcatcaactgcctgtccacttgtatgtggttcgatgatcattatatcatcatattcatcaacttccattagctcagcggccttggatgtcgactgcgcttcatccgtatgccgatagacaattgggcaaggagttggcaccccttcccttggatgatatggcacattatcagagccatacagctcgttaatgtgccataaaatgcgctttttttcataattgatggataaatcaggcagaacaaatgtgcgattgttcataagccatgactcagcatacaggcacacgaagtacccacaactattaccatcgtgttggaccgtcagattttcgacatcaacaatccctgtcaacactgctgacggcaaaatatccgaaatgatatttttaattttatccgtcagttgcggatccaacctgccatatgtggtaggcaaagaatcggcaaaatgagtgccaaattgcacatcatggataatgagagtccaatgtccagggaaatgtactggcaaaagtataacttctgccggaacattagggtcgtacccaaatgtcatatttttgtaaggcatgactctgtccaggccattgctccataccattgggtcaacaacgaccac

SEQ ID NO: 24809 - DNA, 1099 bp, Heterodera glycines
agaagaaaagacaccagtaatacagaatttagaacacaaatttattattatgaaaaaagccaaaaagtgtataggaagctagttctgtattattcaatttaactttaaaaaaagttcaatcagctgttttctccatgctaatcactagagctgggattctaaggttttaaccttttatacggattttggtagggttcggaccccaacaccttgctaactttcacattaaccaattttgcagggcgccgctgttgtcaaagtcagtaagcgtcaagcagttgatgagggccttaggaaatacagaaaacgcgtaaaagaacagcaagcaaaagagaaaaagcagaaggagaagaagccaccgccaaattccaccgtatgccgttaccgtactttctcattttaataataaaaaaaaatttaactttaatgaagaatgatgctgccggtggtaattcaacgggaaacaaccaccatgggtcccgtccagctccagcaggtggcccagacgacccatctccagacgaaccgggtaggacggacttgcatttggttaaggaacagattggccgcaattttgctgtcaaaaaacattcgacatgcatgactgaagttattgcgttcagctattttatggccaatttcctttattgaaaaagccaaatttcatggctatacctacaactgactacatttacaaaggcagttcatagaatggagggatttcttaaaattctaaattaagcaatgttatatcaggcctatctagataatatcttttggactaattgccagcatacgacattaaaaattttcaatgtggacataaggattaaaaataggtacaaaaaattgtaaaattccaagcttcggctcaaaaatatgtgtatttttctgctttcttatgattctgtccaggaaaagaggccaaagctcggaggattataaaaaagtcgtgtgctgggtgccgccgtcgttttttattgacttaattggttccgaattcagtatcaaatgcttctgatggtgctgctccagctggagatgatgtttcgatccctcgtgaagagataaatgaaatgaaacatgcggggttggggcc

SEQ ID NO: 24810 - DNA, 1628 bp, Heterodera glycines
  misc_feature (56)..(57): n is a, c, g, or t
tgcctatttcgcgattttttgtgcctaaaaatggacttcctaatgataataaattnnttaattttttttccatttatatttatttatgtaaatataaaacgctgcataaaattaattttttttttgaatttttaggttcgctccattgagacttattatgttcgacatagcaccaggttgaattgtttctttgtgaattaattaaaaattaaacaaaaatttcatttaattccaataaaaaaaaattacttaattgaatgaaaatttgatattcttatttatttctcaccacatgttgttaacacagtgagtacatacaatcttcaataaaaattaaattttattttaaaaatatttttaaattaatccatacaatgccgttggaaatgtccatttgttatggatattgtcaatctgttcaggggccaacatttcttgtcgaattggtcgtctaaatttgattatgaattatttaatttgtgataaaaaaaaattataattattgcaaaaaaaataaagaaaaaataaattcattgttttaaaaattttcaaatagttaaaaaaaataaatttataaaaatactaaagttatattttaaaaaaagtttcttaaaattatctacctgtcatcaacttctgccgcaacgctgatcatataatctctgaatttttaaataaattttatgggggattaatcatcattttaatttgatttaattatttttgcctaaatatgtcggcccattgttcccgatgcatttgggcatcggcgccaaatcggtcaaccaacatatgccagctggactcagtgaagttctcaatgagctgatcaagccttatcagttttcgagagcgtgccatctgtgaaaaaaagcatttaaaacaaaaatatacaaaatggttttttgataatataacaaattaattacaagctcagttcgggtctccaatgcttgtaaaattccagctcctgaaagaaaaatattattttatttatgcttataaaaattacaacaataataataaagataattataaatttataaaataaattaaattgaaaaaaggtaattataatgataatcgtaaaaaattcatatttatttttagtttttattttgttttttataaaaatattgaaatatttttaatttaaaaatataaaaattcatatacctaaacacaaataaccaattagtacagcaacaagcacaacatgtggtaccataattttgataagctgaaaacccaaaattatatatgtaaaaaataaaaaaagtattttatttaaaaattaatttatttttaataaattgtattaaattttttataattttggcattacaaatgccattgctgaacgaacaccttgagcactttttgtgggcaattcaagcccgtcttggcctcgtcctcctcattcagttggctggtcaacagtgtgccaacatcgtccccttccaaaagtgtgggctgttttggcattggcaatccgtcccaacgggcagtgatattgtctaaaaaaacacacacaaaaaaaaaaggtaccaaaatgaatttgccataatatacagtaagattaaattttaaatgtaacaattattattttctttattattttttaaaat

SEQ ID NO: 24811 - DNA, 1245 bp, Heterodera glycines
gtttgaatccgggttcgggcttcgaagctgagccaaaataaggacggattcgtgctcggcgcctcagattacccctaaaaacaattttctaaaatttatttaaaaaaaaaaaattcggaaccaataatcttaatccccacgtcttaaattatcccccccccctttgaggagtttgaaaaataacccccatggggataaaaagagcatatacggtaaagttctttattagggcaatcatgaagattattggtcccacaaaaaaaatgaataaaaattcaaaaaacacttttttaggggttatttggtgcgctgagcacgaatttgaccttcttttgacttaatttcgaaccccgaacccggattcgaacatttgaaaaaattcaaattttcaatttttgcaaatattgctgatgcattgcttggtactgtaactcaatagagtaaaggaaatcgaattcttcctatttacatacgtatgatcaataactttgaataacaaacggatcgagtcagttggatgaagtcgtaaacaaaaacatgaaatcaggcaaactattgaagaacataataggcggtcaataataatgaccagatcaaaatagacactgagaacattttcaactaaccttaatactagcttattaacaatttagccatggatatttttgatatttgttcacaatttcaaaccaatgagcatacaacttttacggcaaattgcccatatctgtggctatgatttatcacattgccttttattaccccgtgaataactgaattgattcgatttcctttactcatattgtagttacagtaccaagcaatgcatcagcaatatttgcaaaaattgaaaatttgaattttttcaaatgttcgaatccgggttcggggttcgaaattatgtcaaaagaaggtcaaattcgtgctcagcgcatcaaataacccctaaaaaagtgttttttgaatttttattcctttttttaaactgtaatccaagtccaaaattttcgcagtttcaattgaatttttcggagtcaaaatttccttttctaactaatatatttatatgcatttaataaaatggaattcaacaattgattttatataggtttattttttaataatgtatggaggatgctattttcttttgtatagactcttttaaacgaatgcagccagtaacgggtgcaccgtcgcggttgttagtgcagtagcagctcaggcgcagatgcgtggctggatgtt

SEQ ID NO: 24812 - DNA, 798 bp, Heterodera glycines
ggtttttggtagcaattcatattaggccttgtagtgggatctgcgaatcaccacccaaaacgacgccatccttaaatgaattattagttgcttataaaaaaaagaacaaacaaaagtaaataccataaaaggaaaaaaagttaaaatattttaccaatttcagcaaatgaaaaattacctggaaaatagccccaacaaccgttgttcccgagctcgtcatcttcgtcatcgttttcgaactcgtttaccaaaaccttcgccgtccatttgtcgcttcagtgcatgattacgttcgcacaaagagaagtcaaattcagctaatcctccgactgatttgtttaacaattcgggcgattcttccatgacaaaaaagagtgtgtatttatgataggcttaaataaattaattagtgccgggattttgtagaatttgatatttcttgctaattctggacgagctaatgtaggaaagcatgagaaaaaaacacttgtctctgtattttctcatcatttttttaatttaaatgaatacaaaatgccaaactcaattagacagttgaccggaatcgggcgtccgataaaaaaaatgctcgtaaggcggccggtcacgatggtttgtccaaaaaacatgacagggccgggtcggtagaaacctgacgggcccccggggcctgttgtggctccaactaacagtttcttaattaccaaacctcgtaaaaactccaggaaaattttcctcaatgcctccaaaccccttaccttatttcctcaaaattttaataatattagcccacttttt

SEQ ID NO: 24813 - DNA, 552 bp, Heterodera glycines
ctgtcccgcccccggggacgggggcggggtccgaacccctccttaaaaataacaccattcgtcttgtcttagcgagacgaattgtaatttatatgcaaaatcaaaattgatagtattcttcaattttaccccaaatttatttcaattatttcaaacaaatatgtaatcattttttggactaaatgatcgaatgtttctatgatcgcttgaaagtgtcccctttcgaagtaaataaggaattaatctttcttacataatttttttttatattaactccgagcttgcaagtgataatatttttaaataaattaattaaaataagcttttttaatgttaattatgcgttaaattcttcaatttgttttgcttgttttcatttttgcgggttttgcgcaacgacctagcacccggaaaaatttgtcattttttgacaaatttcggtaaaaaatctcattaaataacagtaattttactgtattatagacatataaatgaataaatgagtgaatggacaacataaagaataaatatctaggtagtataattaagtac

SEQ ID NO: 24814 - DNA, 1593 bp, Heterodera glycines
ttcatggctttttcatgcttttttggtcctttatttcctgtaaacatgccgggaaataaatgacggttatctgcatttttcgccaaaaatgccattgctgatcacatgataaaccgtagaaatgttggcccaaacccaaattctgtgccgcctgatgctctcaagattttatttaccttatttcctaaaaagagcccccggggggctttatttttcaacacctcacaaaagggaggctttatttcagggggcggctttattttagaaaatacggtaatagataaatctcatttttatttcaagcaattaaatgcgctgatgaactctttttcgacaacaaatggcacttgggcaatgatacagtatccgagcagtgcgagctgggtgtacggtgctattcaattatttgcgaacacagtaatcaatcagttggggaaagaataaacacttacatattggatcaccacatattgacattattgcagcagtgtgtatgtgtagcagggttcggttttccgaggccccaacaacttttttggaaaacggaattcctctagacctaaaaaaaatttcgtaaaaacggagttccgggggccttaacaatttttggaaatttgaaccgacctaacaatatgatggaggtggacaattaactaccggagaaaaaatttccaaaaaaaataataataattttactgaatttttgtgcctttttttaagacaaaaaacaagtttcattccgccgaggctgctctacattggctttttattgcgaaaaaagaaatctgtacgtgaggctggggcgagggggtcagggtcaaccaggggtggagcgcgaccgcgatttgcggcattttttttttgccgtgatccgcgatgcgcaaccgcggcaatttgaatccgcgactgcggcaaattgaatccgcgatccgcgaccgcgggatttttctgtccgcgctccagccctggtgtcaacaacatgatgtggggcagggatgacattccgaggccccaaaaattttcggaaatcggaattccgagggtcaaaaatttttcgcaaatcgaaattccgatgaccaaaatttttctgaaacaggaattccgaccacaaaagtgtcggaaatcggaattccgtgccatccctgctggtgtggggtataacttctttaagagtcaaccaaattaaacattcttacaaccattttgatagccctaagtgttttcgattggcgtgaaaaaaaattggtggagtttcaaaaagattattaacaaaaaaatttgtttggaaaccagttttttgaagtttttttgggcctaactttttgaaacttaaccaaatctattggaactttgcagacaaatagggaatacttaaggctatggaatgataacaaattcatttagtttagtcaactatgaaaggagttatagcaggggggacaccctcgtttgggcgccagcccagtttttagactataagttttttctttgtcaaccaaatccaacactgttggtatcattcgaaagcccttcagatgctttattagtctgcaaaattccaaaaaatttgtcaagtttaaaaaagttggaaaa

SEQ ID NO: 24815 - DNA, 1382 bp, Heterodera glycines
taaaataaaatttttaaatttatttttcgtcgggaccacaattctatacaattgcacaacattggaatccccgtgaaatttttttggaaaaaatcaacgcaaaaaatgacattttttcagtttcgtttcgtatttggtaaaagcaatggttctaatcggttttacgcgtcccatggcattttacgcgtcccatgacattttacgcgtcccataacattttacgcgtcccatcacattttacgagtcccaacaacactttacgcgtcccatcacattttacgagtcccaacaacactttacgcgtcccatgacattttgtgtccatggcagggatggcattccgaggccccaaaaattttcggaattccgtgccatccctggtctcatggtattatagttgtcctaataactaagagaaaaactattttttttgtcaggtattcagtaaagtttttaactataaatttcgttgttaagcctaaggttatcatgacaacttatacacaggcaactcgaacaatggcttattgttagactaggcctaagcttaggcttttgtaaatttttttcttatattagttgaatttctgttgacatcattaagtgtgcttagagttgcttttgcacatttcgatgatcaaagtatacaagcaagaacaattagactattcggaaggtataaagtttccgattgacggttcgaaaaacattttttgacgcgtaaaatatgatgggacgcgtaaagtgtgatgggacgcgtaaagtgtgatgggacgcgtaaagtgttgttgggacgcgtaaaatgtgatgggacgcgtaaaatgtcatgggacgcgtaaagtgtcatgggacgcgtaaaacccgactagaaccaaattttttttactattttcgtgcctattttaggatttactgcctttttaagtgcctatttcgcgattttttgtgcctaaaaatcccatccctatacataatggattatggcttttttgcaaagaaatttaaataaaaattattttactttaatttaagctattattatgagccacccaatttggcaaatcggtctttttaaacgcattaaagaagattcagtcgattgcttggagtgtaagcaaaaaaacgttatttatttttcatcttcatcattttttggtttaaaaatatattgaatacttttttatactttgaaagacttttattaatacagaatttttttaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctatattcactatgggt

SEQ ID NO: 24816 - DNA, 1062 bp, Heterodera glycines
tcccagacgggcactgcacttcattctttggcacctgttcaatccgatcagtgcccacccaacacttcagtgctaaattaagtattgccttaatcatttcaaaaaaattatttttcaaaaaaaacttaggttttcttaagaacaaccaaaataaattcaaatttttgactatttaaaccagtcccgggtcccgccccgatcatattgacttggctaaaaccgacttaaatttaaccagtgaaactgcgccaaattaaaaaattcaataattattttggcgttatgtcttaattcaaagttttaaagatagaacaaaagcccgaactcaatggatttttggaaatttgtacaatttcaactgctaaaataaaaaaaaattttctctgcgaagcctgtcggcattgctggtctccgcatttcattgtttccaacaaaaagaaattagactcaaaaatggatttttttaaatgcaattaaaaaaaaattcttttggtgtgccgtggcggtattgaactttcattgccaaaaaaggaaatgtaaaacactaaccacttggccaaaacaccacaggatttgatcttgttaattaaccccgtatccatgccaagcgaagtgcaattgcaacacaacatgcgaatgtaagaatccaatagaccgacatgaagcagacagcaggggtgggtcaaatgagctttgcattttacatacaataatcgacagtaaattttttgaattatagaaaaaataagactagaaaaaaatacgctaaaattttcgatttttcccgagaaaagcataattgaccggaaaatatttgccaatatttttttctttaaaagtcacgacagaatcaggaatttacttcatataggttccagtggcgcttaggtaagcatctccgaaatttttttttaaaaaggctttacttttaaagcgccatagaattttatgccattccatttttcggggtatagcccgaccccacactcaaaccccaagaatggcatttttgtgagggaaagagaaaaaaatttttgtcgaaattttgggtgttcattaact

SEQ ID NO: 24817 - DNA, 1369 bp, Heterodera glycines
  misc_feature (12)..(12): n is a, c, g, or t
  misc_feature (1359)..(1360): n is a, c, g, or t
gtacgctttacntggtcccacaaaaaaaggtcgaaaaaaggaattacgagctttttttgttgtgaactcaggggtttccgcaggcgctgatcacgaatatgacatccatttcgacctatttcgaatcccgaacccgaattcgaacaaaagtcggaaattcatttttcacaaaaattcgcctgtattatccaaaaccgattcaaatgcactaaatgaccttgaatccttatttgctattatattcaatgtatctgactcgattttggaccataaatatgaattttggtgaaaaattaattttagacttttgttcgaaatcgggtccggggttcggaatcgatcaaaactgttcttaggttcgtgattagcgaccccgaaaactcatggaaaagctttattgacaattttttgaaaacttttacaaaaaattgttcgaattcgggttcaggattcgaaataggtcgaaatggatgtcatagtcgtgattagcgccactgaaaacccccgaagtgcaccacttaaaagatgaaattccttttttcacctttttttttgtgggaccagtaaagcgtacgatttacccagatacacccctgctctaataggcgccgccggaaaaatttttgtaatttttaatgcgatttcttaacgattttgttcaaaaaatgacaaaattacgattttgagctaatttttttaagagaataagaaaccgccgagagaaaaatttgaatatttaactgaatcttgttaagattttgcatattaattcgcttcaaaaaacatttctttcaaaaattatcattaaaaatctaaatttctccctgaatccaaaaaataagatgaaaataaggacaaagaacttaaataaggacaaatcttacaaataaggacatttaaaatttgtaagatttggaccctcaaaataaggacaaatcttacaaataaggacaaagggtaaccctgacttagaatgtaagttctttatgatcaatttcagtttcttaggccataactttgttctttcttgtttatatgtttttcccttccattttcagctttttaaaatgactggcttgtccgaaaatgtggccttttcccgcttcgtctctgagtttggtggccgctgcaaagaactcaaaatcgctaatgaattcgccagggatccgagccgtgccaacaaatacacgcgaacgctcaaagacggaaagggcagctggcaattgtgcgtggacttctccaaaaacctcatcgacgacgacatttttcaccaactcatctcagtggtattccgaactccgtgcccaaccaaattcgaatttaaactcaaatttctattcccaggctcgctttggaccnntgcaggcat

SEQ ID NO: 24818 - DNA, 2365 bp, Heterodera glycines
  misc_feature (426)..(427): n is a, c, g, or t
tgacccgctgacctgacccagacggaacggtcggcgaacagcggaccgaatgagtcgagagcgactctcgacgacgccccaggggggggggagtcgtaaatgtgccccgggggatatttagttgttcattgtcgctgttttgcaaaattattagggatgatcggaatacaattttataaaagttaaagcgtgccgccgtcaaaatgtggagaaaaagagcagagaaaagcataaatttaatttattttatgggaaaaggagaaagaaatctacgaataaagcatatttatttttcatcaaaaatgaaaaaaagaaacaatcgaagcaaaagacgaaaaaatgtaaaataataaaaacataaaaatataatataagcacataaaaaggaaaatgaattgatttaagaaatttaaaaatgggagaggnnggggggggggaaagaacaaaagaaaatgaatgaatgaatcaccgggggggggggagagaagtaggccataaacgaattaataataaacaggttctaaaattttaaaataggataaaacgaaaaaaaggtaaaaaaaggggggggggaagggggatggccgagggaggagactgatgtaaggtatcgatatttgtcttcttttgttgggggaggattgaggactcgtgtcagttcagcttattattcacgtgtcaatttacggggttaattcacgtgacaattcacagtcatgatttacgtgttaattcaaaatcatgatttatgtgttaatttacggtaatgattcaaatgttaattcccgggcatgatttacgtgttaatacacggtcattattcacgtgtcaatttacggcttaaagcacgtgtcaattcagctcattattcacatgtcaatttacgggttaaatcacgtgtcaattcagggtcatgatttacttgtaaattcacgatcatgatttacgtgctactttacgggcatgatttacgtgttaatacacattcatgattcacgtgttaattaacggtcatgatttacatgttaattcccgggcatgatttacgtgttaatacacggtcatgattcacgtgttaattcacggtcatgatttacgtgttaatttacggtcatgtaagtttaacttacagtcattattcacgtgtcaatttaggggttaattcacgtgaaaattcacagtcatgatttacgtgttaattcccgggcatgatttacgtgttaatacacggtcatgattcacgtgttaattcacggtcatgtgcgtttaacttacagtcattattcagtgtcaatttaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacttgtaaattcacgatcatgattcacgtgttaattcacgggcatgatttacgtgttaattcaaaatcatgatttacgtgttaatttacggtaatgattcacatgttaattcccgggcatgatttacgtgttaatacacggtcatgattcacgtgttaattcacggtcatgtgcgtttaacttacagtcattattcagtgtcaatttaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacatgttaattcccgggcatgatttacgtgttaatacacggtcatgattcacgtgttaattcacggtcatgtgcgtttaatttacagtcattattcacgtgtcaatttaggggttaattcacgtgacaattcacagtcatgatttacgtgttaattcaaaatcatgatttatgtgttaatttacggtaatgattcaaatgttaattcccgggcatgatttacgtgttaatacacggtcgggattcacgtgttaattcacggtcatgtacgtttaatttacagtcattattcacgtgtcaatttaggcttaaagcacgtgtcaattcagctcattattcacatttcaatttacgggttaaatcacgtgtcaattcagggtcatgatttacttgtaaattcacgatcatgatttacgtgttactttacgggcatgatttacgtgttaatacacattcatgatacgcgtgttaattcacggtcatgatttacgtgttaat

SEQ ID NO: 24819 - DNA, 1425 bp, Heterodera glycines
  misc_feature (67)..(67): n is a, c, g, or t
aaagcattgtactgcatattaaaaagctaaaataattttcgtatatttttcacaatttatttcaaanagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaaaaatgattcaattttgaaacgaaatagtgcacaaaagggagggatgggtagacgaaaagaggaatttttagaaagagcgcaccccatctgatattcccatttttccgttcccacactggccaaaggcgactgtgctcattgacacg

SEQ ID NO: 24820 - DNA, 1853 bp, Heterodera glycines
ggtttgacaagtttattgggggaaaaaaagactttacataataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattattcataaatatttttttcagaaaatgctctgaaacgcacaaattttattacatgctagtttaggcactctgatgcttttctatcaaaagggagatgaataaattttaaaaatttttaattccttttaaaaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttt

SEQ ID NO: 24821 - DNA, 1233 bp, Heterodera glycines
caatcgtatgcattttggcgcatggacaaaaagcctcgtgtcgaaccgacaaatttaattgtttttttttaaaatggaatttttaaaaatttttttttaatgaaacttttttattttagtttaaattttgtcgggatgacattttttgctacacatattaaatgattttgtgtatcgtcggcaatttttcgacttaaaatgattcaatttgtttattccttttttaacagtgatttttcctccacttttcttttgttcctttccctttcttttctcacgttccctaccattttattaaaagattcaggaaattttaaaataaattatttaaatttataaaagagaggaaatgtgccaaaaaatacacaatttatttttgatatacaatacacaaagccaaagggcacaagattttagggggtgatcagaaattttgccacaataaatcaattagctgggtctctttcctcccgatcaattgaccgagacggatggtcgatcagtggttgtacaactccttgcgcaactcctcgccttccaagtcgtcggtgccgacattgaggaactccatgatctcagccgacgagtccatctcacggcactgcgcatgatggaatgcaaaatttcaaaaaatgccaaaaatacatataacaatgtggggtattagagaatcgaaatctcgagaattgagactcaaaaaaatataatgcgttcgagtgaattttcacgaaaacgttattcaaaatggtcaaggctcgcgaccaaagtccaaaaaagcgtttttccaaaaaactttgtgggaagggatggggcgggtcccggcggtgccgataggcgccgccgggaaaattttttgaattttatatgggtttcgctacggaaattgttcacattttaacttttttccctttgttacgacccccctccctcctttacagccccccccccttacgacgcacgtgggggggggggggggtgcgccaggccccttacgacgcggggtgggtgcgccggcgcaccccttgttaatgtatgggacggaccaatcgggagtttgattcccgatggtgtgctgctggtgctgtgcccaccttcaacgcgatgaaattggccaagtgctccacaaattgggtggcggacaaaaagttggccacattggcggtctgaatcagcaaattcttgtccagcgccgagaagaagccgtgcgcccagtcgggcaggccgggagtctgt

SEQ ID NO: 24822 - DNA, 1109 bp, Heterodera glycines
  misc_feature (74)..(74): n is a, c, g, or t
  misc_feature (79)..(79): n is a, c, g, or t
aatgcttagtgatggactagcgagtggtgtccttaggaataaaagccaaagcgtggctgcgtcccgtccacaantttcntaatgcttagtgatggactagcgagtggtgtccgtaggaataaaagccaaagcgtggctgcgtcccgtccaacaatttcctaatgcttagtgatggactagcgagtggtgtccttaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtggtgtccgtaggaataaaagccaaagcgtggctgcgtcccgtccaacaatttcctaatgcttagtgatggactagcgagtgatgtccgtaggaataaaagccaaagcgtggctgcgtcccgtccaacaatttcctaatgcttagtgatggactagcgagtggtgtccgtaggaaataaagccaaagcgtggctgcgtcccgtccaacaatttcctaatgcttagtgatggactagcgagtggtgtccgaaggaataaaagccaaagcgtggctgcgtcccctcc

SEQ ID NO: 24823 - DNA, 1360 bp, Heterodera glycines
agtagtatatagccccgaaagcgcacggttgcgcacgggtgtttcgcgcacaatcccaaacctatgggacgggtgcagctctttgaagttgccgcccgggacattttcccgcacaatcccaaacctataggaggggtgcgtgccaaccgaaacttcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcgtcggattagtctaaaaatttctggacgccaattttacatattagccatttttttttatttgtgaccgcaaatttttacatactagccattttttattttattgtgaccaagcatatctttcctcgtatttctgggatttttttcagaatgtggtcatagaataggtgggttgaattatttgtatttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcgtcggattagtctaaaaatttctggacgccaattttacatattagccatttttttttatttgtgaccgcaaatttttacatactagccattttttattttattgtgaccaagcatatctttcctcgtatttctgggatttttttcagaatgtggtcatagaataggtgggttgaattatttgtatttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaa

SEQ ID NO: 24824 - DNA, 1980 bp, Heterodera glycines
aaaaaacaaaaaatgaaaatgaaagccacaaaaaaataaaacaaaatgccaaattaattaaaactttaaaagtcaaatgaggtcattatttaattatcacacttatgtaatttctttattataaatcatatataaaaataaattgttatattaaaattgataaaatgattaaaaaataaatgcataaaaaaggctgaaaaataattttattaaatgagcaaatggataggcttaaagttcagtcgatccacatagaacccgattatggtccaggtattttaaaatcaataaaagagaatttatttcataaaactacaatttaaaaaaaatatgaatagagtttcaaaccaaattcagatttaaaacttaattttttaaaatttttttgaataaaaaaattcaaataatcaacaagttaaaacattgaaatagaacccgattaggaatttatttttctatatgcagaaaatggatttaataaaataaatttataaaaaattccgaaatttcttaatgaatcattcgataaaaaagcatctaaaaaataaaaactaaattttgaaaatataatttgaaatgtttattacaaaatttatgaatggtctgtagccccataaacaatattaaaatattatatacctcaattaaatcaacttaataatacattagagaaatacgaaggtataaatttgtaaaaacaaaaacaatgaatattcgttagtattttttatctcgaaaaataaacaaaataaatggtgggacctacaaattgaaatcaaccgacattgtaagcaagcgaaaatattattaaacaaaaataagcaaaaaaattcaacaaaatttaattgtaaagagaagataataaaagcatttattgattaagacaaaaaagcgattaaaaagattaaaataatattcaacgagacggcaacgaattgcctaccgcggatactaaccgcaaaacaattgtaaaattaaataaaactataaaaagtttaattttgaaacattaatgataaattaataaaaatataattaccatggaaaatcttatgaaacaattgattggctacattgtaatattgctgattaatgggttaacaacttcaagatgtgcacctgagtgaattggagcaagagactcagagatgcgagaaattcgcaagggcgtcgtccctcatctccaattcatatgctataaactaaataaataattttcaaatcaaaaaaagaaaaaataattcaatttcacaacaagcaacaaatattgttaaaaaataatacgaaaaaataattaaacaataaattatttataattcacattattttaaattaaaaaaacaggtctgagaaaccatcagagccaagggcacaaggctgagcaaagagggtgccgatttctttgccggtacaataaaggattaatttcgactattttaaatttttatcatctcccgccctcctccgcatcgtttttttcaaagaaaaaatctaattttattttaataaaatttcaatttgttgttatatttttttattctggaaaaactccctatttgtaaaaaaaaagaaaaatttaaaaaaaaaaattccgggaaaagggtaaacgaactgctcaggaaaagcgacccgttctgacctcccgagaatggggaaatagtgatggtgttctggtcgtacaccggttgattgtcggagaagccgccgtcgatgtatctgacgccgcgaaattcgggcaccgtataaccacaaaaaattggtataaaacagctgcacaaaatggcctaaaaagaattgaaatgacaactcaaccattagatttccacttgaatgagttcttttttgttcgcaaattcagaaataatggcattttgtcctgttgagtattcagtaagcgctgaatttaggagaaaataggcaaaaaatggacgaaacaacgtacagacaaaaagtcgttcagaacaaagttgatgggcattg

SEQ ID NO: 24825 - DNA, 1363 bp, Heterodera glycines
aaatgtctttttgactgggctccgcaagtgtcggcaccgcaagtgtcgcgccgcaagtgtcgtcgccgcaaatgtcctcgccgcaagtgtctgcgccgcaagtgtcgctttgactgggcgccgcaaatgtctgcgccgcaagtgtcagcgccgcaaatgtcagcgccgcaaatgtgttcgcaatcaaataaaagcaaaatgaaaaaaaggcaaaacaaacttttcatttttcaaatcattttttaacgcaaaaacaataaaaacaaaaccaaacatttagtgattcctagtgatgaatagtggcgttaaaccgaagaatttccgagctaaaaatgtgttttccgtgcatttctcgtcgaaataaagccgcagaaaaaatagttaaaaaactaaaaatcccagccctattcatcagcctttcaatcatcattttatcattatctttttgatcggaatttctcgaaattatgaaatgagaccgtgatttgaaacagataaaatgttttttaattttcttgcttgttttatctcagcaaaaatatttacaattttttattaaaaaacaataaaatttcagaatcccaatttggttttgtaagaaataggtcaacgacaaatcaattaataacagttgtcgaagattggtacgaagcaattattaacggaaaaaatgttgattgtatttatattgactttcaaaaagcatttgattcggtacctcataatttgcttttggataaattgaaaaaaattggtatacagggtaaattattaaattggataaaataatttttaagtaacagaacttttcgtgttaaaattggggatgctttatcctcaaataaaaaagttggctctggtgtcccccagggctctgtcctgggccctttactatttttgatttatattaacgatcttcctgatgctttgccatcaggagtgaaaataaaattatatgctgatgatgttaaattgtatatatgctataaagcaagagcagatacagaaattatgcataaagcattgcataatttattcgaatgggcaaataaatggcaaataaaagtttcaattcaaaaaacttttgtattatatttgggttcaaaaaacccaaaagaaacttataaatttgatgggaatacaataaatgctgtggatacaattagggacttaggagtaaacattgataacaaactacaattttccgatcatgtaaatcaaataacaaggaatgcgtatttacgtatgcgttccttgtttagaataattaaatctaaatcttctaaaatttggattacattatataaaacttatattagacctttattggaatacgctccggaagtttggaatccgtctcttc

SEQ ID NO: 24826 - DNA, 1675 bp, Heterodera glycines
tctgcgttggatttttgctccccataattgtttgactatcccaaacggacacttgaaaaaatcgatttttttatttcataaatattttttcagaaaatgctctgaaacgcaccaaattttatttacatgttagtttaggcactctgatgctttttctatcgaaaagggagatgaataaaatttttaaaaatttttaattcctttttaaacaggccaaaaagtttaggcttaacttttttttcagaaactgatcagaagcgccccaaactttgcagggatactgaaaggaaaagatttaacctgttttatcacattagcttgtcatcagtttttataaaaaattttcaaaattctgagtctcctattattttatttttttttcaaaattttgaagggcggggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttttttttttgcaaaattaattcttaaatattttttcagaaagggttctgaaacgcaccagattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacactagaaaaaatcgatttttttgttttcggggcagtccccc

SEQ ID NO: 24827 - DNA, 970 bp, Heterodera glycines
gaaaaacaaaaaaattcgattttttcaagtgtgcgtttggggtactcaaacaattatgggagcaaacatccaacgcagaattaaagtacaggctatagggaagctaattcccgaaggattcggtctccccataaatctgggcgcatcggttcggggggactgccccgaaaacaaaaaaatcgattttttcaagtgtccgtttggggtactcaaacaattatggggagcaaaaatctatttttttttatttttctattctttttttttaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccattttttattattgtactatagtctttttttctaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcgcatctccccataaatctgggcgcatcggttcggggggactgccccg

SEQ ID NO: 24828 - DNA, 2616 bp, Heterodera glycines
gatggccttttcggcttgaaaccattcagtgaccgtcgtcccaacaacaacaacaacaatgcgttgtcgtcgtcgtccgctgccgttgcggaggatttgcgcaaaatttttgtcaaaaatgtgtccgcacgggccaccaagagtcaactgctcagttttttcagcaaatttggccaggtttttgtttttttgtatgttgtatcttgaagaaaaaaaaaatgtactaattttctaatttaaaaaaaattcattaaaaaattttcgttggaaatttgccacaatttgcgcaattttgcgcaccattgtgatcaaaaaaaaaaaaaaattcaaatccaggccccaaaaccgaaaagtaccacgagctgctccaggcatggggttttccagaaatccaaacccgtggcgccaaacatgaatgaatcactggcccagactttttttttcaaaacaaaacaccataaatccaatttattcgaacatttttccattcctcgtccccggcggccatcgggcaacaaaattctttttttttttgttgccaaataatttttttaattttttttttattaaggtgctgaattgtcgaattccgagtgaaaaacgtcgtcttgaaacgtcgctgtacgcaacgttgcccaaacacccgaagaaatggcacggcacttgcaccgtcacatttaagtatgatgaataagtatccccgttttttttaaattttaaatttgataggtccgccctttccgcaacaaatgcaaaactcgcttcgtccgacgaattgttgttctacgggcaacaaatgcatttggtttcggtattttttatggattttcatgggggctaaaaaaggattccgatttttttttaaattttcatcctcttctgtaaataggtatatgaatttttgttgctgttttttaattcattatccaacaacattcatccctggtatcatgtagtccaacctgcgattcctttcatgtgcatggacaagatttccccccccccccccccgtctcattcgttcgtcgtttggccgttagcctgtgaaaatatgggaacaggacaaaatcacgccgccgaaatcacgccgctagaaattaaaaaaaaatttttttcatggaaaaatcttagaaaaatttttataagaaaatttaaacaaaaaaaattttgaaaaattttctgctatttttttataattttatgataaattactaacaataagttttttcgaaaattttccaaatttttttttatttttcttgaaattttaaaaaaaaattctaacggcgtgattttggccggcgttatttcgatcggcgtgattttgggatgcacccgaaaatatacacccttatggcatatatgccaaaaaaaaaaaaaaaattattgaatggcaatggcactttttagcgcttaaacaatgtggaacacatcgacctgagcggatgcattttggtgtccaccgacagtgtgcaagcgttgtgcaacgcgttgaaaaaggaggaggaggaggagaatgttcaacagcaaacggtggaaaatagtggcggagagtcaaatgtgagtttgaattttcatgtatttataagcaaaagggctggctgctctgcttgacagtcgaaattttccgagtctcgaaaaatttcccgctcgagaccgacaatctcgagcagccggctaatacgtatggtaaactttagtcgttctctgcccatggccagttttatgatggattttttgctcaaaacttgaaaatcttttggcagagtttgtgaaattgcgaaaattttactagcgatttttttttaattttatgatgaattaataagtttttttctaaatttttgaaaaaatcactgaaaaattttaaaaaatcttaagttttccttcaaaacattttcagatttaaaaattaatttgatgggtgcacctcaaaatattgccgccttttcaaactgagaaatttttctagaaaaaaaatttttcgaaaatttttataagaaaatttgaagaaaaaaattattgaaaattattttggaaattttttcaaaaaaaaactttgtaatttatcataaaatttatgcggcgatattttgtcccgtccccaatttgatggggggagggacgtgactgaatatatggccagatttttaattcaaaatccccaacatcaacaggtgtgtggtgcgcaacagttggtcagtttggtggtcggtggcactgtgtgcgagtcgcatcgccttcgtgttgggcgctgctcccgtgttgtagtcgatttcagcgacaacagcagtggcggctcattttgtgccgccaacgcgggcggccgtgccaaaatgaagaaaatgtttgtcaccggcggcgacggcacggagcagcagcaggacgacaccatcaccgatgaacaacagcagcaggaagacgaggatgacgacgatgatgatgaagacgaattccgcatactatctgcacaccgtaagcaaagaaaggaaaaactactcatttagaccatgctgatattactgtatccagttagttcaggaggtgttgtactgtacctcggcaaaaaatttttgaataagttgacgacaaattgaccaaaaaaaacgttaaaaa

SEQ ID NO: 24829 - DNA, 1356 bp, Heterodera glycines
tttagggacacccccattaaatggaaatacataggcaagaaatttcaaaaaaacacacaaaggaattattgctcttgataaagacaaatcttcggatttctacaatataatattcttaatatgatgtatttttgaaaaatgagacatagtttatgctttcattttactttaatataatgagtttttgaatgggataaaatcaaagttgctatagaaaaattgcaagaataaaattttgggtttaaaatatgaaatatgcttcaaacattcaaaatgtcttttttcatcaaaaaatgatatttttgaactttaaggtccggtccctccgaataaggacaagtgaaaatggaaactcctttcttaaatcaatcaattttcctttcatataaaattttcaatatacaatagatttctttcaaaataggtcccacattttctctccggtccaactgcacttttcatttgctttccgtgtgctcgtgccgcaccgacagccgttgtttttgatcctggatgaacggataagcttttcgtccccgccaaaactcaccacctccacaaaaattcatcattttaatccctttagaatgttgtatatgagtggtttaatgactttaatccacatccctcatttcattggaatgggggacaaagcgggggaggggatgaaaagcaatgaaaaagccggaagaggcggaaatgaaaattaaaattggacagaaaccgtagtgcgacatttgcggaccgacatttgcggaccgacatttgcggaccgacatttgcgggtcataatttctggatttaattttcaaaaaaaaaatttttttcttaaattggatgatcatctgaatattgaattttatatgtgatttttcggagttaagcaagttaatgcgaatgaaaatatgaaaaatttataaagtttttccaaaaagttcttttttcaattcctcttggtgctaaaaattttgatcacttcatatcatccttaagtagtgatctgatcaacttgtgcaatgcattagtttataaattcctgatttacaagaattatgttgtcattgataatgtgagtaattcattttaattttgctttttaaagatataaaatatatttttatatcttttatttgttcttgatattaatgttaggtatgcttgatcaaaatctaagctctttagactaaggctagtaggtgaaacacgaaaaattttgcgtgctatatattttgtgatatgatttttgtataaagcattttattaatcaatcattatttcaatttgatgataacgaaaatttatttgaaaattcatttaaaatttttttttctctttttttgataatttagtcacaaa

SEQ ID NO: 24830 - DNA, 1522 bp, Heterodera glycines
  misc_feature (7)..(8): n is a, c, g, or t
cctgcannggtcacaattacaaaaagggaccacggaaattttctgactcttcgaaagtaaaagaaatatgataaaatatgtattttctcacatatctcattaatttacagctgaccgacattttagcaagtgcaaaaagtgcgataaaattgtggtcccaagcagccaatgaagccgaattgcagttgattattgagcgtaagttaacggaagaaacattttccgcttacacttgattggctaagattttggtgctatggcgttacccaaaaaccatcacaaaaaattttttgatatgactttgctcaaagcaaccgaatttttaattgttgatttctttcgatagccccaagtgttttttaaatcctgaaaaatttcattatgtttcaaagagatcaaattcaaaaaaaaatatctggtttttgaatttctcaggtcatactttatttaaactatgatttttttgaataagtataataaaaaaaatatttaccgaataatatcaatgttataaatttggttgcttttgagcaaagttgtgaataattttctgtcaaaaatttaattttgatgttttttgagtaaggatccggcaccagaattatattcattaaaattcctatttttggagattttaatggaatatgcttagaaaacttgctaaatttcaaaaatttgcccattttttttgagaaatcgcaattttaagacttttaaggaattttcttaaatgccgaataaaccgaaatttagcatttttggacattttattatataatgtcctctttacgcttttgaagaatttttttgtcaaaaaacataaaaagatttttattaaaccatttttgtacaagagtttttgtacatgtttcttatcccagccctaatgaaaacattcaaaaaatgctataatattataaaatctttataatttttattgacaaaacgtcaaaatattaaaaataaattattattttttccaaaaattccaattttttttgaccaatactaatcaaatatttctaaacagacatggccctgttccgtgaagaatatagccaaaagaatgttgtgctggcttttgagaagttgtgaactgaaagactctgccgtggtataaagaggatatgaaaatattttcattcacctattttattactagggctccaatttttagggtttagcctattttttcctgaaatcccagtggtctgaaatgcacaaaaaacaaatttttttttggtggttgttaagctacttttcgagttattatcaactattttctattttttgtttttttaaagcctaaaaaatttcaaaaaaattttaaaaaatacaccctaagaaatgaaaatttctcaaaatttatctcaaaaatttatttatttattttcttgacaagaaattttgatctgaaaaataatttagctcaatactgatttggcctagtttttttttacctttttgaataaatttcgtcattttacaccccctaaatttgagactttttatagcctatttt

SEQ ID NO: 24831 - DNA, 2274 bp, Heterodera glycines
ctcgatttgttcacgatgacgcgcacactcccacacgtgtcacccttgaaaggaatatcgccgcgcatcgccgacgcttttccgattgcgcggaaacgacgcccgccgctgccagcgattcgggtgctcagccagacgaatcagtcccacggccaatccatcgtcgcaccgctgaatttcaggcaaatcatttccgaatcagaccgattttatttaagagctttttttgcatatgtcatagtggtcataaattgtactgaactgccccaaaatctctcttcccatttcagcgccggaaaagtgttggcgcgcaaaaaggcagcaaaatttgagcccggacaatcctcaacacaatcagccggacaacagcaacaaaaaactgttgttgctggtgttggccacggggaacacatgcaacaaaaaggacaaggacaccaaggaattcaagggcaagaacaccaagtaattcaaagacaaggaatttacaacaagggcgcaattgaaggctttttatgtgagttagggcaaagtttaaaggtaaaaatttagcaaaactcagaaatatgacacaaaatcttccaaaatgacaatttaaaaaaaaattaatttacttgcaataattcatagccaaataaaactattggttcttcattacccatttttgagcaatgcatggttaatacgagagaatcttttttaatgccaaaataagggccagcaggcgatacgatgccaggaatatgcttaaaattatcatggccaaaacagtcaaagattaaacaaatattcgatcaaaatatttgtgggaaaataaattgaaaaaaatgcaaaacccaaatattggaaaaggtaaaattatcggaaaaatttagtgtattgcgtccgtcatattgttctgatgagtctccgctcgttgcaaattgcttcgcctgactcttttctcgatggcacaattcaacaaattcgaaatggccacccgctggaaatggcattgggtcccccaaaaatggcattggcacaaaaattgagccgaatgaatgccatggaagtggcaaaaggtatcaaaatgcatttgttgaacgatggagagatcaaaaactacaaaatattcgccgaaatcattgaccaaaccatggcaaattgtgtcgcggtgttcggccaaacgggcgttgacgttggcatttattttaaaaacaaatattatataattttaataacactttggttgggacaacttcttataaaaattcagaaaaaatatgtatataaaaatattattttataaatctttttaaaaagtaaaaatattttgactgggatgtagtccacttggggggggggactacatccacagtcacaaccaatttttttaagattttataaaataatatttttatatacatatttcttctgaatttttataagaagttgtcccaaccaaagtggtattaaaattatataatatttgtttttaaaataaatgccaacgtcaacgccgtttggccgaacaccgcgacacaatttgccgatggtttggtcaatgatttcggcgaatattttgtagtttttggtcgctccatcgttaaacaaatgcgattttgatcccttttgccacttccatggcattcgatttggctcaatttttgtgccaatgccatttttgggggacccaatgccatttccagcgggtggccatttcgaatttgttgaattgtgccatcgagaaaagagtcgggcgaagcaatttgcaacgaacggagactcatcagcacaatatgacggacgtgttccactaaaacccatttaaataattctattttatttgccaattaataaattcgattttaaattaaaaatcattttctttgcatggtttatgtgtaattagtttaatcagaatattattatctgacttattttatttttccttttttatctcatgtaacttccatcctcctcctctgctgttcctctcatttatactcacttaagtgagctttgatcctcataattagcatgactgctgctgtttttggccttgtgttgttgctggttttggctgcaattttttgctgctgaaccccagcgaccatttgttgtcctacggaggactgtccgggctcaaatttcggcaacgatttgcgcgctttccctttgtcgctgaaatgggaaaagaacaaattatgatcttcttttgtcaaattttaaaaagggtaaccgaattaaatgaacaaggaacttttaattagtggctgggttgtttcgtaaaaaatg

SEQ ID NO: 24832 - DNA, 1187 bp, Heterodera glycines
attcaatatatgtattcgggaaaattaatttaagaagcttaatttaaaatcttaattaaaacagtaagatatttaaaccaactcaataaaattaatttcaagaccaaaattgaaattgaaattaataaatattttttatttattttttttttataaaacaccaaaaaatttctaaactaaatttattgaaatttattaaagatatctgaattaaatgaaaatttattaaatagcactagaaaattactgtttaaaaaataattttaaatttaatatttgtaaaatgatacttaaattcaaaattagcacatttgaaaaacaagtattataacttattttaactaatatctctgttaaaatattatttaattttctacgataaaatatattagtttaatttggttatctaaattaagttttttttaagtggtttttcctatttcagcagttaaggcgaatcaaaaatttttaaaatctatagtttttgaaacgcaaattaatttaaaatttttcaatttaatatgtttgaaatctatattaaataatacaattaacgggtaattttaatcaactatttcaccagatttaaaaaataaaaattaaaacatgcattaagattaattaaattttgaaatattaggttcagggaaatttcttaaaccctaataaaaattaaaataaacataatttcaacaattgcttaataaattaattaactaattgtttaaaaaattgccattattttaaaataaaataaaagcaatcacatatttttatgaatatgtgtttgcaaaatttaagcaattaattattttaaagtaaagaaaaaataaacaatgaaaaaaaaatataaataatcatttaaatgaagtgaaaatttattgataaattaataataacaaaaaaatatttcataaattttacaagcttgacataattaaatgataataaatgttattaatgttagagagaatattttatataaaataagaaaatttttttttttaaaaattttatctataattgtgaaaagaaataaattgatttagtaaatatttaaatctatctgcttatttttctcaattataaattgaagtctaagttttcaaaacaactcaaatataatcaaattatacaaaaatatttaatatgcaatatttaaaattatatgaaaaataaaaaattag

SEQ ID NO: 24833 - DNA, 992 bp, Heterodera glycines
gaaaacaaaaaaaatcgattttttcaaagtgtccgtttggggtacccaaacaattaggggggagcaaaaatcccacgcaagaattaaagtacaggctatagggaagctattccggaaggattcggtctccccataaatctgggcgcatcggttcggggggactgccccgaaaacaaaaataaatcgattttttcaagtgtccgtttgggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccg

SEQ ID NO: 24834 - DNA, 916 bp, Heterodera glycines
cttcgccccatacggcgattggacgacgctggcgctatcaacacggagcagcaacagcaactacagcagcacaaccaaagacagcagcagcaacagccactcggctggcgcagtccgttggtgcgcgagtccatcgacctggtctacgacttggtcatcgcatttgagcactgctacgcatccaacttcacattcctgcgcacattcattgacaacgagatcattgcggttagtagtaggagcgggtgcattacatttccaatccgccaaaatttgttcccccctcccggaatttttttttaaaattttcaaacttgaaaaataaatagataaaaattcaaagggaacagtcatttttctttgcagaaggcctctctcccttggcgacgtgccaccttcgccaaactgatcgacctcataccatccgccgggcacagtgtccaactcgtccgtttcgtgcagtacattgtctccccagtgttcgcatatgcatttgaggtatttcaccaacatggaactactaataattaatactggtttgtgagagtttgttttgccgattttgaattcatataaatatttttttaatccaatttttcccggcaatttcggcattttcgtttgactttccatcattttttcctctccgttattgttcagatgtttgacgttgatgcggttgtgggcggtggagtgggcccatcgtctgctgcctcaactgctgttgatgatgagaacattgtgcttttgctgtgccataaagtgatccatcggctggccaacgagcgttcgttggtgtccgattcgctaatcatcgtcatgtacttgttctgctcgttgatggtccaaacagtgtccattgcacatctatgatccccctaaaaggtgggtcaaatatgaacccaatttttggtaa

SEQ ID NO: 24835 - DNA, 1435 bp, Heterodera glycines
tcagtctgtccgccagactcagtcaatttaacgcgtgcttcgagcttaaaaagacaaatacaacttaatattattaaaagtctaaaaatataaccagtcttgtcttcgcctcctctttgcggcgcagaatgtcccatgcacggtttggcggacccccattaggtttggtgcatttttgagaatgtgaaacttcccctccatggcttcttgatatgtatttggatgcgtatttcgcacattgatccaagcacgccaaagattatgagtgtcgtacccactgtaacttgaacaacgcatctaaattaaagccaaaaattattattgcttgaatagaccgctaatcacaaacaaacatctaaaagccgctgatgaacacgatccatttctttctccgaaacatcagtttctccgtttttcatcagaagagcgctcacatagcttacggcttttgccaaaaagaccgttttgttagccattttccgcgaaccctcgattgaatgatgtgcatttttttcaaaggtgacttgttgatgttgtttttgtccttggaactgtgttccgtagccacttcgcgcaatggtgcattgttgacgttgtttttgtctttggaattgttttccgtacccacttcgtgtacaaccgcctcaatcatgtccgtttgggtagccttcgccatgacgtatttaataaaattgcttttaaaatttgcacaaaaaataaaactaaaagaacgaaaaaatcgaagtatatgtcaagagctggaaatcattaaattaataacagcagctgcttaacaaattcattcattcaaaaaaaacataacttcaaaaaaggattcaattttttttcgtacccacagcaaacaaaaaagatggaaaatttaaaaaattaaagatcatttactatcgctcagaaaagtagcggaatttctgctgcccaattgggacatggcacggcgtctccgtccccggatggtcggcaattctgaacaacgcacgcccattctcgccggcagcttcatttgggtggcggtggcttggctccgacgtacccacgccgttgttttgcacaataaagtgaaaattacagtcacactcgggaatgtgacttaataaataataattttgttggtaggctttatcccaattataccatttataacccgctgcacatttgttgtccttgtgccccggcattccgcagttccaacagccaccaactaatgatttaaaagtataaggatgaaaaaaaaaaattaacgatgggatgcagggtggcgatttaagcattctcttgcgctattgcttccaagtgccacatctgaagaatctttcctcgctttcggaccccccccagacaattgatgggtgggcacgccccaacaatatgcttggccgtggcaagaaaaaaaccacccttcatggttactcaataa

SEQ ID NO: 24836 - DNA, 1503 bp, Heterodera glycines
  misc_feature (1488)..(1488): n is a, c, g, or t
ttttttccgtaaaagctttccctgttcggttgcgcaaatgcgtcgctttttctcccttattcggatggccaacgaccgattcggagcagtacaaatcagtgacgaagttgttggactggtcctccctcttcccaatgcccccccccccaccttagaatgggtgtccaatcatcgccagcggtcatttcccttcgtcaactgataagtccgatcatcacagcttactatcagctgctcaactcaaattcgaagtgccaaagttcggagatgatcagcaatcgaatgaccaagaaaaggccacagacaaattcattgtccaatgtgaagtggcaatgaatggcggaggagaagagcaaatgggcgaagaagaagaagaaaaggtgggccaatgcaaagaaatgccaggagagacatttatggacagatcagaggcgatcaaagtcaatttgggggagggctaacaaattggacatcggcagatagtcgtcctttcatttccttcgcctcatcgtccgaacaattcgcgatggacgccccggcgcggcctttgccactgccaaagtcggccaccgtcggtgccaaacggcgccttaattaaaaaattcaaaatattaatggacgaactgctaaaaaagaactaaaaacaacgaacttcctccgccatcgcatcggccgtatttttaggctgaaacattctgagccgcgtatttctaattggcatttgccttctccgaccgtcgttttcgttgtttgtgttggcattgtactgctcgtccccctcggtcaaagagagtaccatcagtggaactgaccaaggaggaaaagcatgaggaaaagcatgggggaggaagaatagtatgcaaatttcgccaccctttgcctttgccagtgaatggctttttggctttccccactgttttcaccttcctccgcttccgtgaacggttcaacagcagctgctctcttcccgaacaattctcgtgttcttcgggagtgtcgttcgtaatttgcgactgcaaatggcaaagaatgccgatggcataattctgccaattcttttttgtgccgcgttttcccacctgctgccggaggtggtgcgcttcgctttccgaaaagttcgcgcgccctccgtttttggaatgcgtccaatcgatcggaaggcaattcgaattcatcaaagtccatgccattaacaaactgggcaatgatcagaagcaaaatgggcaaaagggacaaaagggacggagaacggcaaaagacggaagagaatgccattgacgaaacgaagaacgaatgatcaatgaatgggagaccgattacttctgctgaaaatggcagcgaaaattgaaaaacagagaaaaacggccaaagtttaaatgagaaaaaatgcgaatgttttggctgctgctgaaaattgggctttttattgcgggaaaatgccttttttcgtgaagccaaaattggacttgttgcaaaacaatcactganatgcgtccgatttca

SEQ ID NO: 24837 - DNA, 1046 bp, Heterodera glycines
agaaataaaatggaaaagataaattttaaagcatgatgcaatttcattaaaaatgggataaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcctctgtttggtcccgacaagaactatttttcgtgcgttttcaaacacactattagtgctttattcaccgctacaatagaagacaaaagttggtgtccaattcccggtagggatttaatcgtgactttcagagatagccattttttgtcaagaactatttttcgtgcgttttcaaacacactattagtgttttattcagcgctacaacagaagacaaaagttgtatccaattcccggtagggatttaatagtgactttcagagatagccattttttgtcaagaactatttttcgtgcgttttcaaacacactattagtgttttattcagcgctacaacagaagacaaaagttgtgtccaattcccggtagggatttaatagtgactttcagagatagccattttttgtctagaactatttttcgtgcgttttcaaacacactattagtgctttattcaccgctacaatagaagacaaaagttggtgtccaattcccggtagggatttaatcgtgactttcagagatagccattttttgtcaagaactatttttcgtgcgttttcaaacacactattagtgttttattcaccgctacaatagaagacaaaagttggtgtccaattcccggtagggatttaatagtgactttcagagatagccattttttgtcaagaactatttttcgtgcgttttcaaacacactattagtgttttattcagcgctacaacagaagacaaaagttgt

SEQ ID NO: 24838 - DNA, 1919 bp, Heterodera glycines
ggggggaccctttggttttcaaattttttaatatatagtcatgaaaattattcctggtggttcatggggtacatgacctcgaatagatgtcaaattcgtgatcagcgacctctaaaagcccggataacaaatttttatgggtttttatcacaaaaaaaaaattgcaaaacaaaagggtcccccttttgtttttgataaaatccaaaatcgggcaccttccaattatacgccattattttctcgaaaagtacccatttccaagcctaattagttaatgttgtttttttgatctcattgttttaaaacaattgttgtttcaattctatttttatttaaatccacattatttcagcagaatccgctgcggttaaagcggtcaatctttccgctgacacttggctgtccgctcgttgttaccttcttctcggtatggtcaacaggttcggtgactgacaaaatgccattaaatttaatttaatattttactctttaagtatgaaggcacgcaacagttatttttttgaacagaagaaaacactgacattggaaagcataaaatttttcgagaaagcaatcgaattggacccttacgacgacttggcccatttttactgtgccatggaatatgcaaattgtacgtgccatttccaagttgttggttggtattgcttcacttctctcccgtttcagcacgcaatttggacttggccaaagagtgctgtcagacggcactcaatctgaacatggaaaaccccttcgccattatgctaatggcactgattttcacggcccgcaaagacttcaaaggcgctttgcaattggtcatcaacgccctctccgattttcccacacattatggactgttggtgctgaggttggtaatgcttttgctacgagataaaattcaaaaaagtaagcaattaggcttaaattggaggccaaatacggtcgggtggaggaggcgctgcaaacgtcgcacaatttggtctatttttggcgcaaaacgcgtcctccggtggaatgcttttcacccgaagaggaaaatggagcggagaacggaggcgaaggcgcatcacggattggggacagtacaatgacactgagcaaacagaacgtaatgccggggagaggagggggagggggctgtaattttttggcatggcatcgctaacaaaacggcaatcttagtccaatttcttgacaattttttgtgttttcagtaccacagcagagacgcgctggtcactcccctcactccgctgctcaccgcgtccattggaattgccaccccttcggcccatctgtcccttttggccaattccgcttgcgacgcaatgacttctttctccctcaacggtcggtctccccattatcgtcccgattaattcattctccctccctcctactttagacgtttctgccatcgatccctccaacaccacacaaatgtccgaatttggtgccgcaccgccgtccaccgattcgctgagtaatgtcacttcgtcaagcaaatcctggatcagtttctccgcctttcgaattcaggttggaaaataacacaaatgtacatcgtacggtttattagtaaatgtgctcatttcaggcggacatttgggtcgaattggctgaatttttcatcgaaattgaccgggtccacgatgtccaggcgtgtgtggaggaggcgtgcgcaatttacccgcattcccaccaggcgctttacctgaaggtccccgccattgtctcactttaaatcaaaaagaaatacccctttttctttcagggccatttgaacttgagtcgtgccgaaaaattagcaagcaaagatgccgcgctgagtcgaaagttccgcgaagacgcacggaattgctttttgggtgccctatcaatgtgcgcgtggcattgtccgtcctatgcgttgc

SEQ ID NO: 24839 - DNA, 1810 bp, Heterodera glycines
  misc_feature (34)..(34): n is a, c, g, or t
  misc_feature (1675)..(1675): n is a, c, g, or t
  misc_feature (1697)..(1697): n is a, c, g, or t
ttttacgggaatcactgtgatagacccaaatatnaatatgatagactaaaaggtctttttacataaatgacatgatagacacaaattaaaaagatattttaaataaataatttttcgtgaaactatcagccaataattgattaaaaattatttattaaaattatatataaaattcctttattttttattgtatccaattaaacgggccataaaattcaaattggcagagaatatattaatgagtatttaaaatacaaatattttttttatatccttatttagcatttcataaacttaaagtataatcaataaacgaggagatgcacaatttccgcaccgacttcaacatggaggcggtgcacaacgaaactccatctggaatgccgactcacaaactgaccatcaaagtgaacaaaattttatttgattattgtttaaccaataaatccaggtgggtagtgttgaaagcggccccggcgctttcacagtgccccttggggccttggttaaataataataatgaaacaaacaaaatttagagtgaatctccgaaagcgaatcaaattcagcaagtcattgcgcgaatgaggaaacataataaaagcaaaaattaaaagcaaaaaataaatacaatttcattatataagaaataaatagttattttttaaaaaatttaatgggattaaaaaaccatattaatattatatagaatcatagaattaaattatttaatgaatctatacatattacttcttaattatattaatttaaggttaaaactcactcaattcattaaattttaggacgagattcaccatgagaataaatcacaaaaagaattcattttctcaattaatgaatataaatcaacaaataattttaaacatttgaaaaataactcaaattagggactaaataattaggtaacaaatattttaaaattaatttaatggtcgacaaatgctgaaattaaaaaattaaacgtatacaaattatttatattatactatcagaaatacaataatttaactaaattgctcatatatttttatttctcatataaagctattaatattcaacaattaaacaaatttattaaactaaaaaaataaaatgaagtattttctcaatattactaaacaatatttactaaaatgtaaaaaaagttcattctttataagaatataatgcattatttaacgattttcatttttttaatatatataaataaaagagcaaaggtaaatctttttttactataaaaacatattagacttttagttaatgaaaagagagaggaataatcaatacaaaataattagcataatttaatgcgcacccaattaaaataattttcttttctgtaaaattattattaattaattttttttaataatgtttttggaaatattatttaactaacctgactataattaatgacatatgtatgcacaaattcctaataaaaaaaaattgaaaattcttaaatagtttagccaaagatttttctttaaatttattttatggttatgtcatactttattttgtagtaacactctcccggaaaatttaagatctttgaatgaaaaattaaaatttttatttttacttgttaaaacagttcgccgcttaaaataatataattagtaaaatctttttaatttctattcattanatatatgacttaattattttanaaaagataatataaaaactaaaaaaatatctgaacataagaaattacgaaaaaattttatattcattttaattattatgaaaaaatatacagattatattggaaaattcaaaa

SEQ ID NO: 24840 - DNA, 946 bp, Heterodera glycines
  misc_feature (616)..(616): n is a, c, g, or t
aaaccttctaatgtgtttataatacgattaaatccttacaggagaataaacaaattaaaaaatgtattttttattagaatttaatttaattctcaattatatttcccgaaattaccatataaaccctttagattattcatttttccattttaatgtttggatatatacttaggttttttaattaaagtatctttttttctctaatttacaattgcgtaagaaatttttgtcggaaaacattccgacaaaagttatatttatggtaagggactgaagtgtacaaattgaaagtgaatttgcgagaatattttggccaaaataccactgacttcgaaccgtttctcggcctgccaaatgaggcgtcttccgctggcctttcaccaggcgaaaggcgtccatttaacagctaattgtaagaagatgaaccaaatcggctgtcttctgtttactctcagcttcgtaagacgaaaacaatggaagaagaagtaatttatgaagaaggaaaagcgaacgattaaacgcaacaaacgaaactttgacgagaaaagaaccgaacgaagtcgaacataagccaataaaaagagggaatgaaacggaagggggacgcagaggaggncgggaagatccccgggattccgccccccccccccccttttttgatattctcgaaaggaaatcccgccggggacagtgataaaaaataagtcattaattaattaataagaagggacccagcgacaaaaaattgacaaacttttttcgtgttttgaacaattaatttttgcttcaagaccggagtcagttgacaaatgatgcaatttggccgagagtcaactcacaatcagtcgagaaatgataaaacatatttttaatgcgaattttcgtctttccttgggtttttttcagttttttttcaggtttccttagttttttaccttttaaatcc

SEQ ID NO: 24841 - DNA, 1720 bp, Heterodera glycines
  misc_feature (41)..(41): n is a, c, g, or t
  misc_feature (67)..(67): n is a, c, g, or t
gacccccgttttggcgaggttccccgtgcccatccccgacnggggaagatgatgaaaaaaaatcacngaaaagtgatcagaagcaaaaaaaaatgatcagaagaaaaaaagtgatcagaagcagcagaaaaaagtttcgctgttgtgctgccgcgcgtcgtacagaagtggaacggtgagcgatttggtaattacagtgcccttttggcatttccacaataaatttattcttaatgtgccgaaaatgttcatacaaagggtgaaatattttattatatttttgatgaaaaattttaaaaaataaaaagaaaaccctaaaaattgttaaattttcattagacaatttcaaaatgagttcaagcaaaaaacagaggacagatggatccaggtagaaaagcgaaagcaaaatttaattgttccgtaaatgtgttaattaggctaatttatttgggtttttttgaaggtggatttgaatcccggcaaatatgctgtcaatcgaaagctaacgaatcggcaaatcgaattttgagctaaaattcttgagcagaatgaagctaaggtcaattcaaaaatagcaaattaaaaaatttagtttcataataaaataaggtttttgccttttaatcttacaaaattaaaaaaacaattaaaactttcgcaaatttaaaacagcaaaaacttctgaccatcacaactttaaaaaagagtgataatccattctccgggacattaaacaaaaatccctattaaacgacagtaaaatttagtgttcgaaagtcatatacacagttaaaatttggtttgtctatttagggtcattccaagcataagcattttttgaaatttactgagattacctaattttgaaaatttatttgtctattatttttaaattattgaatgaaacactttttttggattaattaaaaattcaaaaagcgggaagaagggcttggattgatcagaattaattattattacattcgtttgtaatcaatcactttttatcattccgaaattcgtcatattttttgagagaagggctcttggattgatcagttactattatatccgatcactttttatcattttgaaacgataattttgctaatttaattgcctattaatccatgcaatttctgttaaattttaaattagaatttaaaaccttagaataaaaaaagttaagctcctaatgcattttttggcctggaatttcgatatttaagataattcgcagtaacaaaatgtcatcgcttttattttaaatggataaaaaagcacaaaaaaaaattaaaaaaaaagtaaattaacatgatcataattatttgttttgatttcaaaattattgtactccgatggcactgatcagtgagtgatcagctgactcagtaaattcctgccgattttcgtttttcttctgcagcagaagcatttgcaacttaaaataattttgaaaatttatttgtgtatacaatattttaaattgttttttattttatttttttgtaaaaaaattaaatatttctttttataacactcacctgcataattgtgctcatcattgtcgactgttgttctttgattttgccgatctctgcccgcagctcgccaaactgttcatccactgcaaatatttcaaaaataattgcctaattagaattttcacggcatttttcggtaaactaatgaaaatccgaaacgaaaagccgacataaag

SEQ ID NO: 24842 - DNA, 1300 bp, Heterodera glycines
ctggagaagttaattggggggcaaattactgaatatgctttggaagaccaatgaagccccagcaaagttcatggatgagaattgtaagttaacgaaacgggaagaaataatatgccgtatttataatgagtggctccgaatttcggaatcccgatttttttttgggaggggggggggggggggggaaatgccggagttttatgtaaattacttaatttttatttaagttatgcttgatgaaattttttttcgaaatttcaaaaatcccacaatcccgcgcatgatcccataaattttaaatatgggatttgtaagctttatccacgggatcccgtcccgcaaaaaatattctgagttccaatcccgtagcgggattcgcaaatttcaaatttccggttctaattagtacagctttggaaaataatacagtatttgatatgacatactgaacggcttagctacagtatgtgattggcatactgtgtgtgtcaacagcaataaaataattataaatttttttcatttttcttcgacaaaaaccgactcgtggatcattacaccagcgctctgctggtgagtgccaacatgcctgtagactctgttgctgatcggatgcgtaacataaaaagcgctgatctgattgtgtggatgcaatggtttcaatcggcgcataagggaaaagcggggcattcgatcaaacgagaatttatttggctatatgcacgtgttttttacgaccggtatggaaatggatttgacaaatattttgaagccgaattctccagaattgaagtgctgatggaaagtaagcaattacagtcccattaattaattaattgggtaattaataaatgatttaactacagaaatcacccaaatgcacactgatgctactgctgctttcgctttgcagaaaggcatttgctgtgaattgccagaaaaatggcgtaccataatcaaccaaggtacgatgaatgagagcattttggaagtgatcgaatcggatgagggaaaggaaagaaaaatggggacaaatgaatttgtacaacagttgcattttgatgtgatcagagagttttgccaaaacattgatcaaaccgaagaactggttcagagaaaaattggaaatataataaaaagtaaattaaaattataaagtttttggcaagtaacggaaaatttttttaaatttttaagtgttaaaacagagcaaagattatcgacgaaatttgaaggaataatgaacaaaggacagatcaaaaaaaatttccaacatattggcattccatttgatgaaaaa

SEQ ID NO: 24843 - DNA, 877 bp, Heterodera glycines
tttatttgtttttttttgaatttgcttttgcatcgtttacctgaatgtcaattctctgtgttatgaaaagaaatttatctgttgaggacatgattatacacagcggcccaattttgggctccaagtacaaatatgctggatttttcgtcttagtggtctgtgagttagtcaccaaaaaggaagtctcaggttcaaatcctccttgtgtttgtgtataaatttcaattttttaaagcaaataaataaaataataataaaaacagaacgccaaaagaacaaatacaaacagtaaaaggtacacactatattttacccttgattttatgaaatttttttagcttataacttggccaataatagaccaaacaaaaccattttgtgctcattttgaagggaaaattctgaagaatatttcttagttagtcaaaagtttaaaaaattgtttattggcaaaaaaatgaaccatgtgttattttatatgtcagagacatggaaatagggtaatagtaccgatggtatcacaccttttttgaaaattttttaaaaaatttcaaaagtcaaaaatatttattataaggttttcggggtcgctgagcacgaatatggcatccatttcacccaattccgaacccctgatccgaattcgaacaaaaatcgaaaactcaaatttttcgaaattcacatttatccaacaaaatcgctccaaacgcaaggagattcataaaaagcagaaacagcctttgttttaacgtttcagttcttttttttaaacttattatatggctgctgtgctagaagaacttcggaactttacggcccaaaaattgcacgcgaaattggcactagaagacaatgagtttgaccaatggcttgaaaa

SEQ ID NO: 24844 - DNA, 1318 bp, Heterodera glycines
  misc_feature (1266)..(1266): n is a, c, g, or t
  misc_feature (1278)..(1278): n is a, c, g, or t
ccccccccccccacctccaccgcaggaaaatgcggagcagcagaaagggaggggatgagagagcgaggccaaatgagagggtgacagacacagcgagagtcaagaaaagcgggaaaagacactgaagagagaagggagtgagactacgcaagagagcggtcagacaaacggacggagcgcgagcagacggattcgcgcgaggacttggtaatgtgcatgggccttttatcagttaacttcaatgggttatatagtggcggagtatttagagaggactctgaagatgaatgagagaatgtcgggcagacggtgagagagagagggatatagagggagagggaaaagaaaaaagagtagaaagagagagggagagagagaggaagaggaaagagggataaacaagagagagagagagaggagaaaaagagagaggggagaccgagcgatggatgagagagaaaggaggaaaagagagaagaaaagaatggaatgtgagaaggaacggggaaaagagaggaatttccattattagtcgagactctcgaaaaagccgtttgagtgcgtctgcctcacgtcggcggagggcagagagtgtgtgaatggtgggcatttttcattctttccctccttcctcatcagtttgtctgctattccatctttctctgtttctctgatggttttgagataagcactattcctccccccccccctctctttcgactttttgtccacatttcttctctgactctctctctctctcactctctctgcttcttctgcccctcctcctcctccgtgtggccaaatgggttttagctgcgaatggcaccccccccccccaccccccgaagcgacgggagaaaagcgcgacgaggaagcgaatgattttttgtgaggggggggggggagaaaatgtaaagggaaattgggacagaaaaatgggaaggaaaaaaggaagtgaaatgcgaggggtttttttaataaacccatgggttttgccattcattttaatgcgcaagtgcaattgataaaagtcattttggcattttccatggcatttcagagatcaaaggagccgagcaatgaatgaatcagtggcctttttccccagtttttcctatttattgtaagaaatgttttgatttccaagtttcggaatttttgtacctatttaataactttttgagtttttttatttgcctatttttctaccgatttcgttattttttcttacctaaaaactcccagccctattaatcaatttanaattaaatgctntttcaatttatttggcgtaaaatgttttccatctatcaaa

SEQ ID NO: 24845 - DNA, 1497 bp, Heterodera glycines
  misc_feature (41)..(42): n is a, c, g, or t
  misc_feature (59)..(59): n is a, c, g, or t
  misc_feature (67)..(67): n is a, c, g, or t
aaattcccaaaaatttttgagcaaaatgcataaaaattctnntaagactaatcattatntaaacctnttgtctttcattatttgtcgcctgggttcaatttcccactgggattgaagatttttcatattttctttaccattatattaaatgaaattttattaataaaaaaatattccaacttttaaattctcaaaaaatttttcggcatctaatcttttcaatttttaaaatcataataaagcaatttatttttttatttgttatgaaaatagttttaaattaagataaattatatttaatttcgatgggcattattttgagtagaatttagattattttgattctcttgccatggttcttccgctttccgtactttgtcaattcaaatgttttttttataattttttttatctttgttcttttattcatataaaaattaaaagtcgttaaaaataatataataatgagaaattattaattcttttacctttttaatcaataaaaaatattcgtttagtaaatttgagaaaatatttcatttttatgaattattggatgaaatattttttataattttataaaacaaagaaattttatgcattattgtttttcctttcttttatttttttaaaataaataaaaattatttaaattcaattattttaggcataccgacattatttatgaaacagaatttgcaattattaaattatttattgattttaatttttgaatatttgtaagagcttgaaaaaaataataattttgttggttcgtggtaatcggcgatgtttgctctttttatttaatttacatatatgctgcataattttattattttattattaatttaataaacttatttcttcttttagtttataaagttttttttttgcttggaaaatttggtattatttttttaaatttcaagcttttttatgtattttttattttcaaagaatttagtagagttgagcggtaatcggtaattgcaaaaaaaccggtaccggtactgaccggtactgcaaaaaccggtaccggtaccggtaccaactttttcatccggtaccggtaaaaaccggtaattttagaacataaaaatttttggacaaaattttccaaatacaaaatttttattcagttttcgcgcgagtacctgttttttagcattagaattgttcagaagtatatgtatattgagggtgaccaagtttttttttcaaattcaggacatagaacactaaaattcagatgtagacctcaaaattcagattattgcaaaacaaggggtcagcagccaattttccaattttgcgaaggggtctccggccatgtaaattaatgtaaatcaatgacctttttttgctttcaacaccgcctttaatgcggcacgttttttccaagacttttgggggacaaggagggccggcggtgccgataggcgccgccgggaaaaattttgtaatttttaatgcgatttgttaactagaatttgt

SEQ ID NO: 24846 - DNA, 1260 bp, Heterodera glycines
cgaaggagagaatttaattaaatccattccttcgggtcatgtgccgggtgccgcggggtaagcagtgctggttcgtctttcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgccctgtttggggtactcaaacatttatgggggagcaaaaatcccttgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgatttttactcgtgtccgtttggggtactctcacaattatggggagcaaaaatccaacgcagaaataaagtacaggctatagggaagctattcccgaa

SEQ ID NO: 24847 - DNA, 2309 bp, Heterodera glycines
catgcatatttttttcctggactgtgggaggcctgaaacgcacgaaaaccatgtttttagcttgttttgaagcttctaggatgactttccatatgatatttgtgcatatttcgcgatttatgtgcatattttggcatttcgtgcatattttatgtgcatattttggcgtttttccaaaaaacctctaatagatcggcccccaacagacaaattggcctttttgacctcaaaaaccggaaaattttccaaaaaaataattttttagcaaaattttcacgaaaaatattgaataaataaattttctcaaaaaatggttaatttatgttaaaaataagcaaaattttgcttttcaggttgatttttcgctaaaatgagtaaattttaagctgtatcgtgtttttttctcctaaaatgctttttaataccacatttagccatttttgaagattttactttatgtttaacaaatttgaagaaattttgagaaattacaccccaaattggaaaaatttatgtgcatatttttcactttttatgcgcatattttgcgattttatgtgcatatttttgccaaccttatttttgaggacaggcgtcctggctgccgccgggtgtcctatttcatggtcgcatactctcgccggcgtcgtcgtcttcgtggatgtcgtcgtcgtcttccccgaaggacagtcggggccgcggcgcatccaacggcttctgaccatgattgggaattttatatattttagtaattattcaaacaattatttaattttcctaatgagcagggaacggtaacttcccacccccccccccctccaatttaccctaacaattcgtccgcaggagcggcgagacacgcgcgtcgtgcgcacgattttttttgttggcgtgttgacgccatgcagctgtcgaacctgttgttgttgttctggcgtgatgccaggacgtccacggctcctgcctgaaacgcacgaaaaacatgtttttagcttggtttgaagcttgtaggctggatttctatatccatatttttccatatttcgcgacatgattgagaattttatatattttagttaattattcaaacaattatttaatttaaggaacaccagagagaaaaaggaatgccaaatttaaattaacgccaaattatcataacgaaagcaacatattaattttaaattccaacgccaaattacaaagaaacattttgctggcggccaggggcggagaaaaagccgtcaaaatagctaaatttcaaaatccattgtgtaaacgatggaaaaaatgctaatttatcgtttcaaatacacccctattttcccagcgtcgctggtatgagcaaaaaaaaaggtcgttcgggcgaaagtttttcaaaaatacacccctaagaatcgggcgaaaattttaaaacaaaatcacacaaatttgctagcattctaaagctcttgatgagctaagtctaaaaaacaagttataaattcgaaccgatgccatctgagcactggacaactgagtcccagtgaaaatggacactttaccgaaaataataaacgggaaataacaatttaaaaacaaaatttcgcaaaagggagcattttatgcaaaaaattttaattcgaattaaaattttgtagaaatatgatttttcattgtcaggcatttttatgtaccaaatgtccggagtcttttgccacaaaattggcctcaccacccacaccaggtggcacggcgcagaaggaaacccgcaagaatggtacttactgttttattattattaaatggtttaaaaattggaaaattttttaataaatgcgcggtgcgcggcctcggcaatttgaatgcgcgatccgcggtgcgcggttttttttgcgcgatccgcggcaatttgaatgcgcgatccgcggtgcgcggccgcggtttttttctgtgcgcgccccacccctggtttgggtccacatttttggtcaaatttttcaaaagcgtaaccagacagtcagacagtgcgctatttccttctttatttttctcacttcttcccttttcctacacacaatgctgctgcacagccagcacacggctgcttactgtctgcccttccacccgccgcgcccccacgagacagacaggtcagacagtgcacctatttcttccttctctccactggctatacggaagaaaacaaggaaatagtgcactgtctgactgtccggggcaggtgaactcgtccaatttgcacttttcctccgtccccttgtcattgtggggacatttgcctcgtccgaccattcgcgcagtcctccgat

SEQ ID NO: 24848 - DNA, 1904 bp, Heterodera glycines
ataaaaagtaataatattaaatttgaaatgctttttaactatatttcatgtttaatactttgcttaaaaattaatatatttttatttaattttaattatttatttttttattatttattattcaaattaattaaattgttttaactgtatgtattaaatctgttcattaatattagtttaaaattcttcataatcaccttttctcagccaaatttagcaaaaattgctttgacattatggaagaaaaacaattgtgaaccaacagaaaagcaaaaagaattatggcgtgaataaaacacagattcattttacaataaataatagttttaagcttaatttaaatttgtatttacaataaataaaattaattccctcgaaatttcttcgatttaaataataaattattaatacaaaaaacaaaatttcgcattgtttaactctaagaaaaaatgctgaaatgaacatctttgtgaaaatgaatgaaattgtaagtttaaaataattctttttttcttaaacaattaaagatttgaaaaaattggtttaaaattaattaataagtgaaaaaataataagcgggaaagtattatgacaaagaaattaattgaaaataataaaattttattaataattaataaacaaaaatgtatttattttcatattttttcgaaaaaacatcgataaattccttttgttttcactgtctgtcactgataaagctttgacagaaaagtattaattcagcaaaacattaacaatgtttacacaaataactttacgaataatttgcaattgtaaaacattaataaaaaataaatttattaacatttaatatataaattgaaactcagccccggcttaaaacttgctcaaaaatgggttttcgaatattttaggcctttatttttgtacagcgacaaaaaatgtaaattttggttataagtatttgtcaagtgctttcgaacattcctaagagaatgtttgatttggctgtgaaagaaaaaagaattacggtcctaaattcgtccagggctattttcggtttcggttttttgtcctttacctggttaacgggaaataaaatcggttttatcaaactttcttttttatgtaatttatttataaatattccatcgttttcatttaatttgaaacaaatagttggccaattatggattttataccttttaaccaacatttagatttgccgcataattgaaatgttttattggcattttaaagaaaaaagaaataaatttccaaaaagcgaaaaaatatttgtcattcattgtcacagtttcattcatttttcagttttcgtttttagttatctgaaagctacttatcctacacggtaagtaaacaaaaaaaaattgtgtatttgttattttataaaatgataatttttttggttttgggcacaaaaaatacagaggaaagttttgattaaatataatgcgcaagtaaacaacattaaggcagttttaagtagggttatgccccgatccgatgcggggaatacgaatcccatcagttggactgcaaaggacgaacgaaaatgttttctttaagagaatttcgaagatatttttgttttgaaaaatttctataatcttttcctcctttttatgaaaattcctccccgaagaggatattactccccgacattttaattaaatttctccatctatccccgaaaatttttgacggggaatttcctcacccatccccgactttcctctccccgccgagggtcgggggtttaacaatagttttaaggaaaataagcatacattcgagaaaatgtataagaatctaaaaaatcaatatgctttttttaggtcggcatatccaaattagttaggaattgctttctttatttattttttattattactataaaa

SEQ ID NO: 24849 - DNA, 2664 bp, Heterodera glycines
acaaatatgacgaatgtgttttccaatatttccatccaatattgaatttgattctcttttccgtccctttgatcgtccgcccgttccgtctcactgatcagagtctcaccaacccttaagcgttgaaacgcgtgtccgccaaaatatgcccgttataacagaggcggttgttcagcacagtataattaatctggtcggtgtcctcaacgcgcgggatgaattttggcgtactgctggagggattaattatcaccgttaattgattagattggctagggagactcaccgcttcagctcgttgaaattggcacgcccgcgcttggccaattcggcagcctggcggacgggggttggcaaacccggggccaatgtcacaatttgccaattgcagcagagcgaaaggagaaaactggaaaatcaattaaaaagcatgacaccagcaacaaattaaagaaattggagacgattttgtgttcaagttgctgatatcggaatcccccacccctcggcaccgtttttgtccctttttttggttccaattacatagaaatcgtaaatttttctcaatatattaatccacctttgcaactcgttgttattggccatgacttggttcaccgggaagacatattgagggattttggtggttccctgtaataaagcataattaagcgaataaattcgtaacgaacggtccgtcatttcaaggccatcaaaatcaccttcaacggaacgtgagactgcagccagaactcgtgaatgtcaatgcgcgtgaatttcgaatcgacgacgcttcctcaaaattaataactttaattttaattcagcattcgtgctatttttgatattaggcatcggtcggagaaaaagtggcttatccaaattttggggggaaatgaaacttttttgaatacgacggcacttatgactggcttttgcccgttccgtatttgaaactgatttcggcattcctgcactgttttaggtgataagccattgactcgtaaacatttgtgccgttctcaatttgtccgttaattgttggccaacggatgaatgagggaaaggcatggcacaactaattaaccccacccggctccgtgttctccacttgctgcccgcttttgacaaagaagcgcttgttgtgtttcttgtccacaatgcagtagacaaacttcggtgaccagttcggaaccgcctttttgcacgcgtcgacgtacgcttggaactcgctgtgcgcgttctgaaagacggaggacagagtgccaatgccaaccggtggaattgcggtgcaaattcaaaccgaccttcggcaccattccctcgctgatgccgtcgcggatgatgaaaacctttgagaaataacattttgttcgtgatgatcagtgatttcaatttggaaggtccaattcagcagggattggcacgaaattcggatttcgacattttggggtcggaatttccatttccgaaaatttttggggcctcggaatgccatccctggtccaattcgttgacttaccaccgacggcatcttccctcggttcttttgcactttgtccaaaatccagccgaatttgtattcgagcatctgtttttgcaactgatcttgacttaaatgggaagaaataaaacgggaaataataattatttctattattaaaaaacaattccatgcattattattaattggaaggaaaagcaaacggacgtgcacggttggaagtaataatcgccacagaacttgtaggggttcttcagataatttgcgcaaatgccaactgtgaaattgaaacaaaaaatcacttaaaaccagccgaattttgggcatttaacaatggattagagataatccccgggagcgattcccgatcggcggaatgccaatgatcgctgtgccattgccgcgcccattgactgtttcgttcacccaccggtcatcggttcctcggaggtgagctcggccagccccttgctgcacagtttgtaccggtcgtacgccgtcgcttttggtgggcgactcgtgtcaatgccaaccaccagcaaatcgccaccgtccatgttcagcttacccttcctaatcgttgagaaaacaaagtgtattgatcaatgagtgatcagtcagtcgatcgatattgtttttttaaattttcaacaattaattgtaatttttgaaaaatattttgaacagccaaaaaaatgtccctcccaaagtggcacacgttgaaaaacttacgtgatttgcgggaagatgggcaagtagttgaagccgaacattctgaaacattggaaaattatgaaagcattcattaatgagtcagctgattattctgatcagacttcatgttcattttgttcagcacatttgacaatgtcatggcccgcgctttgctcgccacttcaaaggtcacgtgctgagtgagcaggccgaaacgcttctcgttcagtttgaggatggctaaacaaaagaacgaattggcaattagagaataggcaattgttgaagcaacggttttaatacatattgtaatgccgaaaccttggaccaaaaatggcataccgtactctgaaaactacgataacccccccctccccccacccagcagtgccgacatggcagggaatacggtagatgtcaacaactatcgtacttcccaccccctc

SEQ ID NO: 24850 - DNA, 1661 bp, Heterodera glycines
tcggtggatgggttttagcgattggacatgaatttttcctctctccattccatcattcccttgacaccggggggcaattacctccccccccccccttcccctcccccttttcccccgtcccttccctccctcacaaataaaccttttcgcccctctgggcttgtccggtgggtccgcccgccgccgctgtttgccttttccttcctattctaattattttttgccgcttcaactcgccccacttcactctcggcgtggtgatgatgatgagtatccccatcccccttatgccttggccattgccaactttgccctctcctcccccccccgggcttttgccctttcactctcttccctttccctcgcccctccctttgtgtaattcttttttattgtgttcgctccttccccctcaggcgccaatgattgttctcgttgtccccctctctcttcgccccttcggcgcggattgctgttgagcctggtcctttcccatctttcaccccttggccattctttccgcaacattcccccaaagaatgccttctgccaaatgggtgtgccatccgtcgcttttctgttcactgtcgatgattctgtctttggtgctaggccatgaagcgagcggagacgccaaaagcagaagaactgtttccggcactggcgctgcaatttcgccggagggtgccgagggcaaagaatgccccgcggggtgcacttgcgcggagctttcggtaattggcagcgatcttcttcctcgaactttacccaaacatttgctgcagttggaatgcgccggtttcgacttagaaaccgtccccaacgaatggccctcgcatttcgagcgggtcgttttgcgcaattggacaatgtccaccatcgacaaaaacgcattccgtcgcttccaatatttgcgcgaattgcacattttggactgtccacggttggatctgatcgaacggcacgcgttcaaacagttgaggaaattgaggtgagaagttgaggctggtcaaatgcagaataaatttcgaaagaatattccaacaatgtcaaaatgtggcactttgaaattttaaattatggaaattaaaaaaaacatggctctgaggggggggggggggggaagtgtcggtttgtcacgggagaagggggaggaaaggcgttggaaaatgtttgtcggtcatacggcgacccattggcagggaaatgccattcttttgcttctttcaaaggctgcttgtgatccggggcaacaaaagtcttcgcgagctgcacaaagcctccttctcagccatcggaaatgagcagtcgctttccattcaaattgcggacaatgccatcgaacggattcgctcctttgctttcaagtgccattcctcttttatgtacaatttcgacataaatttgtatcataaatgctcaaaatctgcgcgaactgtcaattgaagagcgctgcttcgaattggaaggctgtgccctcgggaccatttcgcgtttggactttgtcactttgcacggggtaaggcacggctttttcctttcccttcaatttgatttggtgccctgcttaatcaattattgttaagcttcttccattttgattttccttcttccccccttttcggtgtgttctttggaaccgttcgccttccaaaacagca

SEQ ID NO: 24851 - DNA, 1215 bp, Heterodera glycines
ttaaatgctaaaattttctctcttataatttttttctatttttttatctcatgctatgttggttgtttagaatcgccaatattattatatatattaattcataaaagagatgaagtgaagtaaacaaataatttatagaagatacatttggtgatatttttataatcttataagtagaaattaaataaacaaaagtatattttagtattcctaaaatttatttttgcaaaaaattaatatctaaatgaaaattattagaagcagaaaaattaaatatttatgccattatcaatctattcaacaaccataagcttttaatgctttatctcatattcaaatcaaaagttccatgcttaaaacgatatatgaagaagactgcctaaatgtacagataacaattaaataaaatagaaattatttaatttaagaaaacatatatatttgttgatgactgataatttcttttctataaatataatattaatttctaaaattaaaaggtttctccaatattttaaagaaaattattgcaaatatatttagcctttattattttatgctcattccagataagaagaaagaggaagagtaatgagaatacgcaagaaaaataaattttaattattattatttattaaatttaattttcattaatagtaaaaataaaaaaaatattgttttacattaatataaaatttctaaattttaatgtcaaattttaattttttaaatataatattaatttattttactttcgagaataaataacttaaatcattgaaaaacaaaaacttaaaatcctttttctttaaaattagagatgggaatttaaagctaacctaagtaattaaatcattattaaaatgacgtatatttaaaatattttatggtcgcttattgtaatatattttgttaaaatttaatcatagtaaagcaataatttttttaaaaaattttcatgtattcggtcattatatttaaagaaatgataattattatatgaaaataatattaaattcatataaacaattaaattaaagaatattttctcaattagttcataatggtaaatcaaaatgaaaaaggaatttaaaagaaaactcaatctatttattggttacaaattagtgcaaaataccaattaaaacgcactcaacgccaggagagaaataaattaattcagtttaaaaataatttattttatataaagtagta

SEQ ID NO: 24852 - DNA, 1132 bp, Heterodera glycines
ctctcccccgccctccccgttccccgcccgattttccccgagattcgtttatccccccccccccacctatgtgttatataaaacaaattcaaccccgttaaattagagttttaaacttttttccactttaattgacatgggtaattaattgattgaagcggaactctaactcattttgataaaacttattagggaaaggaaccccaattaaatattaattaatcatcaatattcatgaaatgcctgccatcccatttattctcttctccgatcgaaagcggaagctgtgccatctcattcttcctttaagaccatttattctcttctctgatcggaagcggaagacgtgcaaaaagcagtctcatttttcttacaaattcccgaccattgaaaagggtgtcgagactgtgagtgacacaatgataattgcttgacccttttacccgttctcgtcaaaataattgctcttctccccccccccccccttccaaagtgtccgcttcacccgttgacggctggcggaagtttgtttaattaacctccaccctttcccgaaaaattaaattttaaaagtttgtcgagactttaattagtccaaaccagtacaaaaatcaccattcaattttccagactaggcagctttgcaaacattgcttaactctccctccccatctctcccccgtaatttgctcatgaaagataaaaggcccattagttgttaaagtacttccgcaccattaccttccccccttcccccgccgtttgttgtgttcgtcttgtcttcgtaaatgcatgcatttttgtttgaaagttcccgccactttcaattactctccaatccactcccccgtcggccaattcattgccccttcacctcattaaactcacctcctctctctccatctgccaacaactgactcacttaattgcgaaaaaggttaaaaaccgatataatgccgaatttatttctaacaatgaaaaagccactaactaataaccgtctaatcatgttcgagagtctctcttaatggcaatcattacgaaaatccgcttttccatttacgaattaatactttatatgtattactttaatatttttgaaaatttttttttattaatcaaaagactctag

SEQ ID NO: 24853 - DNA, 1733 bp, Heterodera glycines
ttaaaaatcgataaaaaatcaatcttttgaggtttttcccaccaagttttgctttttttccttatttaagctaccatcccttttcccttttcatatgattgacttttttacaccaatttttgtggtgctcttttttcaaaagacttttcgggaggaaaatttttaagattttagtgcaattttttaacagattatatccagaaatatccaaaatttttgcggttttgagccaatttttttaagaaaaatagggattttgggtccggtggaggcgaatggcgccgccgagaaacattttgaccgttttactgattttcgccttttcaagaaactttgtgacacactttagtatattatctgctcaaacagtgacggtgttaccatcgcataatcattatgttttatacatgatgagacaaactttgacttggaggggaactgatcgaacgcaaaaattaggaacagaaccaagaacagaacacactataccacgaatatgtcaacaaaatttaacaaaaaaggacctaaaatttataaaaatataaggttactaaaagccaatcattgctttttgcgacacttttatcattttcgttttgcgattttggtaaatccttattaaaaaaagaaaaagacaccccctaaatatcaccttccaaattttcaaaatacttcacaaaactagcttttgatttgggaaaatcttagaaaaaaagaactcaattatccaatgacgcacgcataccgaacactttataattaacaattaattgcccaattcattcattgttcaactttcaaattaattttaacttcaataattctttttattcaaattccaacacattcaatcactttacacattatttaatcgcttacataaatttgtttttgctgaattgttaatgagttttttttggtcagctttcacaaattccgatattttctgttttccattgcaaaatgtgatgattgtccaccatccatctgctgatcgcacagcacaaattggcagataactttcccagcaaatttttgatcggaaatggacaaaaaattaaatttgttaacattgattcatcagagggagaacaaaaataatatgtgaaaagtgatttgaataaaaatggataatattttgatgaaatgggtaattaattaagctaattatgagttgtaatcagaacaatttgattggggaagtgtgaaagtatcgttttttcggtcttcgattcgtctgtcagtgatcactcgccgatttcattcttcagaatttcttctaaaatcaaaattcgccacaaagtttcttcggtgccgttttgttcttccaattgtttgttttctgcattttcaaaatgaaactttttgatatttattttactataaatgaaccaccggccgttaaatatcattttgcatttgaaattgatttgatgatttatgattggatttagccctcattaaagatttccgagatgaaaaattggaagaaaagggtggaataataaatttaatacattgtgtgaagtgatcggaatatagaagttaggtgagtgtaagctaatgataattgaaaataagtttaaggaagtgatcagaagagaactcacaaaaagagtgctgcatcttttcatccttagcaattttatctcatttttcattgtgtattttaatttgttttccaatggccaattgtcactcaccaaaccgtaaaaataatggtggattttatt

SEQ ID NO: 24854 - DNA, 1723 bp, Heterodera glycines
tcaggccacactttacaatggcagtgccggcgtcagtgccatttattttcgcgcatcaaaaggacaccaacaacaacaaaaacaacaattaaaacagaagcaacagctgaagggggcacaaaatttcactttgggcccagtggaatgttcgggcgaaggtataataatggtttcgggattccaatggaaacctaggtctgattgatgatcaaattgatcaattttcatggatttgaatttctcctgataaaactgatctgataatttaattcgattaaatttggctaaattttcatatattttttttgatcacttctgatggattagttaattgggccggatattaataaatctaactgaattaatttaatcaggcataatgacctgatttggtctgacctgctgataagaagttaaagatttaaagttaacttttgtatatgattagcttgatagatttagttagtttaatctattttctttgcttaaatgatcttactctttttttcatgcttatttaattagctcgattattaggccctgttcagtcaccagctgataccatttctatcactatttccattattagccggcacttcactgcccggcgcggtggtcacactccgctcgccgtctgtcggcattggcaccgacccaatgggccaatggcgtcagctggaatttgacttccgcaccggacagccggacattgagcaaattgtggccggatgggacccggcggacaatgggcttcaaatgaaaatctcgctcagagcaggtggccaattataacaaatttcgtccatttgtcccttttttcgacattttgtcatgccaaatggggccagctaactcgaattgcttagtcatagttctatctagtcgagaaatttcttgggttttgggattctcggctttctgcaattagcccattttgatactttgtcgtgcgatgtcgaccatttgtccaatttattaaaaaaaaatttggttaaaaggttcataaaaacaaggatatttttcaccttgtacagaattaaaaagtattttctcgatagtctttcattttttgttaccccaatttaaaccgtaacccaatgtgttaggctaccgtatcgagttgacactgtcacatcaggcgaacattgagcaagcagaaaaaagtgccgaaacggatgacaacatggacacatccaatgataataataaagtatttgtccatcaacaaaagcggggcatacgacgagaaatgagtgtttccattgcatcccaacggcctttaaacgatttgttttggcacagggtaattaattaataaattaaaattagagtattcaacaactaatcaatgctaattgcttttaggtgttggtcgaagtatttcgtggtgaaattcgtttttctgtcgaccgtttgaatgcatttcaaccactttcatttccattcgcaacatccacgaaatttagcattggaggcgatgaaaagtaaaaccataaaaatcatttttaaaaatttattataaattttattttcagaggcaatggctttgtcggatgcattggcaacttccaaattgatcaaatgctgcatgattggacccagcaattagcacagaaggacagggatgaagatggtaataaatatagcccgacacatgacagtatcctatacaggatactgaacgtttctgaaaaacggggttcatagggcttcgcaggactag

SEQ ID NO: 24855 - DNA, 1878 bp, Heterodera glycines
  misc_feature (94)..(94): n is a, c, g, or t
  misc_feature (117)..(117): n is a, c, g, or t
acttgctcgaggagtgccgcggaatccaatcgctgcaaattcggtggcagcactcggaaatcctggtcaggttcatgcgattcaaaatcggccncaaaagctgaatgatggcaatcncaaaagattttttccaaagaaaaatcgggattttccgaaaaagggtccaactcaaattttaatgataaacgacaggaacaaagacagaaatgccaacgttgtggaaacgcccgcatgctcaaggactgcacttatcgaaaggatgtcaaatgtcaaatgttatggttgtggtaatctcggccatataagaccaatgtgcccatccgccgtgtctcagtcgcattgtgtggcgtcaaccttcagtgttgttcaggcgcgagattggatcatggttccgatccaaatcaatggacacaaaatcgaattggcagccgactcatgctcacatctcacaatcattcaaaggccgatgtggttaagtctcggagggccaaaattgattaaaagtggtaaaattgtgggatctttttcaggccataagctttgtttgctaggccaattcaaatgttcggttgagtttaaaggtgttcagattgctccttttgaacaggcaactgaacaaccaatcgcaacgacgttgagttccgaacattttcaaccgaaaactttggcaattgcaattcccgatgaacctcaagggctggcggaacagcttaaaaatgcttttccccaagttttcgcccccggaattggcagatgttcaaagatgaaagccattctgcatctgaagcctgatgcatctcccattttctgtcgagcacgtccagtgccacatgatgttcaagacgcagtggacaaggaattggatcggttgctcgaaatggatgccatcagaccagtcgatttctcacgttgggctgcacccgtgctcgacgttcgtaataaaaatggagcagtaagaatctgcattgatttttcgacgggtctttatgatgctctagagctaaaggcaccccctgccccgcacagatgacatttttcatgcattgcgcggctcgaaaattttctctcagctggacttccgtgatgcatatttgcagttggaattggacgacaaatcaaaaactcttgtgggaataaacactcacaggggtcttttccaatttcagcgtcttccgtttcgagttaaatcagctccatcgatttttcaaaagaccatggaccagttgacagccggaattaatggtgtgttcacatatctcgacgatgtcatcatcgcttcaaggaacgaaaatgagtaactcggttcttgctttgaactatggtaaacgcagtaagccaagttggttggaaggcaaaattttaagtgggaaaggtttgatttggaaggtaaacattccaacattgggaattacggtcactcgacacgtgaatcaattacggtcttttgttccctaccaagcaggaaaagttcaaaatgatcagatccatcagcctgaaccggtccacgaacaaaatttgccagccgaacccgccgaaccgattcctcaaacgccgaaaaccgtccgcttcctccaactccacgtccagtccgtgaacggcgtccggttgttcgttactcacccgaaccatgggaaagacgaaaacggaaatgaggacaaatgatttaaaaggggagatgttggatagggatttaaatgttttattatgtattgacacgaattaacatcatccatttcatactgtatcccatttcccaatccttcctcatttttcattcattcgtcgcatttcccaattttctgattttggacttttaaaattatattttcttttctctatcttattatttttgtttgtcctttggacacaacagggctc

SEQ ID NO: 24856 - DNA, 1576 bp, Heterodera glycines
  misc_feature (32)..(32): n is a, c, g, or t
tgaatttgcccaaaaagcgtggaccatcagcngtcgacgggttcatttggggcacacaaatggtaaaaataaaatatactagtatttattgccttttttaagaaaaatttattattgttgtctaaaataggccaaaatgtaaaggaaatctctattaaaaattactcattttttcagtttttttttaaatttctatttctgtcaaagggaaacgattggatgtggccttcaaatattttattattttttttggtctacataatttttcacaatttttcccaaaaaaggtacgcaattttgttggacagaacagcggaattggagggcaacaaagcgcgcatcgccaaagcaatggaggtcaaaacgcattttgaacgtgccctggagttgaacccaacggacgcgaccacttggcaccttttgggttcgttggccaaacattcaaaaacaataatgtaatttggtgtaaaataatattttgttttaattttcttggtctaaccacatttacaatttattttaaaaaaattaaaacgaattgggaaaaaaatttaacacctcattttaaagtggatcatccaaagcttttgaatggtatttttacattggaatgtttttgttttcactaacaattttaacacccatttttatgacgaattaaaattaaaattaataagatttccatcaaaattcaatattgccaaaatcatcgcgggaattaaggcgtgtggcactacgaattggctgatctgtccacgcacaaacgatggttggcctcgttggtctatggcagtccgcccgagaccacttatgacgaggcattgcgctgctttgaacgagcggaaacattggcggtaattttatttttgatggatggatttttttttgatttttttttttttggtggtggaatttttaaaatttgtttttagccttgcttttactcggccaacaattattatttggcacttgtgtatgaaaaaatgaatcgcaaagaagaggcagtgaaacagttcaaattggcatataacgcgccaatggccgaaccggacgacttggaatatcacaacaaagtaggggaagatgccaaaaaaaaaatttttttaattcaaaaatccattggttttaggctctttcacgtctcaaatcctacaaatataacgaagaacaattgtgcaaagagaaatgaatcaattaaatgaattattttggaaccattctttggaatttatcagtttgtgccacctttggaattgtgcctgataattgattaatttttgggcatataattaaaatgtgtttttaaatatagaatatttaattttttaaatattgaacggatgattcacaatatatccatttgtaaacttttcaaattacactttccattctttcattgtccttttaaatgaaatacaatcacaagtttataaacaaaaaattgtcaatttttgtatgactcgttcggactctctgtttgttgcagcatctctcaccattccgatcaatccaattagctcgtggcacacacacattcgcccttcatgcatggcaagccgaaacagtcgtccgaatt

SEQ ID NO: 24857 - DNA, 1701 bp, Heterodera glycines
gagaaaagtagcaaatacctagtttcataagataaaatagttcttacagattctttctacaaatcattcgacaaataatgacttacaaaaacgtggaacgccaatttctgcaatgattcctttgttcagagtgatttgctttgcacttgaagaaggcgatttgaaacatgtaaaaaaggcaattaccgatgggacttaagcatcgaatggatgcaaaaattgatgccagtggaaacgttaaaagattttcgtgggatgaaagcagagagcttgttctgtcgacaattttggaccctcgtttcaaactttcttttttgaatgcagaaaagcatgatcgatataaaatttggcttacaaatgaagcagagaatgtccaaaacggctcaagtgaattccatgatcttttctcccgatgtgaacaaaatattgccacagaatgcggattagacattactgcgcaaccgttacctagtccagaaacattgaacaaccgccaaaaagcggaagtcataattattaaattttcaaaatttatttgtttttaattaaaggttgaagtcaatgattatttgcatgacaaaaaaattccaatcgactctgacccatacgggtactggacgggggacaatgctgtaaaatggccccttcttacatgtcttgcgcatcgttttctttccgcgccggcgacatctgcagaaagtgagcgcctatttagcgctgcaggattaataattaatgatctgagaaaaagattgactccggaaaatgcagagattttgttgtttttgcatcacaacctcaaaatttatgattttgactattcgtaaaattttttgaaaaaaatttcgcttttcgcatttcgcttttcgcattttcgcatattttggcttttcgcatttcgcttttttttcatttcgcatattttggcttttcgtatttcgcttttttttcatttcgcatttttcagtttcgcaaatttcgcttttcgcatttcgctttttatttttcaatttggcccatccctggtatagaggcattaatatcatttttttatcatagaaaattgttacttggcaccgctccatgcatcagatgtgaatagaagccattttcatacttctaattaccttttggttttttactcaactaaaatcgctttatgtttattatagaacaagataagaatttttaaatttagaattgttataaaatatataaatttaatctttaacgcaataccatagaatgcgattaagataattttacttaaaattaaagtaacattcttctaaaactgtagagacatttgggtcgattatatttttaattttgaggttgcatcaacagagtcattaaaaccttccaatattaacagaacaggtgggatatcttattatcttctaaaatattattttcagccaaaaaatgcatatatctatgagtatataattatgtttctgaccaataaacggttgacattttattttatttattagtcactttttaacaacattcaagcagttaaaaaattccttagatggtaacaccaccttcaatgacgttaaaatttagattttaaactataaattctgttaaaaaaatattgaaatagatattagcttaatatacgagatttgttttcaatcattgaacattaagaagttgttttagttgttttgtttaattatttattttttattt

SEQ ID NO: 24858 - DNA, 1642 bp, Heterodera glycines
  misc_feature (1284)..(1284): n is a, c, g, or t
  misc_feature (1298)..(1298): n is a, c, g, or t
ctcccctcagattctccacgaccaatttgccaaggaggcggacgcgcgcgcgctgatttttgtgtccacccgcgcgtgtgcccaacgtttggccaaacatttgatggaggtgaagcccgaatttccaatgtttttcaaacaaaaggtacgcaattgcaataacataattaaataattttccaaaatcccattagattttcacagaatgtcggttacatggtcagctccatccaaagcggcacaatgggcggccaatcgtcggacgaacagcgaaggatgcgcgaagggttcaaaagcggactaattaaggcaaaattgaataacaaaatccccaaataagcatatttacataaaaaacattttcaggtgctcgtggtcacttcagtggcggaagaaggttattaattagcaatcgtttttgagcgattttattttgaataattttacctttgttaggtgtgaacatccccgcttgtaatttgatcatccggtgagttttaaatgctcatacattaaatgggggggagggctggtcaacacccctgacttcgttcgtatgaggggccgaaaaagggggggggggacttcaattggttgggataaaatgtgggaatggtcggtgattttcaccgactgcgctgtaaatgctgttttggatttatcattccttcacctttgcaatttaaggtacaacaacatcggcagcgaacggcagatgatccaaagaaggggtaaaatgggcgagggattggccagggcatgggaccgatttgaaggagcatgagagcgtttacaatcatagtgggactgatcacgaggcattaaatgattgtgaggggctgataaagcacatggaagcaatgagaagcactgatcatatggattggattgaatgaaaaatattttgctgattgtggtagctatgttagcatcgcgcgagcattatcatcgacattttgcccaacacattatttataggccgtgcccggcacaagcacagtctgtccattctgttggcactggacaccggcattgagcagcgggagttcagcaacatgcgcaaggaggccatggcaagtgaaagagcggattatcagtaaggctgggaccgaaggccttaaaatttagcgaaagtccagtccaaaaaccatgaatccggccccacatctggcttggatgttgatttttaaagtatattttatccaaatccaacagatgatgcgctgcattgaggacatgcaagagcaggatgagcagacactgcgcagatcggtgggtggcatntggcaattcgaganaatttccaaataaaaaaaatattcatttactataataggtgtcaattttttttacagatcgaggaaaaggccattgaattggccgaacttcgcaacgacgagaaaatgaaggaggagaacaaacgggcccagctgatgggcagacggtgtgtttgttttatgtcattgtgccatttttaatttatgattattttcagtttcgatttgagatgcgcctgtggcacagtgatttgctgcagtgaccgcgtccgatcggtgatgggcactctgtttgtgtgctgcgatccgaaagtgtggaagcgatcgaaacacacgctgacacgggccccaacggtggggagggg

SEQ ID NO: 24859 - DNA, 1376 bp, Heterodera glycines
  misc_feature (1302)..(1302): n is a, c, g, or t
ccccgccccctttggccattcatttattcccctctggccaacgttcgttttcccatccaacaacatttttgtttttttttctcatttggccaattgtccgtctccattttttgctcattttactacaaaaatatgcaatagttgaagcggcaccccacaaagtgtccaaaagagtaaaaacccacgaaatgtacaaaatttttcaaaatttataaaaacaaaatgagtctaatttaggatttttaggggtttcggggtcgctgaatacgaatataccctttatattaccccttgcctacccttaggcccatctgaataataaaaaactcaaattcgagacttggacatttcgtgggtcagcggttgaagcaaagaaggaagcaaatgggaaagagaaaaattgggcttacaattagattttatctgctgctgcatttagcgacatttctgacattggaaaaaatgttaaaaatttgccgccaattgaaactacaaaaaatatgcatacagtattgtttattcaaatttattagcgccagagaaaaacaggaatttgtagtggttttttgccaaaaaaatgacagcaattttgcaatttttggggccaaatttccgaaaaatgaaaaataatggtacaatggagtccggctgtgctgacgcttaaataggcaattactaattaagttaaatggaatttgggttgggagacaaacaatgaaatcccctttatggacgacctatactgactgattgatcactactgatgctgatcatgccaaaatttataccccccccgccactgtgcgcacttcatccgaccccttctcgaaaaattataacgcagtttatggacaaattttagttcaagaaatcactaaatttatccttataacatacaaaacacaaatatacatatgttgatcaattaccattccatgctaaaaaaagaacaatttttgagcacgtcaataattccataattcaaattggtcgatcacttctcagcaaatcattcattcattaacttctgctgctgatcacttgtgcccggatttgcatcgagaagcctaaaaaccgaaaagcgatgactgaatttttgaaaaagcattcgcttacccatctgccatttcgtcaatttggatgaaaatttgattccactgaaaagaatttcgccaatcatttgcttcattttcccatttcgcccatttgtccgcgtcacgcacaattgggcaacgaatcagcagaaaacagttgcaagattcacaaaattcagttcttttcaatgccaattttgtccgagtncatttcgtggtcagcacaaagggcacaacggtgtcagcaaaagatgaacgaaaacgaaagacaacaatgaaatt

SEQ ID NO: 24860 - DNA, 1374 bp, Heterodera glycines
ttttttcgcggcgcgctttttctaaagacttttagcagaaaggggtccggccgataggcgccgccgggaaaatttttgaaaatttggatgggtctgttaacagattttgtcaaaaaaatgatagattttttcgaagctttattttctaacagattttaataaaatttatgaattcccgtgaaatattatttatttttttatattttgtaaaaatatttacttttcatgatttagtcaaggaaaattaaattttttaatttcaacgaaaggaaaatagagtttaatttgtcaataaattatgaccaatgggattttgtttaaaaaactctattaatcataaaaaaaattaattaacaatgaaaaagtcaatgaggatcgaactcatgacaaatgtagtgttagtgttaacgcactaaccactacagaaatactacatatgactgaacaaaagcgggtgtatatttaaccccgagtcgaggttaagggtcggggtcggggttaacccgaaaaatgggcaaaaaagtcggggcggggtcggggacgcaaccctaattcgaaagcccaaagtctaaagaagctaaaatatataaaacctcagcgtttaggcaatttcaaaaatgctttaattaattaagtaatagttgattattttcgtttgttacttttttaaaatgttaaaattctcttgttttctcatattaataccttatttagactttggggttttcaaattatatcaaaaagatagggtttgttcgaatatgaacaaagttattgtataaaaacccgagattgtcaattgattggactcacaaaatgaattagagccttaatgagtctaaatttttcgaattttttttgttacgacttttgttaaattccagttttaagaaatcactaaatttatccttaagacatacataacacaaatctatgttgatcattccaacaacaaaaaaggaacaatttttatgagcacgacaataattccataatcaaattgatcggtcactttccaatgtcaattacgttccactgatcaagaaagttccaccaattgttcatgagtcgattcgttggccgtatagaagatataaaaggttccatcgaagttcttctcaaattgaatggaaacgatgaaattgacttgacggaagatgaagccgaggcaaaagcctacagagggaaaaaacagtgaaaaattaaaaagcatttcctggtttgaaatagaccaaaaaatagtaaacaatttgaatttttgccaaaaacaaattgagtaccgtctaaaatattttgtcagcggctgtaaaaatgtcaattaaaatcaaatcaaaatcgccgctttgaagctatcaagcctcaacgcgaaaggca

SEQ ID NO: 24861 - DNA, 915 bp, Heterodera glycines
acacgtaaaatattccaaaaaaagagatagtgattttttctgggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgatttttt

SEQ ID NO: 24862 - DNA, 1970 bp, Heterodera glycines
  misc_feature (1872)..(1872): n is a, c, g, or t
  misc_feature (1886)..(1886): n is a, c, g, or t
  misc_feature (1909)..(1909): n is a, c, g, or t
  misc_feature (1932)..(1932): n is a, c, g, or t
ggcggtacgacaattgcggaccggcaattgcggaccggacaattgcggacgacaattgcggacgacaattgcggaccgtacttttgcggacgacaattgcggacgacaattgcggaccgtacaattgcggacgacaattgcggacgacaattgcggaccgtacttttgcggaccatacttttgccaaaaaattaactggaagggtgggcctcgtcagtacgatcccttccgtattacaaatttgaaatcctaagtgtgtttcggcccttccgtagacacaccaaataagaaagctcacagcaataaattaataaataacaaatagaaagcacaattaaggagaaaaaagcaaagcataggatgataaagctataatatgtttattttattggcttgctgaaggcccaacaacagcttctacaaatacaacttatgaacataaaaataactcaagactttttccattcatcaaaccatacataagcactatagccattgcttttcgtgatcgtccaatttttctatccccaccatctttagctaaattacttatttaaatttaattattccaaaatttcttactgtaaaagcaaatttccttaacatggctccgtccggttatgtcttcaatcattgaaaaaaaatgtgaataattgaagtctttggattctagcaaaaattcattcttttcgagagtgaaaagaattggaaaagcggctcaatcaaatccatgtcgtctgaacaaaatacccaccttagttcatgaaaaccattacctttggaaccgatattatttaaggggttccaataaattggaagtagaatagattaagtattattaggtggaaagtttaaaatatatttttaaattcttaattagaagaaatgaaaggtaatggattaggaaacgaatacccaggttaaaaaattgatgcaaaaaaaaagaatctacaatcctttgaaggcaagtatgaattccgcgacaaccggccattataatgatatttttaaatttaagggttgtaataataatttttattttaaaaaataaaaatcgatctaaaatatttgataacaaattagctaataaaaaaattaataagaaaaatcaataatgattacaaactaataaattaattatcaagaaaaccaaagttcgttttcgggaatgaaatgtgattctttatgctggaaaatttttttttgttgatttattcaaaaagcttcaaaattataaatgtataattcttattatgaataaattaaactataaatattttaaccatgtttatacaataaaaaataaaaagttgtgaagtaatttaatgtcagctaaataaataataactacattaaacataactgtttatagttagtttttttttatatttataattataagcatgtaagtgttgtgaaaaagcaaaaaggtttaaaaactgaaaattattataatgaaaataaaaccaaaaataaaacaaaagtcaaaacaataaaaaaacaattttaatttacttaaagaattaataagtctggactcaaattaaaaataaaattgcttgctatcttctaacagataatgaatgagtgtgtattaaatcaaatgatttaaaaaaattaatcattcttcgtgaaaatcaaatttatctatcgtgattttgcataacaaaaaaagaaatagatcatttacggaaataatagagaaaaaataatgaaaaggtgtattttaattttaacaactaactgcaataatttaatagaaaacattaatcgaaaaaatgtaaaatatccactacggatgatttaatgaaattgaaatttataaactagcagtatagtgccatcgatgtttattaatgttaaatggattanaatgattaaatcanagaatttaagaaataagaattanattaaattttaaaaatattttanataaaataataaaaaatccctgaatttattcatatgtt

SEQ ID NO: 24863 - DNA, 1114 bp, Heterodera glycines
aaaaaatggcctaagggtaatacttgagaatctgggctccaccaaaaaaattttttctgctatgaaaagataaacccggaggttttcggggcttctgatcacgaatatgatatcagatttgcaaaaatcattgattttgaaaatcatagattttcgaaattttgattaacatgatcaaatgctgttctttttcgagtgaggcaaccatatatttatttaggctctactccagtttatgcgtccaatcgttttttatgcgtccaatcgacttttatgcgtccaatcgctttttatgcgtccaatcaaagttttgtgcgtccaatctcatttcatgcgtccaatcgctttttatgcgtccaatcattttttatgtatcaaattatgtttttttgccaaaataaaggttttatgctttcatgagtcaaaaagtttgccacactttttatgggcagccgctgcccttttccattagtcggcattgagggcagtcgccgtttttccattaaccagaattgaagtcagccgctgcctttttccattagtcggcattgagccacgagacggccgccgccactttttctctccaattttcggcaataacacagacagccaccactttttcgacaaaaattggaatgttgctattagctttattttcggctgtcactgtttcggccgccttatcaatgaaatgggacggctatatcatcgacaaatacggctacaaacgagcaaatccatggcattgttgcggagtttgtcatgacggaaataaattttacgaaaaagggcgttgcgtaaacgaaaccagctatgaaactgcaaccgaccgctacattcgcaacacaacttttgtgtatatgactggtaattgagaataaaatttttcggtaaaaaagcgagtatattttctttgatattagcacccaattacagggctaagtataacagaggcagaatggtgcaacgacagtacgattggttgttcgggatgcttgagagaggcacgaataaagttcggtttttccctgtcacaaatcgtgatgccgctacacttttgccattgattgctgaaaacatcgagccaggcacaatgatcatttctgacggctgg

SEQ ID NO: 24864 - DNA, 1251 bp, Heterodera glycines
aaaatgcgtaaaatttttttgtgtctttttgaaattagtatctgaaaactgcaactaattcataaaaattaaatcaaaaaaaaaaaattgtgtaaaaatattaatgcgccgcacagcaatgagaagttttcgcccgatttgagccctcggccaccgctgatcacaatcttggcaccgcccaactcaggccgctccgacttggacagttcctggcccaggaaggcgctcagttcgactacgtcgggggacggcggggaaaagtcgggggctggaaaatgaaatatttattcgataaattgaattaaaaagtggggggaaagaccgaagtataaaaagaaagaaaattttacaaattgaatttatgatggagccaaaaaaatagacgcgggcgggccaaaaatttttaaaactgaaaacttttttttattgtatattttttcctaaatttctaggtgttaaaagcgtgtcccgacatttgcggctcaaccaaaattagacttaaaataaccgacttatctatataaaaacttttttggctaattttcatgttatttgcatttttttggcgttttgtctcttaaatcccttccctgcaacacccataaatggctttgcctccatggcattgttaggtcctatgaaggttttcaattgtggcgtcatgcatattccaattataatgcgaaaataatagtggttttatgtaaaatttactaaatttatgcctaaataagtctaattttggttgagccgcaaatgtcggaaaatggcccttaagaaataggccgcaaatgtcggaccgcaattgtcgtttttggctggggccgcaaatgtcggaccgcaattgtcgtttttggctggggccgcaaatgtcgtggctcccctactgatgatgatgcattcttttggtttttgttgttttacgatgcgttttctaagcaattcgttgttgtcattaatgtattgttgcatttttccaacaaaaaaaatgtgtaaaataatgaatttgtgaagccttatagtccttttgtttcctggcaacacatctgaaattttacaaataaaatacctttatattacggctttctattcgcaaaagtttaataaatttcataattcaaaatttcttacaaacattcggagttttttaaagtttaaatttcacataaattcttatactataatttttaagttttaaaaaattccctaggttctcgaaaaattttgaatttttgtaggttaaaagccgcc

SEQ ID NO: 24865 - DNA, 1074 bp, Heterodera glycines
ggggctataggcatggaattaccacaaattttgacgacattcaagactgctttttgttaaaatatgaacacatatttaaccggaaataatgaaaggtgtgtgcttgatcagactttatcttctctatttgttacactatcgattgcttatagaaaattgcataagatttatacaattaataaaattacaaaaaaaaattgtttatttaattgaccttctccaaaacataatgaaaataaacaagcctatgattttttaaatgctttgcaatcatagaaaaatgtttgataattattgtttacttaataaagtacatagaaattgaaaaactcaccatagaagagttaatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtataatgtgggtattgaagaaaaatcgacaaaaaatttaatgcgctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgcttgatcagaacttatcttctctatttgttacactatcgattgcttatagaaaattgcataagatttatacaattaataaaattacaaaaaaaaattgtttatttaattgaccttctccaaaacataatgaaaataaacaagcctatgattttttaaatgctttgcaatcatagaaaaatgtttgattattattatttacttaataaagtacatagaaattgaaaaactcaccatagaagagataatctgttatagaagaaaattgaga

SEQ ID NO: 24866 - DNA, 1252 bp, Heterodera glycines
ttttctcagaaaaaaatttcaaaaatttgattttttgaagggggacactaccatcggtactattaccgacaatagttttggtctaacgaagcaaaagttttttaagaaatttgttaggaaattcattcaaaaaaatttctaatattttttctgaaaaatttctaaaatttaaaccaaaaaattatttcactggccagattccgtgaccccttcaaatctgagcaattaattaattctttttacaatggcttaattgacaaaaatttattttcgcattttgcagggtcgacgatgttcaagcccgttgtgatgagctcaatttgcaatttgtgcaccgttttggggtgatgccggaccagcatttggtgaagtaagtttggcggattttttaaaatttattattcaatttagaaaagatatttttatttgatcatttatttttaaaattaaggttttgcccgaagaagttcgacatgctgtatgtttaaacaacaaccataaatttgatttttttctcaagcaaattattagaaattgaacaattaataaagtgctcaaaattttttccagtttttttggttgcaaaattttagttttttttaactttttaaggaattaagttgggagcagtgctcttccccccccccccctctctcgccaaaaaaaaaatttcaaaaaatcttattttctaattttttattaaataaatttaaagactggtgggggggggggggggggtgagaatgtcatgcaccgaatttcgtcccaatttttaaacacagccttggaatcgatttgctggttggccttggattgagcatggactatggcaaattggcaatcacccacaagggcaaaatggccaaatggttgaccgaggaggaaattcaaatcgaaatggaggacagctactgaagaaacgaaagaatgaatgaacaaaaagtgatcggaattttgtgatcagagaaacagaaatcaaacaaataaatacatttatttggcaccatttgcgagaataaattggtttttttgttgcgttccaatcccactgcggcgggtgcattttttgaaaatttcaagacaaaatgccaatttttagctgaaattagcaacaaatgtagggtcggggtcgttttcgcgtggggcgagtttttgaactataacttttttctttgtcaaccaaaaccaatgattttggtatcattcgagagccctaaaggttctctattagcctacaaaattggaaaaattc

SEQ ID NO: 24867 - DNA, 1827 bp, Heterodera glycines
ttgctggcatatgaacacagcacgaaaatggttggtgccaatgcaattgaataaaatggcgtgaaaattgaaacggattccatttgtgaaaggtgagatccacttcctttactgtgttttatcgtgtttaatttagaaagtcctttggatctagaattatacttttctaaatttacgccaagatattcaaatcatttttatgctgaagggcataaccgaataaataatcagacagtgaattaggttaaaatcgaattgccaagaaatctttgtggttatttttgttcgatttagtacccagttgcggatgcgtcaatgaaagaattagacgtgttgatgcagccattgttgtcggacacgcaaaaggcagtggaagggatttgaaagcgaatgccacggatctcaaacaacaattctctcatcacttttgtgtgtcattatttacgaaaaagtcagacctcctaaatcctgaagattttaaagtattaaagtaggtattatcatttcatttatgtcggccgcccccccccccccacaatgttcccaaaaagttttttggaaccgcccacaaaaacgcgatttaaaaaattaatagattgttaatttattcaaaaaaaatccagaattttgggactcagaaaatccaagattccccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaatttttgaaaattttgtttttaaatgcgcggtccgcggccgcggcaatttgaatgcgcgatgcgcggtgcgcggccgcggtttttttttttgcgcgatgcgcgatgcgcggccgcggtttttttctgtgcgcgctccagccctggtttgaggcgatgaagcgaaaatatttggtcaatgtttgacgtaagagcatgagagatttggcgaaaggtcgcggattgaaaatcgacaccgattccattgggtgaaataatgtgccaatggttgagagtgcgaaacggacaaagaaatacagtgaaaaaatgtgctgtgtatcagagaaagagacagatagagagagtacagagaaatgatgaaacccagatatcatttccatattacataaattattcaacacttctataattaaatccctttgcatttgagaattgaagaaaaagaattcaaaaagtgatcgaaattatgtcgcaattgtaaaataaatcggacagtcatggacactaattatgtagatggaataaacttttaagaagtcactttaagtgaagaactgaggaaaaaatggaaaaattaaaatttatttaaataaaaaaaaattttaactaataaaatttttatcattgtttctctcttgagtttatcaccagaacttgataggatattgtttgaaatcgttggaagacaaataaaaactcagtttggaatgcatgatgaaactacgtactaaatttagaattaattttaattataagatattttaaaatacccattaaaatataaactaggtccattttgattttaatttagtttcattgaaaaaagcacagattttcaaaattttcgcccctattttaccatttttcgtcctaaaatctgccacttaatgattaggcaatacgaaggcttgttattgatatggtcccaaagaaaccctaataatcaagatttgatcaattatcacatgcactaaatatggggcttggcgtgaaaagc

SEQ ID NO: 24868 - DNA, 961 bp, Heterodera glycines
  misc_feature (35)..(35): n is a, c, g, or t
  misc_feature (44)..(44): n is a, c, g, or t
gatttcggaattttgtttgcataccggtcctcgcngagtccatnttgaatggttttcccccgcagaattattttgggaagaacactccgcacgccttgtcaatgcttgaaccaagacagcacgcaccaaacgagaacgacaacaaatgtggacagtaccaatcgaagatgtcacagcagtacaaccgacatcatggcacaaaaagccgttcattcaattcaggagactcagtctgtcttgaattatggaggagtggtaagacatcatggttggaaggtaaaattgtgagtggtagtggtttgatttggaaaatcgaaattccaatccttggaattaccgtaacgcgtcacgtcaatcaaatgcgttcattttccccttacatttcaagtaagattgtgtccgatcagattcaagccgctccgcaacaacacattcctccaatggcgccaattcaaattgatcagacacctgtccgtgatcaaactcctgtccgtgaccgcacacccgaaccagtcaaatctcctcgtccgcagcgacagcgcaagaagccaattcgctattcgcccggctaattgccacggacggtctttccaaaagagggagatgttggatgtgttgatatttaatattattaagtttcgacacgaatacttttattgattagttatttgttgatgggtcctctcccatcgactcattctttgcatttgtgttattttgcaattcggtgtttatttttcggactttctaatttgactccgtcgttattttattattattttgtgattctaattttattgtttattcatttaataaatttatcttgtttgtctgttagcaaaacacaacactaaactaaaaccaatgcattcaaaatttagattccaatgttgttgtcattttttgaatttggtagtctttgacgcgctcaaatctgaatgtctatctgagatcatatata

SEQ ID NO: 24869 - DNA, 2130 bp, Heterodera glycines
actgccaatacatctcacgcccaattatgtctttcccaccatagtttcgttccgaatcacgttcttcgcgtatatcattacctggagaacgtaagcaaaaatgattaaaataaaattattttattgcaatattcaaatttaaaaaatatatcttaaatcatttaaaattgagcaaattattgtcgatattttcttgcagaatctcatcttttgtaaaaaaaaaatatcaatcaaaattatttttttttaatttattatattaattcgttgtaaattattggctcatcaaaatttttttatagaagctggtgctgtgcacagcactctccgtgcgctagaaagggatgttaacaaaacaactgaagttatacgacggcaccatgaacaacaagtaattgaagctcgaaccggatttaatcatgacgacttctgaaatttcgcaatttattttttatttttttgctcacaagcatacagaagttgcctgatttaaacaaattaatcccctagtcttagtgattttatcccgcaaaatcccaaaaaaatttctgtttttattatggcataaagccgttttgtgcctattatcccactccccttttagcttctcgataagaagacatttcaaggtgagatggaagtaagcggacgaattgaagtggagcctcaagagacttggctgaatttgcggctaaaatcagtgcgtaaatgatttattttagaaagcgaattaattaattaacttaaaatagctgaccccaataatcgaaattattagtctaaattagggttaatccccgacccaatgcgggaaatttcgaatctcattcattgcactccaaagactttcttttttgttttagaaaatttcgttatttttttcgacttttttttttggaaatttcctccttgatgagggtggttgctccccgacatttttttaaattactccagccatccctgaattttatccttctaaaagatatcttttcaaatattgctttatctcaggtgagcacggaggatttgaagaaggagttgggtcgagtgaaggatgatcaacgtgagaaaaaacaattcaaattattcggcaaaattaaaaaagccaaaaaatttccaggccaaaatgcttaccaggacacgctggccgcattggtgtacgacgtgaatgcaacagcggaagtgcttcgccgcggttcattgaagcgcaaaaagcccaaaagtcacgaggtgcggtttttgtcagcgcgatattcgtgcacagatagacatgtacagtaatttgaaagtaatttaaacttggatgtacagtatacccatttagatcaaattaatttaaacaatagtagttatcataactacttacaattaattttttaacaccttttaatatttgtaggttcattttttattgttagtcttgccaaattgcttaaacatttttatccaaacttaaacaggagatcgaatatcgtctgcgcctaacacctgcacccgacgaagccgatttgtaccaacaggacgaaatgccaccacttggtagctatttaaatttaatttttaataattttaattcggttgcaatggctatgcaatttattcctttttttaatttaatttattcattcacctgaatattcttgatacaaaaatatttttaaatatttttttttgcctacatttttatataggtatgaagaaaagatagaattgttacaataattagggaagcagaattgattgattgggcggggcaggcagacacttaagaactttctttctgctgatggtggtattaaatattttttatgtaatcaattacgattagttaaaatgaatcaaagcgcgcgccaacaaaggcagtcgcacaaaattggcgcattaatcaatcatttttggctcatttgtcagagagaaggcagcaaaaaaaagtgggggtgggtttttgggggtttccccccccccccctttgggaaattttaaaattcatatttacattttcaaaaatcatggatattttgttaatctatgaacagatgtcatcatatgtcaaaacaaacaccatattcgtgatcagtgaccttgaacaccccaaaatatgaatttttaaatttttcgcggggggggggg

SEQ ID NO: 24870 - DNA, 1100 bp, Heterodera glycines
tcagccggggcagcgccaatttggcggactcgcaacgaacggaccaatttgttcacgaacacttgtcgcttgcgtagagttacaaactgaagtttgtacggcacgggaaattgggatagaatgtggggcaaaatgccaaagaatggtccagaatgtgccaaatttgacttgttttcgctgtacttttgtgctcgggtccctgtcccagtaaatgtcgtggaattgcaaattgctctccgaaaggcgtgggaaaaggtggcaagtgaaggagaagtggtcaaattcgtcctgccgcaatgccatcgccgccggcactgtcccctccgtgccgttgaccccttccgcctcctctttctgttcggcttccgctgcgactgtccttttaataaacttttgcctttttctctctcctccctctttttgccgtttgttccccccatttacatttttgaatttggccctttttggccttccgttggccctccgttttgcccgcgggtgttcttctctgcttttgttgttgtcgtctcttgcttctttttcctctgcggttccttttgctgttcttttcctcctctctctctcatttcctctcgtttctctcccattttccctgtttcctctctcttttgctgctctttttcctctcccttttcctctcgtttctctcccatttgctcctttccctccccttcctctctctcgccgtttcctctcaccttctctacatatttcgtcgcctcttctttctctgccgctctctccttttccccttctcttttgctgatcctttgcctttgtttagtttttctgctacttattgatgaattctttgattcggcaatagcagaagagcgttcatcattggaagaatcgccgtcgtaattatcgtacatcgaaaacaaaaaatgattttttggggtgggaatataaaacggatgtaaaatgagcgaatgaatggtcagtcggtgccaatgccaatggattcggccgttcccatggcaatttgcttacgaacggatcgccattcataaaccagtcccaattttgaacaattgttaattacaatgtgtacattttacatttgggtacttccttat

SEQ ID NO: 24871 - DNA, 1014 bp, Heterodera glycines
  misc_feature (106)..(106): n is a, c, g, or t
tttttaattaatttgttttgtattattaataataaataaaaattttaattaaataaaattattttggtgaacaaatgttttaatttaaattatttaattttttatntaattaaatatttgttttattaattattttaaattattttctgatgaataaatgttttatttaatttgaattttcgagaaattaattcctttcaatttcaataaatattctatattataaatttctaactttatttttaataagtaaaaggatttttttaatttgataaatttataatacatccattaatataatttttttatttatttcattttaaaccatgattgtacctcttctaatcacttttgtacctcttctaatcactgttgtacctcttttaaaaaattaatttcattttaaataaaataaatattattaattttcaacgttgttttttattaataatttaaaattaaaatgcattcgatttttaatatttaataaaaaaaattacttatttattacattttaaatcatgttgacctctttcacgttgttgtacctcttctaatcactgttgtacctcttctaatcactgttgtacctcttctaatcactgttgtacctcttctaatcactgttgtacctcttctaatcacttttgaccgcttctatttactgttgtacctcttttaatcactgttgaacctcttctaatcgctgttgtacctctctaatcactgttgtacctcttctcatcactgttgtacctcttctaatcactcttctaatcgctgttgtacctcaaaatttaaaaaacgggcgcgaagcgcccgtatgagttcaacgaatttaaaaaacgggcgcgcagcgcccgttcaaggccaacaaaaattgaaaaaccgggcgaagcgcccgactgaggccgcgaagcggcctaacaagctaaaaaacaggcgcgaagcgcccgtatgagttcaacggatttaaaaaacgggcgcgaagcgcccgttcaaggccaacaaaaa

SEQ ID NO: 24872 - DNA, 1178 bp, Heterodera glycines
ttttatgagggatatatcgatgagggtgggtgcggggggggctctccccgagcccaccttttccaagggatttaagaaatgggcaaaagggggatgggagagaaggacgggtggggatggcatgccgtatggtgagtaacgagtaatctttggcaaaggggtttttggcattttggcaaagattactaattggagaccactcccccccccccttttttgtgtaagaattgccatcttctcatcggtgactcatccccgcccgatcattcacagctgatccttccttagcttacaacttccccccacccctcccctccctcaaaactcacatcgctcatccttttccccaatagggccacacttctgcgaacttcatgctttgcctgttgctcaacattgtccagtgcgacgaatttgtccttcattttgtccaaatttcggaaagaattcattttggcatcgacggattcgtgccgttcccgaactttttcggtatgtttctccaatttcgccatgttcaaagcgcccaatggctcatcaaattcctacaaatggcacagtgaattgggcgtttggttcggtttgtgccgttcttacgacgagtgcctccgtttcgtcgcaccagaattccaactcctccatctgtccgcttatcctcgtctgatccgctaatcgttcttccatcgctcgtttcttcgctttcaccattttcgcgcactcattaaagtcgttcacaaataattgaatgcgctgctggtaacggtctcttgccgacgttgagagttgggaagagattgcattcagtcggttttggatttgctgaagacggaatgccacgggagggacgcggttttccagtgccatttgcacggcttccaactcgtccaagtcgggcgattcattccgagcgggagactttgtttgctggaaattgaatacaattgttgtcgtttgctctttgctcacttccttctccggcagtttgtcctttttcggcatttgtcgctccgttcggcactgttgcgacagttcgtccaacatctcttcgcattgcgagtacagttcctccaaagtgtgtaccgtctccctgcgcctgcccaactcggcctttcgttgtgcgaattgtcctcggagtccactgattcggcccagcaaatgctccgcttctccacttccat

SEQ ID NO: 24873 - DNA, 1824 bp, Heterodera glycines
cgcataaaaaacatggtcaacataaatttgctcctcaccccacagcatgtttcagagcgaggacgaactgaagagcacccttgtaggaggacaatgtgaagtacgagcggttgttggcccgattccatgagttgagggaagcggctgcgcatcagctcgaccagttagtggtggttcattttggttttatttgcctttcctttccccctttagggccaatttggaaatacaaaggatgaccaaacagcacgaggacaacactttgggactgcggtgtcgcctgaagatgaacgatgcccagttgcagacgctgggcaaaaccattcagggcaaggtatcaaccaaagtgatggccaaaaatgccaatatttgcaaaactctgggacctcgggagagggatgcaatttttaacgctaagtctgacacaaacccttttaaatatttcaattaatttaggacgatgaaatcaaagagttaaaagcgatgtgcgaggaattgatgcagaaaaaagggataatggacgatgatgaagacgaggaagaggaggacgacgacggggaaatggacggcgaatagaacaaattttaatgaatgaccgacaaaatacccccatgattgtatgccctacatttttctacattaccctgtacaattcacttattatgggattgattttattatggctgcctattgatgataagcctaaataaattctagacaatttcttttgtgcgttactcttgggaccattaagttgttttattttttttgtaaaatccctcataaaataacacacatggcaataatttatgtcaacaattggatacatactcaaaataaattacgcggttcatcttgaaaattgaacggatcatatgaaaaaaacaatttgatcgatgttaccgcgcaacatttataccacaaacactatgcatttggaataaattaggaatggacggcactctttccgtcgctcgggcaaatcattgaccagtatcgtcattaaattctgtttcaatcgaaatttgggagaagagagttccgccgaatatataataacaacaacaaccaaaagggcttttccccgacaattcccctcacgaatctctcccccccttttttgggggttggttttgtcgatcacatcacccgttgcgtcccttctcattgtcagactacccttcgcacttcgaaaaagcgtttcagatagtagatttggccaatcgtcatgcaaattagcagaatcgcctcgaacacagcccatacgaccacgcgactgttcgtattctcattgactgaaatggaaatgaacgttttgattgggtttgagtttgcgtcgtttaatttctcggggatcaataattgatcaaatgcaacccaaataaaaaggacaagcgtttttattggaatgcaccaaacttcaatagtggatgggatttgatagggtactccatcctctccccctttttaaaagttccgttccgtccctaccctccactagcccttctattttttattttttttttgtttgccgttccgtcctccacttacttgaacggtgcactctgtcccgcacttgcatgtactcctgctcgtgtttgaccgcggtgagcattgccgacaactctctgatcatttcctccaatttgtgactgtccgctgcaaaattagtgaaggtattttagccaaagacaattaaaaaggaatttggttacatcattttttctaatatgaatcatagtcagcgttggatttatatgatagttttagaaaatatgaaacgaagttttttatacagggatttgcgagatgcacacaaaaact

SEQ ID NO: 24874 - DNA, 1340 bp, Heterodera glycines
  misc_feature (68)..(68): n is a, c, g, or t
  misc_feature (77)..(77): n is a, c, g, or t
tccctgctatatcgatgatgaaaaattgtaattgctaggaaactgaggcggactctctgatcggggtnttccggatntggtaattctcaccgatcgatgcacgttcaaatgcacgaaagcttgcctttgatttgaatgttgcttgcttatttgttagctcggattcgtatgtacttgaatggcaagtacgtacttgaaattgactctcatgcgagaaaatttagaaaaactctcgagatttttcgtcactaaaaatcgcaacctttcttattaccctagtgaatttttaattatttttttctaagcggggggatgagtgaacccttaactacttaatggatttccaaattctctagataatcgtttcaatcgaaaattcatttctcaaatacaattaatcaatttaattattcatttccgtacacttaatcagcagacgacatttccgttgcttttatccgcttcttcttcttctttttcttcttccgttggtggcgacaatggcctaaaattaattaaatattttatttttcgataaaattcaaatgctattgctgctgctcactcaatggatttatcgaaactccacagatcaaatctgatactgttcaaattggcactcggatttaagctgtctccccatttaattgctggcaccctcgccgtctccccaattgggcaccgttgcaacagccaattatacacatttacgtcgaattcgtcgatctcctgtttcagtgtcagcttttcattcgtccgtttgttcaccaattcaaatggttcagttggaattgtgttcacatgaaaataaagttgaatattgtaactgacagaagtggtggcactgataaatgtctaaacaaatttggaaaaacaaaaacaatttatagaaaatatggctagacacacctctttgaagttgttgacccattcgagattctgtggaccaaaataattattgcgatacaatcgcttcggttggccatttttgctcggagtgtgaagccatttgaccaaagcttggccagcagttgcatttggtccatcgtcagcaattccatcggggaacagttcattggaatcaattgaattcaattggtcaagaccagtgagaattgtcggcgagatcagacgacgcaaattgtcaaaggcatcgccactggtaaagcccaactggcgaatgcttttcgcaaaaaactcaaatttggtgcccattctgtcccaaattggcttgtttgaacggataaatgtgagcacagaatggtcaatgtagctgaaaagggggaacaatgatgaagatgaccaacatgcagtctagtcagcccaatcgattgctatcg

SEQ ID NO: 24875 - DNA, 1948 bp, Heterodera glycines
ttgacctatcgccaagttttccagaaaatagtcaatttctgtaggtaaataatttcatgcatttaaatacgtgccctattttttatgaaatttgaatttttgtctgttctttgaaaaaattggcatttgttttacgatacaacaggttatttttagtaatttcaatttttctttaccgaaacaaacaaatcgaaattatggtaatttaaattaagagattttaaatgatttagctactgtgtcacagtgaattgtcatgacgaacgtgctactgtagcgaagactttagaatacaacattacaaaagactcaaaagatgggttgtggacgaccttttcagaaggaggaaaatcatttgaaagggttctatttgactttaatgaagaaaagtgcaaggactattcaatttttatcaaaacaaaaaaactggaaattgagaacaaaaaactgctggaaaacgaacattattcacttcttggcatcttagcaaaggtaaattaaaattctaaaattagatgtaataaaaaaatgtatttgaaaataaatgaataagtaattgtaaaaaggtaagcattttataatatttattcattttttatttaaaaatatttgacataaggaatataatattgggaaaaagaattttataaaaattcatttttagaggggcggcatattttaaaaaagctaattagtgagagattttcttgatcattttcaggattatgttcacgtgaataaaaaagccgagtcaaacgggaggacagaattcaacataacttgcaaatatttttttgtcaattttacgccggtgctcacgcgaaaggaggaattttatgagattaaagtgtactgtaatgataaacagcaacaaaatttggtttatcatagtgatatccaatgtggcaaagacggatgccaacgaattattttggcggatgaacaaaaatgccaaacaaatgtctatgacgttcaagtgtggcgctggagcgagcgatggacgaggtaatcgggtcagagttcgggttcaaaatgacggtttttcagggactctattttagatgggcaggacagacaggaatttaggagggtgaaggggctgcatttaggaaaaaagacacctaggtatataaaaagaaaaattttaaacaaaaatgagtaaaatacaaaaaatatatatatatttaattttaaattttagagagaaacttgtcttactgagccaagaagcacatatttttcagacattcatataaatgacggtggaatgctagaaattcaggaaaatagtgacggttttcaaacattggtgaagaaaaactaagacagaagtagatattatatacattctttctatttgtcatggtgtagtattattatctttttcacaattgttgctattttttttttgaaaaaatttccatttttggttttaaggagatttaattgaatttaaaattatacaaagttaaaataatattgtgatggaaaaggtcgaaatttggttaattatttctatcaatatttattttaaaaaaaattttaattttgaatttgaatttttgtggctaattttcggatacttagtgctctaaaatgaaataaagtatatttaatttggttattcctaacaaaaattataatcaaattccgctagcattaattaaatccattagcaggtgggcaaaatgaagcataaatcataaaatattgccattaggcagaccaaaatttttataatcttaatagtcaaacgggtttttgtcaaaacaaagagatagaaaaaatgtctttgtatacaaatttcacgcttcaaaaactcataattacaatatttacaaattattgcgggacgggaccctgcaggattaatcccgcaatttccaataattgcgcgttcgatgttggatcctgcaaaatctcgagcgggataccgtctcaaccttat

SEQ ID NO: 24876 - DNA, 2171 bp, Heterodera glycines
gagtatatttttaatgatattttaaaaattttttgattttcaaaatgagtcccaatttcccatttattcagtcgttgttctgaagtggcaatggcggacggtctccgaccgataacggaagagtttcgcaaagaatgccaaatcgcatgggaccatttcggctcggaaggccggcgcgtgttcgcatttgcgaagaaactcttccaagcccctcagaacaccaaattcacggcacaatcggacaattatccccaggacggactcacttttttgggaatggccgccattacggacccaccgaggcaaatcaccactaaccaaacaccaaaagaccaattaacttttactaattaacggtgggaattattaacagaaatgaaacagcagcggccattcagcagtgtaaagacgcgggtaaaaagagaagaaaaaagcaatggaatgataagctaagcgaaaattcaggcattaaagtgttcatgatcacgggtaaccattcgatgagagaaatggcattttaaaatcgaaaaaccaaaaaggcgatcacccgacggcggccagtgctgtggcttcccaaattggacttttcggtctacaaaatgatatggtaatggatattaaaaagcaattaaaaacgattagtccgccaattattccatttccaatcgaaggtaaagtcgcgcggaaatcaacaggtgaagctgagtctcgacctcagcacaaaagtcgattgggccattgtgcttggcgagtcgttggcacaaatgagccccgctgagtgggaccgactgttggcacatcgatacatcgtattcgccaggttctgctggaaattggcgaatgtccgcccaataaaaattttttttaagaacgacgccggaacagaaattacttattgtggaggaatgccaaaaaagaggtgaagcaaaaaaagtagaagaaggctgatgagtgaaacccaaatgatcgcaaaaatttattaattaactaattaggggagaccgtagcagtgactggcggcggagtgaacgacgccccggcgttggccaaggcaaacatcggaattgcgatgggcgttaatgggagtgacatcgcccgaagggctgcggatatgtgagaggagaggggggggggagtggcacggcaccacccaattaacgcataaataaacattttaaactttctaaaatttatgatttgcaattattgtctcatttgactaaatcacttcctcttgagtgtgctgactgatgacaatttcgcctccattgtgaagggcattgaagagggtcgtcttttgttcgacaatttgcgtattttgccccccgcggcgtttgtcccaccaactcattcgccatttagggctgtccattgcgtacactttggcccatctttggcccgaagtgtgtcccatcattctcaactttaccctcggaatgcccttgggattggagccactgcaggtgaatcatcagccgatgaaaagaactgacggagcaaaagcatcaatctaaacagattctcagcatcgatttggccagcgaattgccccccgccgtctctttggcctacgaaagccccgaaaggtcggcaaaagcgaccaaatgcaacgcaatgcctttgaggccctttcagagacataatgaaaattccgccgcggaatcgaaatgccgaattggtgtccagccgactgctgctctattcctatttgttctccggcacttttatcactttgggatgcattggcgcttatttgagtgtttattggtctgattattcttcttttcatgcgggttttgcagacagctctttttttctgctaagggacaatgggattacgttgatgtgctaactgtgtgtaccataacccctaatttaattcttagtatgttttaattatttctgaatttaatttaattcatacattttaagtcactccttttacattgatctgagtttacttgaaaactctctagttttgcaattgttggaaaaaaaattttgaaatttgcaaatatttataattcaccaaacttgccatgtcgtccaaattcatgagcaatttgatttatttaattttgcttttttttaaatttaaatccaaagtaaagtcaacaaaatcaatggtcgaggatcacaacaaaagcgtcgaacaatgcaaatggtaatca

SEQ ID NO: 24877 - DNA, 1443 bp, Heterodera glycines
ttcaaaaattacatgtgcgcgattcgggaggcagcaaaatggtaaacaaatgttggtccacagagacattctccgtcggaagttcgacctttcggacggaaaagccgagattcggggcaaacgcaccgacaaaatttggaaaaatcttttgagaaattgcatttcgaacattggaccttttgaaatatattgatcatcttaaaaatcatagaaatgaccgacctcgagttgaatgagttcaaggagtgtttgttgttttgctccctattcccttcctcgtcaacttcagccccgtcattccctgctgattctctctcgccatttttttgctcggatgtgtccgcaatttcagaggaaggcggcggcacatttaatggttcagtgacgggaaacaaaggatgcttaaataagaaaacgaataattaaaaaaataaataataatgggtgaaaaaaacctcatcagccgcatatggttgaacttgctggatataatcatgaagttcagttactgaaacaaaaagcaaacaataaatgggaaatcggagggacatcgaatttactattaattccattggctccgaaaacataagaaacatcttccaagccaacttctgcacgaccagctgaatttgtaaaataaataaatgaaggggagaaaatgaaaatcacaattaatggccgagttaagcgagtcgcgacacaattgctcaaaataagttctaagcagaaaagacaaggaactgactgcggagctgttagaagtagaaaactaaaagacaaaacaagaaaaatgtaaatttggaaatgaatgtatttgttactccgatattttcaacgatggccatagtcgcatgtcgaaatttgtagagttcgtacttgttgaatttgttgcttgagattggtagtttcatattactttctgcttgtgcatttttaagcattccttaaaagttaattaatatacataaaaatttcagaaacagtgaaaaaaggcaatgacaaaagtaatgaaatagtgtcgccgatttcttaaaggaaaagcttagcttacaaagttagcatatcaattaaattatactttttgctaaaattcaactaacagccattgatcagaaatcacttcacgtttcaaagaacaaacaacacaagcttgcacagcattcgccctcctctcccttcccattcccttcattttcattcgcattttgccacaattctctctcttctgtctttctctctttttgcttttctctcccgctcactgactttcccaaaacaaacaacaaacggtcgaaacaacaacaaataaaagtaaaagtaggggaaaccatacggacagaaaatctatgcacagccgagcatcttttttacggtgtattgtaaaaacagcgaaattattcatttttcgccttatttacatttagtaatgccataatttttttg

SEQ ID NO: 24878 - DNA, 715 bp, Heterodera glycines
gaaatcggaaatttttcaaaaaatatacaatataataaaaaaattctaaatattttaataggctaaattttttaattcttaaccaagtaaaaggtatttcacaaatgtttttagtatattcgcttgaaaaaattattcaattattttatcaaaatctttttttgtcatttttcattattttagaacatttttgggaaaaggagtgactatttacacgttttttacagcgcgattttttcaaaaactttttgggaacttggaggagagtacggcggtgccgataggcgccgccgggaaatttttaaaaatttcagttcaatttattattagaaattgtacaaaacttactagttttaaaaaaaaaattaaaaaatttacgacttttcatcaaaaatttcggaagtcggaattccgaccccaaaaatgtcggaaatcggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgctgataggcgccgccgggaaaatttcacaaattttgaatgaaatttgcgatgaaaaatgagttaactttaattaaatttattatttaatttttttaaaaatatttggcattctgtcttag

SEQ ID NO: 24879 - DNA, 1296 bp, Heterodera glycines
cgccaataacctcagatttactattttcgcgaccccactttttgaattctgacattttcagctcattacgctctaaatataaacagcatcagtgttccggaaggatcgatttgaaatcgccaataacccccaaattacaatttcctaccgtaaacttatacagattacatttggatataagaaattgaaatattgagaatatcacaaaagtgatcatgaaaattgtaaatttgagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaattaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaatattgagaatatcacaaagtgatcatg

SEQ ID NO: 24880 - DNA, 1689 bp, Heterodera glycines
tgatacatttttctgtcgacagttaagaacaactcaaatataaaacccgataaatctcatcacttcagcagatttacacgattaaactcaaaatcactaaaaactgaatgaatttgagtcaatttgtagtctcatttagccgttcactctcatcaggtctcgtcattcagaaggacagtggtagagtaacacaggtcccagtagtgtggcactccgtacttttcgagcagttcacgggcctgcttatgattggtcacaggagtgaagcgtggctcaccagtgaatgctcgcttttgcacgacgccctcccaaatctgagaattgaaaatttgaaattggtaagacaacaaacattggttgggatgcttaccaaaacgcactcgttcctcttctcttccgctggtccatcctccgtcccttctcccatttcattcgctctgttatgcgtcgcccttcggtcgtgcttttgaccggcaatttcagcagaccatcgaattctgttgagcatcaagtttttgaagaacttttgctgcttgggaccttaattacataaagtgaataaaatttgcgtgccgaaatttaggtttttggttttgctcctacacctcaaaattttaaaaaaagtcaataagggcacgcgggaagccattaaatgtacgacactgttttgaaggcattgaacaaaaaaaaaattcggcatattatggcattttcacgtatgaatattttggttaatcagttggccaatttatgctattggaatggttcaaaaattgtgcgttccgtgcaccttttgttgattttttaaaatctttaagtgtagaagcaaaacggaattttaaactgacctccctccatcacaacaacatttatgtcttccaacacaatgacaacaccggtcatttgcaactgtttggcgttcatcatcactttgaatttcttcgcagggtttgccaacgatttgatcctgcagagagaatgaatgaatgcattggcattgtcccgttttgctttgctaatgatgccccttttctctaatgtcccctccccttttttccccacttaaaaacggtgacgtgcactgccaaagttgtgtcctccccaatcttccggatggccttggcggccttctcttccctggtcagttttctgcttctgttgtcctccacgtgcttttgcgcccgttcagccatttgctttcgtacctaaaaaatttcaaaactaatcgttttttctgtgaatttgtccactgactttcgcttccattttggttgggtcttgaattgcatcggtgcctaacacgcgcatcaaattgctgattttcaattttggatccggcggtttttccaatccaagccgaattttctccgctctttctttcaatgcctcgcgacggttttggcgtcgcaattttttcctctcctttttggttagagaagcctaaaatcaataaatttgcagagttggccatcaatggctcccttgccttaatgtattgcggttgcaatggttcgtccggtggtttcagttggatgggatgctccaccaaatcggtgacagaatccgcgtaacgttcaaccggggccaactcctgccagggcacttcgttgtagctgtaattggtttagcattggctttggctttaccctcctttcgcccactctttgcagttgttcccgagcaccactt

SEQ ID NO: 24881 - DNA, 974 bp, Heterodera glycines
tttttctttacgtaatgacaaataagctaactgatacatttttacgaaaaatccttttaatattttttaaaaaatgaagccttcttgaaagcattcatttagaaacaaaataaaaaatattggaattgatattttaaaagaaaatgattgcttgtgaatatttttcctcttttgttgagagaatttaaataaaaattttgtcggactacaaaatcaattagccgaaaaatattatgaaaatggtcaaatgaacaaaacaaaaatgaaaatatattagctaaaaaatcgaattgccaaaaatgatgtttaaaaaacagaggatcttcacgtaatttaaaaattattgacctaaaaatcgaaattaacaaaattagagtgcgccgggaccgggaccgggccgggaattcccggtcctcagaggtcccggtcccggtcccagattttgaaaagctcaggttccggtcccggtagggcaaccgggaaccgggaaaaacaagcactggtaagaatggtggtcttggtgaaaaattagagatgaaaattagagtaaaagggaaaaatttaaaaatatattaatatattctttaaaagtgacatggacaattgcgcaaatggcctagtggctagtctccctgactttcccttcttctttcccctggttcaatccctctacagaaagtaaaatatttagaattttttttttgtaggctcatggctttcctatcgacaaaatatgattcctcatagttttattttaattgacacatttttatcatttttttaaatgaaaatccgtacaaattgagcctaataatcccaaaaagaagccatttttcttgaaaatctgttaacaaattgcactcaaattcaggggcttttcagaattacataaaaaatgacgatggagcgacaaacgaaaaatttgttgtttttctctgaattgtcgttatgacaagaaaatattataatatttt

SEQ ID NO: 24882 - DNA, 2031 bp, Heterodera glycines
ctggactcctccattctacgtcctgttcaaactgcaccacagtcggttggccaaccgggtaattggtgtacatattccttaaaaagccaaaatttttcaattattaattttttccggcatttcttaccgcgaaggataaagactgttaaagtccttcactttgattgtgcggcttttccagtcgcccgtctctgggttgatcactgaagcgcccaagtattcggtcccagttcgacctgtgccggaaaattagttaaaaattaaatggaaaaggtaccgccaaagaatgcatcatggaagtcaattgggccagaatccgggcagttgtcgaagtacgccttcatggctgggttgtcctccagcattgcgttcaagtggcactcccaaatcacttccacttcgaattcccgcgcaatgtcccgggttcgttttgcgtcccgggccctgagggctccggccgtttctcctccgcccacaattgccgcatcgtcggggaagcagctcgggcatccatgccaatagcaccttttcaatgggtaaattggcacatttttggaatttttccttacccattgacctcaatggccaagtttttgtcctcatctggacgctccatcatcccatctaagctgtagttgccgaatttgaactcccctccagggctttcgacatggcgcaggactcggccattctcccgcaattcttcttcggcacgccactgagagtcgacaaaatgtaaaattaaaataatttggatacactttcaaatatttccgggcgatggagctctgtttgcctcgcttctcgtatcccaagtgtgggatgatggcaacccgttctttgtcgtggtgagccaactgcacccaatacttcatacagccggacgggatggtgaccgaatccgtgatgtcatgccgagtctcggacaagaacagctgccgcatctttaccataccatgggccaggatttggacatcttcaattttttttgttatttttgcatgtttttttttcaaaaattgtacctgtcttgcagtagtccgcgatgacttcacagagctcaaaaccagtttcccggttctcgtcgtaccactgctcaaactttgcgcgctctgccgggaagaggccacctgggtaatagttctcaattggtggcagggtgtccagcacagtgccataattttccgcctaagattgtattaatttttatttatttttttttttataaattcctcttaccttattgaatttgtgtggaaaatatttcttgttttccacgccctcaatttctagaccaaacgtcttgacaaaattggcaagttttattgggatcaacttgtaactaaagtgatcaaaaattttaaaaatatttaatattcaaaatatttacctgtcccggaaaacggtggttgtgtagactcctgttttgcgggccttcatttccaggagatggttccctggcggatgagatcaggcgggacagtcatgtgcaacatttcaatataaatcagcacatgatagtagtgggaacttttaaattttatatatttcaagttttttaaaataattcctaaaaaactggcgtgggtgtttgtgtatgttgtcacaggataggaattttctcgggattattgtaagatagaagacaatcgcgctcgtaatccattagaattatgttttcatgatttttgaaaacaaaaaatatttttttcaaaaagggggtaccaactaaagtattacacatgaaaatagttaaatttgagaaatattacttattaaatttttatgtctcaaagaaaattgcaaatgatctttattgccttcaccaaacgaacactgtcaaatgggctcacaataaaacaaaaaggaggaatttatgttggaaaatatttcacaagcccaatacaaaacggagaattcggaaatatacaaaaataacggaattttaggctaattaaagggatggaaatggcgcttgatttctttgaaatatatcaaaaagaaaaccagcgctttcccagaaaagtaaat

SEQ ID NO: 24883 - DNA, 1718 bp, Heterodera glycines
  misc_feature (1581)..(1581): n is a, c, g, or t
  misc_feature (1609)..(1609): n is a, c, g, or t
  misc_feature (1614)..(1614): n is a, c, g, or t
ttgctgttttcgccttcttccacgtgcgccgtcctgcatggcatctgccattagtccggcctccactaagtcaagagctacctttgctttgcgcttcagttcatgctgatggtcattggtgcgtcgtttagtggtgtgcgtgtcagaagagggtatgtcgccatagggtatgttgaacacacgagacttatttttcagacggaaaaaacaatgtcccggtaaatcatacacaacatcgaacgggatgaattgggccttctctatgcgggtgcaccaaagcgtgatgccttctttcgtgatcacagtgtcaatttcggactccgttcccttacaacacctacaacggcccgcttcatcaaaaggaatgaagcggggtgtcgagaggcggggaccgctgatggttataccactcgaggtcacggtgaggtccgtttggccgaggatttggttgcacaacgattttttgtcggagatgttgatcgccataggaattgtgaatttgaaaagggacgccaaatgaaaaatgccacccggtgagcccgtatttatacgcaaaaaagtcgggccaggtgccacgcccattttataataataattttggcgagatgggcgctcataaatgaaccccgtgtgaccgatcaggggaagtaacaattatttcctttccaaatatttcttctcaaattttatttttttttaaatcacatccatcaccaatgagttcaatcatccccccttcgtcctgtcaccaaaatatctgatcactcatcatccatttcatggcttggttcccttccatttgatcagtcctttgtccagtttgtacaacagcatcttcacatgtttacatggcattccgtgcgcctctgcatagtcgcgcaagtcgatcagcatctctttagcgcggtccggtccgtacaattccatcatctgaaatggattaaaattgagggaaaaaatggaattttcaacaattatttacatcataatcaccgctctcaaagcactcgaggtgtagaacacgttcatcgggcatttcgcagtcgacgtcgtccggtgctgtaggtgaaagattgttaatgttaagggaggaattgagtgttttttaccattttttgattccgatgtagacatttttaaaatttggaataaataaaagttagtttatggataaatgctaaacaaaattttatttttaaatttattggaataatgcaatatggtaaaatgtaaacagtaaatgtgaaaaattttaagaaacgaaaagagcagggtgggaggcgaatgagttaatttaaaatatattttatttttgcataaaaacaatatttgaaaggaattatgaatttggtttatgaacagtaaaccttcgtactgccttttatatccaaaaaagctaattaattacaattcttgacccatttcattgtcttgttttgtcggtaaatttgaaattttgctttacttaataccgacaaaattttgatgtatctgctaaattaaaaattccctaattatctatgcaccgatcggacgacgaattcagatttagatcagcccaaaccacacaattgaaattanatatgcacaaattcggactcagaatttnaattntgacaaatccaagccgcgaaattgacctaattcgaatgatttaatattcatacgaattaaatatgcaataattggacaacgaattcaaattttggtcctaacat

SEQ ID NO: 24884 - DNA, 1343 bp, Heterodera glycines
  misc_feature (9)..(9): n is a, c, g, or t
ccgcccacngggaatgccttgaaatgaggcgctctcgcccatagtgtccgtaatatttgcagagcagggtccttagattcaagtcgttttgtcctccgcccgtgccacgacggtgcctgtaaaatacaatttaaaaaataattattgtgttagtcacttttgttcatctgcgttctctctttttgctattttctttaagttgtgccatttttccttgcactgtttttccgaaatgctgctcccgaattcggcattaatttctgaagttaaattggcccaagcattttgcgaacggcgcgaaaacgctgcctccttgctttgcggaaacaattcttcgtaattgtcgcgaactttttgcgctaaagcgcttgacatttccttggtaaaatttgacattctaaatttatttgtgatcttagatttaattataaaatattattattttatgagttgatcattcgtctttaactcacaaataaataatatattggcggtgcaaaaatacatgtaacattttgggtaaacataaaaattgatcaataggaatgatgtgttatgcgatagacctaaaaaacaaaagttatttttccataaaaaatgtgtaaacaaattgtcccaaaagtgcacgtggtcaaataacccggtagaataagatcatagttcatggtcgtttgacggaggttggtggtaaaaacggcacttcgtggtcattttcttattctacgggtttaccaccaacttcatggtcatttgaccaggtcatttaaccatggtcgtttgacccggtcatttaaccaccttcttattctacgggccctgttcttcgctctcctcggaatctaaaaattcagtttaattaatggacacaaattgaaattgtgccattcccccgccccgcactcaaactcaccactcgaagagaaagagtagctgctgtccaaaaggagagagaaataaatgcaaaattttcagcacctcataactttaaacgggtcggggggctcggtttagtacggctcgttttagtacaagcgccagttcttggctataacttttttctttgccaacaatatccaacatatttagtatcgatccatattcctaactgacctctattaagctgctatattgccaacatctctgacaatgttcagagaagttatgactcgaaaaaatgctcacaacgtattctagaaattgtttatgacctttctttgacattgctctgaaattggtaacactttctcatatagagtagcataacgaccgcgttctgcagatgaagctcgcaataccataagtcgtttttgctcacgaatatcaaaccagtccacaagtacaat

SEQ ID NO: 24885 - DNA, 1253 bp, Heterodera glycines
  misc_feature (1235)..(1235): n is a, c, g, or t
tggttgcgttgaaggctttgggcgtgggcccggccgagctttccaccagtgcagatctggtggttagttagcaaattttcaaagtgagatccttgaagactaaagtggaaaagggttccacgtgaaccaccagttgaatgtgggtaagccgatcctaaggcaccggctaacgccgtaacacactacgaatgacgacttttctgtgcttgcgccagttggtccctccggttgccgaaagggaaagtgggttaactttcccacgccaggctagggaaaatgacggttcgcaagagctgttttgcgcggtaacgcaaatgaactcgcagacgtcgtgtggagtccgagcccagagttctctttttctggtttagggtgtgcgtgcctggaagtggctcagcctgagatagggatgttgcgcccgtaaagcaccgcggtttcctgtggtgtctcgtgcgctccacacggccctttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaangggtgtccattttggtgt

SEQ ID NO: 24886 - DNA, 2510 bp, Heterodera glycines
  misc_feature (71)..(71): n is a, c, g, or t
  misc_feature (2507)..(2507): n is a, c, g, or t
taaggcttggcatgccgtcactgaaatggtcgagtccgaggcacgttatgtgcaaaagttggcactgctgnaaaaggtgggcggcttggcaataaaaaaaaaatgccgggacagcaaaatgccattttttaaattttgaatttccaaaaagttccgcgatttggtggagagggcgcgcgtgttggacaagcgccagttgggccaaatgttcgccaacatcgcatcactgcaccaattccatgagcagcatctgttgccccagctgatggaccggcacagagaatggcaaagcagcaaaaagtgggccaaaaaatttataattttaaataattaaaataaaaaaagaattaatcactttgatcagaaacccatccaaattttacaggacaataaaaggacaacgatattcttaaaaattggctctcattaatctgtgaattttataataggcccaaagaagacgcagaaaaataaagagtgattttaaattttaaataaataattgatcaccataatttaaaaaaaaaattgatcacccataaaatcgtctaaaattgatctaaaaattcacccaaattttatagggaaaataaaaggatacgataatcctaaaactcattaagaattttaaaagataagtaggccaaaacgtggcagataaaataattaaattttttttttgctatttttggaaataattattttttacaaaattttttttagcaagttttcctttctcatttcttctaagctgatcggaactgaaccatatttaaaaataatcaaagaaaaagtggcatatattttttatatttttaaaataaaatcgaataaaacagaattttttctaattttaatttcaaatggattttcatttaaatttaatttaatcatttatttttatttgcctttccacagaataagcgatgtgtggcgaaagcaggccccgtttctgaagatgtacagcgaatacaccaacaattacaaggcggccattcaaatgtttgaggaaagcatgcgaagaaagcgcaattttgaaggtgaacaaatggaagcggggacaaatgatcaaaggacaaaacggggaacggacaaatgatcaaaaaaggggatggacaaattgtcgaaaaaatggagaaaaatctgatcagatcacattcatattttagaattggtaaagcgagctgaacagtgggaggaatgtgagcacttgtccatggtgtcccatctgatctgcccggtgcagcgagtgatgcgctaccaattgttgctgagggtcagtgatcggagggatatttatttcagaaaagattgattgattaatcagtgacactgatcagtgatggaagcgtgatcacggtgatcagagaaagagaagagagagagagagagaaaaggagagaggggagagagagagagagaaagaaggagagagagggcgagggatttcataaaagagatgaaattgtgatcaactgagttgatcattttcattatcgaatgaattttgattattaaatcaatgatttgttcatgaatagagatatggataagtgagtgatcagttttcaatgctaaggtgatatgataatatataaataatttcaaaaatcaattaatgactgtgaagcaaaaagtgatcagtcaatgatcaagaggtataaactgatcaatgatcgaaaaaattaattagtaataggtacattatttgattactgtacatcattttactcatacgatacccaaggcttgatcaatcactgttatgtgatttgtttcaggaataccaacggcatctgagctcaacagaccccgattgggaggacacagaggtagccaatataaaaattaaaattaaaaaaagaaagcgaatatttaaaaaaacaaaaattgaaaaaaaggtatccaataatttaaaattcaaaatttttcaaaggctgccctttcgcttgtgttagaagcggcttcacatgccaacgaaatgatgcgcaagcttgacaggcaaaaacaaagttaaaattgtaaaatttcagatttgatttgggcaggtatcgaagtgtgttggaggtgcaggaactgttgggcaattgcatttcattggtaaattattacatatttttaattgatcaatttgggttaattaattttcaaaaaatttatttaaatattttattcaattgaccaatttttctttatttatttcaaaaagattaatttattgactattcttaactttttttttgaatatttttataaataatttttacttacctaattaatttaatatatttttttaatatttttaattattttaactttttttcaattatttataattaaacattttttcttcttttttaggttacgcctacacgtgaacttctgacaaaagctcgtctttggaagtgtactggtcagttttggaggacttttttttgtgatttttaaacacaaaaaattaagccataatgtagggccccagtttttagggtcatttttcaaaatgntaa

SEQ ID NO: 24887 - DNA, 935 bp, Heterodera glycines
tgcttcgtttatgtagtttcttcacgcctcacacctcttctccccccaataagagcgaggaggccagactgaactggcgagacgcaaatgacccatttatccctagtaaatgccccacaacctccctaatcgtgcttaatgatgcgaagagattcggagattcaccaacagaaagtgggcggacgaagaaactttggaacaaaacgacgccacttggaggcaaaaatttgcatttttcctcatcattcgagtcactctcaataagtaattgtttatcactgacctcaattttcatttttaataatatgcccactaatatatcggtgtttgatcagcaatgtacataagccaaaacgggggacggggatgaaaaacccgggaatcaacccccccccccctcgtctctatgtcccctccccggacggggaccaaaagtccgggaattactccatccctccggtatccatcccctccaccggctccaactataattgaatttttatttattatatcctgattacgaagccttctttatttattgttcgcgactcgtcagaagcagggcaacagctgcgacaatgtctgatcacccgcgtgaagcagagcgaaatttaaagagaatgtgatcaaagcaatttaatgaaaaaaaaatttatatttttatttatagtgtcacgggacgggaccgaggcaggaattcctggtcattcggggtcccggttccttcccgatcactttaattgaaaaggccaagtcccgtatcacgctaaaattaaataagcaaaattgggtgaaagaaaaaacgaaataaagaatttaaaaccagaaagtcttacaaatcatgttatcttctgaccgggtcaagattaaattcatgtgtttctctaaaaatattggtcatttgaactaaacagatttaatatttgaaaaactta

SEQ ID NO: 24888 - DNA, 2531 bp, Heterodera glycines
  misc_feature (60)..(60): n is a, c, g, or t
ctggccatgaattgatgcacgcgctggcttttaggcatgagcaaagccgaaatgataccntaaattacatcattttacggaaaaatgaatgggtaattaacacaaatattttaaataaatttttcatgtgctcattataaagcaatcgaaaattcattcaaacacgcaaaacttcggcttcgcttacgatttcgggtcggtgatgcattatccagctgggggcaatcatgaacagtaagaaaaatctcggattttaataacctaaaattggaattaaaggggcttatacgacctgatcactttgccacggttttatcaacaaacgattggtcaacgagaacgaatctcttttaaagacgcggccataattaatcgaatttattgcgaaggcaaaaatggtcgaaaatttcgaaaaattttaatttgtttagactcatgcaaaggccatgaggacaagtgtcaaaactggggctatttgaacccaaatgattgcacaaaatgccattgtccggacggatacggtggtcaaaactgtaaagaactcgaagagagtgagcattaattccatcaattaaaacaaattatataaattaattgaagatttgaattgtgaggatttgagtggaattgcaagagaattggtggccaataagtcagcagtgttttcgaagacgaaggccaaatgtggggggaattggccgtgccgatgccattggcgaattaaggcaataaaataatgtttagaaaattataaaattattttgagtgttattaatgcaaattttaattgctttcagcctgaagcggggaaaaaggcgcgaattcagttcaaaagtttgaacaatttgtttgaatgcacatacaactgctcatcggcgtatgtcgaggtcaaataccgagccgacgaaagggcccaaggcaaaaataaataaacaattaactaattagttacaattattaatgattatcaaaatattgctcattaaggtgccaagctttgttgtgccgcatcactcactgatctgaacgcaaatgaatataaaaattggattgcggcggaaaagccggacatggacattgtcatatccgcgtgcctttcaccaaaatggaccgtaccatctaccgtattcgagctgacgtatgaatcaggcaaggaaaattgtgaaataaatttttatatattttcaatatttctataattaatttattttaaattgaaaattgtctttatttcaatggctttcgtaaatcagaaccattacacaattaaaactgttcaaaaatgttaaggcaaagtcaaactcataaattcgaacaaatgcgtaaataccgataatttgtttgccgagaaaaggaaccccggcaccggcggtttgaaatgttatgacgagatcaagcaccaatcttatgactgctcctgtcacggtgatagaaatgcctcgctgaagaaaaatgggcgcacgacgcctttctttgtccaataataaaggtaattaattaatttattattattaattaatgccaaaagacaccgccacagacaaatttcatataatataggcaatttaatttttaagtagagtgaagcgggactgggacctggtagcggacaactgagtaccaaggttccgggtttgacatggacctggggactagtcccggttttcccagccaaaaattaacggtttttcaactcgaaaaggtcccggtccggttttacccaaattcccggttccgcttaactctatttttttgtatcaaaaaaccggaaataataaaaaatagggacgataaactggaataaggataaatatgacaaatgataaaaactctattttattaattaatttgaaaattcaggtcaattcaatttcaaatcaaaggaagccgacacgagtgtttactaacccaaaagattttcgatacaattggactcggattgaggttgattgttatgtgagttggggttttctaatttcaaaatttgtttaattgattaattttacagaaggccgatgcgggcaccgtaagcttttggggctacagtaagccggagacaaaggaaatcattcgggtggacgaagtccactgtttgacttatgaaactgctggagtgccaaaacggttcaaaagtttgcaagtcgaagaacagccgccgatgaaaaaactgaatccaagtccattcttggccatgcttcatcacttatccatgtgttcgtgccatttgttggccatccatgagagaagggggaaatcagtgatcagtggatctgtctgtgagtgatggtgatcagttggccaaattccatcaataaatttttatctttttttttactttttaaaggtgtcaatgtttttaattcctcgtatatgtatttttagcgcattatgcaccagcatgggctatattattttttggctaaaagtacaaaaatatctctcaactaaatagacatgataattacaaattttgtcaattaaaaatttaatttttgtgcctgtggtggtgtctttttgtttatttttttttt

SEQ ID NO: 24889 - DNA, 2324 bp, Heterodera glycines
gggatttgcttttcccgttttccaaccaaaaaaaaattccgccttgttcgtctgctcctcgagtagtttctgtgttttgttcacccttttaggttttccgtcgacagtccgttgaaaattgagggatttgcctcccgttttccaaaaaattcaaccgatacttaattgctctgttttctaagtacttcgaaggtttccacaatagaaaagaataagaatgaaatttttttattaaataacttaatttatattttttaattattaatttctcattgtagtttgaaaaaaaataatagtatttataattttaaaaattactcgagtagttacccccccccccgggaccgtcgccgtttgacgttaattagaagtgacaggtggtgtaattgggggtgactaattggtcaaacctacacctattgagggttttttgtgtaattaatatattattaattaattggggaggggggggggggtgatggatggtagatgtgatgggcgggaccgtcgccgtttgacgcttaatagaagtgacaggtggtgtaattcggggtaactaattggtcaaacccacacctattgggggttttttgtgtaaataattaattgattattaattaattgggggggggtgatggaggagggcatggaagcagatgtgatgaaggggggggggggtgacagatgagaatgggggcagatgttaaaaatgggagtggggggggggcttttcatcatatgcttacagacattccatcaaactgacatttcgcctacacacccccaaattgacaaattgccaaaaaatttatttaaaaaaattacaaaaaatgtttttattttttcttatgaaccccggggtctttaataatttcatctgttccccatttcatattcaaccatgcacaacagcgtccaattcttgtattggcacatccaacacgcctacagatgaagacgcggccaccagacaccggcaaattgggatggggagggcgggacttgtgtaggcatactctaccccttggtagagtattatgttttcggtgagaaatatcacttcctacaaattgtaatttaaaatgtcaccccctccccatgttttaaagcagcagcagatggtccagctcggggcaagcacggagaagcagcagcagcagggtttggaggagcagcaacgggagaggggggtcgggaagcagcagcatgctcgccgtcgtcgtcggctttttgttgtactgcttgaacttgttggcagtttttttgcggtttgctggtgtcggcccccactactcaccgtcaacatcatcagtgcttaactctgcccaaaaaatgattatataaaagttgaaagggattgccgacgagaaaggaaaatttttcaaacatacaaaactgtttggatttaattacccaaagttgggagcttttttctatatgcttaatgaatgtcgtggcgcaaatggcgattcgtatattataaaattattaaacaatgtaatttgaaattttaattaaaaatatattcattaatttaaaacataaaatgggatcaaagagaattaaaaggatttaaactaaaaactaactatctgttataataacatttacgatgaagcaataaagaagaacattttttgctagtacgcaataataaagcatatgagagaaaaataaaaactaactcataattaatcaaaattttatttgaaaaacttgctaattaactagtaaaattaggcagcttgacagattatttcaaaatacatttctagttgattttttaaatttctaatttcaactattatatttatacttcttttgcataaattatttttgtcatcatttattttgtcataaatattaaataaataagaaatatttttatttccctaaatattttctaatttgaattttttgataattaaattagattatgtattataattgaaactctttcaatttgggacataatcgaggttcaaaatcttcaaaaaaaagaataaaaaatatggtgttctcttttatatttatagggagcaaaatacgctacaaaagctataatattttataaggctattaataaaattaataagagtccacaattacaacttgattaactaccgatatcattaaaaacaaatatattaaaataactggtgcgtaaaccgtcggatctgggaatgggataaagcgcttcgcccttcttgagcttcgctacctaggctgtgaagcgattcaaattgatcaaattggttgagagatttttttgaatttttaaaaaattattaggggtttttagtacacatcaagcatcaagacgg

SEQ ID NO: 24890 - DNA, 2153 bp, Heterodera glycines
  misc_feature (2106)..(2106): n is a, c, g, or t
aagcgtccgtcctgaggccgcgaagcggccgaatgtttcccacacaattaaaaaacgggcgcgaagcgcccgtcctgaggccgcgaagcggccgaatgttccccacaaaattaaaaaacggccgcgaagcgcccgtcctgaggccgcgaagcggccgaatgtcccacaaaaaattaaaaacgggcgcgaagcgcccgtcctgaggccttgaagcggtcgaatgtcccttaaaaaattaaaaaacgggcgcgaagccacgtcctgaggccgcgaagcggccgaatgtcccccaaaaaatttaaaaacgggcgcgaagcgcccgtcctgaggccgcgaagcggccgaatgtcccacacaaaattaaaaaacgggcgcgaagcgcccgtcctgaggccgcgaagcggccgaatgtcccccaaaaaatttaaaaacgggcgcgaaccgcccgtcctgatgccgcgaagcggccgaatgttctcaacaaaattacaaacgggcgcgaagcgcccgtcctgaggccgcgaagccgccgaatgtttcccacacgataaaaaacgggcgcgaagcgcccgtcctgaggccgcgaagcggccgaatgtttcccacacgattaaaaaacgggcgcgaagcgcccgtcctgagaccgcgaagcggccgaatgttccccacaaaattaaaaaacgggcgcgaagcgcccgtcctgaggctgcgatgaattgctaaattacatcactttctagcgacgcggcgaagccgcgtcccatagcgcgatagcgctttaaaacatcacactaatggaattaatgttttgtatgttttaaaataacaaatgagggccatatattaccaagccacgcatgcacaccatagccaactgggcaccctagttatatatatgttatatatatgttatataggttttgagtttcgttgctaaaaccattttctcccggccgaaggccgggagcgccctgaaagtggtggaagggtcttacaactttttgaggagaatccgggaaaactatagagaaaaattcagcgcggacgactgagtcccggggaccgatttctcactttttcttgcagtttagggcccgtaactttttttctaaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggcgaataactcattagggtttgatctgagcgaggtggctccagcggacttattgtagagctttgaaagctcgatttttccagattttaaaatttcgaaaattttcaaaatttttcgagttaggcctaaaaaacggttttcgggttttttaattttatgattttttaacgaattttcccagaaaaacggagaccacttccaaaacatagtttttcgagctctatcgattggtaatttttttggaaaattttcgatttttttccagaaatagaaaaaatttttggcctgagcgggacatttgagtcccgggcccataactcgtcaggggttggttttagccaaaaatggccttagagcaaaattgtagagctttttaagctctatcgaacggtgtacttcattttcgaaaattttcaaaaattttcgagctaggccccctagaaattttcaaaaattttttttgggttgaaaaagagggtgaaaaaaatttttctggggtaaattagggtcctgagcacaaatatgatgtttattttaagtttcagattttttagaattttttaaaaattcgaaaatatttttaatttttttggtccttggaaatttgggttaaaatttgaaaattcataactcaatggaggactggtcaatttaagtgaattaaagctttaaaaatagcaaaaaatcgggagaattttatgagatttatttggttttataatgttcaaaagaaaaaaagttattccagaatttctggaaattttcgatttttcagaaaaaaattcataactcggttctgaaaagtcatactgtaaaagtaaaatactaggaaaatccccaattttttnctctattatataaattttaaatggcatttctatcacatttaaaaaaa

SEQ ID NO: 24891 - DNA, 1745 bp, Heterodera glycines
taactttttttatacttaagtaaaaattatttcgaaaaatcatattctaatagagtacaattaaggctattgaatgataccatgaaatattaatttggttgaatttgagccaagctattaatttaattattttacccattttttgttttcaaacccattggcagttttaagaaacgtgctggcggttttaagaaacgcgcatgggtggcagtttttaagaaacgcgccagcacggctgaacgcgcttattgaatttgcgcgcatttttgttttaaattttaaatttcttttggtatgtagcttcgatttacttttcttacgatgattttgggctcagagctccaatttttcaaattttcatttgaattttaatttttaaaccattctaaaaattcccatttgtgaggaaaaaatacagtattctcaaaatgtggaattactggaatcaattctaaaatgaaaataaaattgagaattatgaaaataatttatgttatattatcctttttcttcccttttacccgcctcattcacagttaattaagataataatttgaattgttaaatttcttctgagtgcaattttttacataaaatgacatcgttggaaaattctatacaacagatgaaacctttgttggtggggacgaacatgaaaaagaggcgagttaaatctgcgatccgtggcctaatgcactaaattttatataaattttttttcgaaaattgggttattttttcaaaaattctttcaaaattctaatttttcccgccggcactgatcaataaactaagatttttctctacggcgcctatcggcaccgccggacagggacgtatccaggaggggggtgcgcggggtacgcaaccaccaagtcctcgctcacttaaatttctttaaaaaactggctatttaaaaaaaatccgcaaaaactggtcattttttagtgaagatatgacaaatcatacccaattcctaagcccatggacgaatttttaattggaacatagtcaagggcaaccgaaggggttcttttattatgcgttggaaattgaaaaatgtcaaaatttgcgggagagactgtcgggagtttgtcctggttttcttttattatgtcctttgaattgtatcttcccagcaaaatgatcactttcgtcactttgtcctgggtttcttttattatgtcctttaaattgtatcttcccagcaaaatgatcactttcgtcactttgtcctggatttcttttattatatcttttgaattgtatcttcccagcaaaatgatcactttcgtcactttgtcctggtcttcttttattatatcttttgaattgtatcttcccagcaaaatgatcactttcgtcactttgtcctggtcttcttttattatatcttttgaattgtatcttcccagcaaaatgatcactttcgtcactttgtcctggtcttcttttattatatcttttgaattgtatcttcccagcaaaatgatcactttcgtcactttgtcctggtcttcttttattatgtcctttaaattgtatcttcccagcaaaatgatcactttcgtcactttgtcctggttttcttttattatgtcctttgaattgtatcttcccagcaaaatgatcactttcgtcactttgtcctgggtttcttttatatgtcctttaaattgtatcttcccagcaaaatgatcactttcgtcactttgtcctgagcttcttttattatgtcctttgaa

SEQ ID NO: 24892 - DNA, 1743 bp, Heterodera glycines
cagcagcggtttttgcattacaactaaaaacgacgagagaaaaggataaaacgaaagatacgaagctattgactttggttggccctttcgacgaccatcgattggtgcatttcggtcgccgttcctttggcgttttcagcggggcctttgatcaaagcattgacagaatttctcgaactgatcggaggaacaacggcattttgcagcgcattggccgaagggttggcaattgcgctaaatttggagggtttcgccggcagagacggcggttgagcatttgtggaagcctaaatttgaaaaacatgaaatacattcggccaccgcattcgacctgcatttgtccttggtcgagaaatcggacgaaattgtcggggaaaaggccccgccgtccgtcatgctcggcaatgaaccaatcctcctcctcacagtgccggctgaccacagtgacgacggtcccttcggagagagaaagttcgtccgagtttgccgcctcgtaattgtacaaaactttggcgaactctgtcaaaaagatctgatagcttaaatttgaaaaagaattcaaacaccttcataaaaccaataacagccaatccataccatactttgaaacaggattcctattttgcagaaaaacctggcatttttaggcttttggggggtctgtgtggttttgatggatcacggaatttcaaaaattaacccaagatgaatatttatgtctaattaatcgcatttgaagacttaaaaagttgctgggtttttcatgcaaatcctgctttgaaatgctctcgaatgccttacaattcgcttttctctctattcattcgcttaccctttgctttttgggaattcggcacttcagcaccctccaaaaccattgtcgtcgttgtgggagtgatcatcgtggacatggcacgacgaacaccggcggaaacggtcggtgccgcgtcccttttgagaagggaggacggaaggacattggcggattggacaattccggcgccattggtcagactcagtgccgacgtttttgcggggggcgccgaattcggaacggaaacaccgacggaaggaacatgttctgctggctgctgtttatctgcaaatattcctcgctgaccataatatcatctcttttttgttaaatattaattttttggaattttatggaggaagaaattttggttctaatgcagtttacgcgtccaatcaatgactatcctcggtttcttaagtcataactttttttctttcttgctcaaaacttatattatttgtatcaatcgagagctaaagtccacagatttttttatatagaaaaattctgggataaaggcaacagataaaaagttattgttgaatatacgcgaaaaatgatgaatttcaggtttttttcattgaaatttttcgtaatgcaaatatttgctcttttcttgtatttataaattcccgagactttaagctttcaattgataccaaggatgtatggattgaccaagtaagaaaaaagttttggcttaagaaactgaggatggtcattgattggacgcgtaaaagtcgattggacgcgtaaactgcattatattcagtaatttttcgaattgcctgtgtatgaattgtcatgatactttatgtttaacaacgaaattttattaaaaaagattactgcatagcggacaaaaaaataggtttcctcttagttatttggacggctaaaataccacggaccagggatggcacgga

SEQ ID NO: 24893 - DNA, 865 bp, Heterodera glycines
aatttttcctacttttttaaaaaatttttgagatcggtgacgctggattggatttgcaaccagcggcggaaatcataatcccgcagcgcactcagcatttggtcctttctgatcaattgcacaatggagaacgaatgctcattttctgttcccctgctggaattgagaggctaagaacttacaatgctgaagtggcgattgatgggacttttgaagtaattaagcaataaaaaaagaaaaatgaaaaaatatgtgctaaaatttaagactagcttgtgcgataatatgcgataaataaacatgaaaattaaatggaattcggttaaaagaaaactaaatcaatgataaaatgttttgtaaaattaataataaaaattcttaattttatatggttaaaatttgtccatgggttgaattttgccttatctggggaaaacaatcaccggcgagttcaattactggcgaaatcaaatacagacggcgagaaaaagagaaatagttcactggcgaaatcactcactggcgaaatcacacactggcgaaatcccactggcgaaatcactcactggcgaaatcaatcactggcgaaatcacctggcgcgaaaaaaaaatccccaaatatgtaagaaatatgtataaaaactagagttgctcggtaccggtaccggtactggccggtaattaccggtttttttggtaccggtaccggtaccggttttttcaaaaatgaaagtaccgttaccggtttgtctagtaccggtaccgccggtaaaaatttgcactggtaagaatgggggtctggtcgacaaaaaataagaaattggtgaagaaggagaaatttttgagaaaaaaataaatttatttc

SEQ ID NO: 24894 - DNA, 1398 bp, Heterodera glycines
tttttatacataatttctctaattttaatttgtttatctatcgttcaattctttgtgatttggaaattccaacattttctgggttcagatgaatgtcagtgacgaagaaatccatttctctcggactgttcgtcatcttaatcagcggctgttcttcggtttgttatcgcaattttcgggaaacattgccattgtttgggacggtaaagcgatgaccacacaatttgacatggtaagcaaaataggcgaagttgaacatcatcttccagcattttactatataatttacagatagttactccgaaattgctacaagagcacaatgtgaccaaaaattacaaattggaactcgtggcacaacccgacacacaacacgtgattcttttttatttttgttacggaatccaagttcttaggttgtctatttgatttatgcgacccgtcaatctgtgttattgcttatgcgaaattggcttcaccaattgcccgacgatgtgagttttaactgttgaggaattatttaatttttacaagttgtatataacatacagcgaatgatttttttaggacttacgcctccatcacgttgtgttcatccccgacgcttcattaactctcagacaacagttgcgtgaagatcaacgcgtttgggatcgtctccaatcggtcgactctttgcctttgcattggttcccgacggaacagcacaaactgctcacgatggagttgcctcagctggtggcgcagctggtgctgaacggagactggaacttcctgttcagatgtgccactgcgatcagacaattggagcaactgatcacaggcagtgacggggcgctcacaatgcgctgtaagggcgaatggtccgcacgcattgtggacatgtgccgcaaaatcagagacgatgttggtgggaccagaccaagcgggaggagtgctttcatccctttgaagcatttcgattgtttaagcccaatgagaagaaactgccgctggagaccgacttttttcccagcatccacgggttgcgggcggtgaacgaaattgtggtcgtggaccgatgggtggacccgttgagtccgatgtttcaacaattgactttcggaggagcatgcgacgagttgttggccattgattctaaaggcatttggatttttaagactacatgcaacaaatccaattaaggcagactgagggtgccattggcggactttgaggagagagacgaccaaacggagacggcacaacaatcggacagtgaagagatgaaggaattgaacttgcacgacaaagtctatgaacagctgcaggatttacacgttaaccagttcagtgggttttggctatttttaaccaaaatgatgtgaatgattttagagttgccaacaaaatacgagt

SEQ ID NO: 24895 - DNA, 1754 bp, Heterodera glycines
cttacaaagcacagtcggcaaaacagtgagccatcattccggcattcttcggcaaatttttgatggcacgaaacagtgccgaagaattgttcagcttggatatgttcaggcgacacacaaattgtgtcaacatcggaatccatcgtaaaagcacccaaaatcattgacccacccaacaacagatcactttggccatttgactaaatccatttttttaattgaataaattaaaataaaatttacccattcccgaacaattgttcgaattttgttaaaatgaactttaatttcgtgtgctttgctcattgtgtgatggccatttgtattcaaaatattttccaactataatttaatcaaattacttttaattgctgaggatttatattaattttctataaattaattttaaatcagataagaaatgagttttttttaaattatttttgtaagtatttgctactcaatttctatgaattttttaaaatttaattcgaatgattaaatttaaataaaaatatattttacggcttcagggaaattggacataatatcacaattaatttcttgaatatattcaatgtgtgctcgccaatacgctggcatttgtccaatcaaatatttcttttcaacaaaatcatcaaaaatgcttttatctaaaatcaatttaaaacaattaaagaactgttttatttaaatttcttgcttttttcgaatttaaatttaaatttttaccaagcttcagttgctccagcgtttttctccatttttccatgtatttaagcatatttttgcgttttccatctttgcttttccggttttcatttactgcagcgaaaattaccgtaattgctttggtctgagaatctttgttcaatttattccattcctctgacagtcgagcattggacaacagagtcctggccaaccaatttctgtataatatttcgccaaaaattttccaaccaaaattttcaaaatttcgcttataatctgtggaaaaattgctcaacatttcgtgcagttccatcttcaattgttcgtctttttcatttattatttgcttattttcaatttctgtccatttctcaacaagaaaattcgtttttgaatgccaaaattggatggcaatattggcaaaatgtctctgtgccaaaaagcggtgccaaatttcgttcgaataaatgctcagttcaaacaaatatcgttgcttctcattgctgaactcatttggattggtcagaagcatttgataatgatcaagaagaaaagcatcctctttaacatcttaattatggaaaaaagaaaatatgcattagttctctgttttctgtattcatttttaatcactattttggcgaaatgtctgaaaaaagtaggaaacactctaaaaataaatttaaatgcttttttggacaaaatctgttaagaaactatcaaaaacttcaaaattttccggcggcgcccataggcaccgcccgacccctcttctgttcctaagtatccccataaaatagtgatgagaaaaacaacataaaagtcttcgagttttgtggattgatccaattagcaaatttaaccacaggtaaaagtaaattatttctgttcggttttccttacaattattaatctaatttttatttatatttaaaattggcaataccggcaattttgtatattttcacactttttgatgcgtcattttttgcctcaataacgcctgttttattgcttgaatttttactctttgtccttcg

SEQ ID NO: 24896 - DNA, 1137 bp, Heterodera glycines
  misc_feature (1109)..(1111): n is a, c, g, or t
  misc_feature (1113)..(1113): n is a, c, g, or t
caaaaaaatcgattttttcaagtgtcgttgggggtactcaacaattatgggagcaaaatccaacgcagaattaagtacaggctatagaaagctactccgaaggattcggtctccccataatctgggcgcatcggtcggggggactgcccgaaaacaaaaaaatcgatttttcaagtgtccgttggggtactcaaacaattatggggagcaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgcgttaaaagggttcatctnnngnatgtcggtagggaatggcaaacat

SEQ ID NO: 24897 - DNA, 1203 bp, Heterodera glycines
attttgcgattatttttctgcggaatgcctccatatgaaattactttcttctttcgtccattgactaaggtttttctcttaataatttttcaaatttattataactttcagccatctttggtcgaagcaataaaaaggcaggcgactcttttgatggataaaggcgcagtgattacgaaattggaaagcctcggctaccgcgacttgccctattcgcgattggacagattcgcgaagaaaaacgtccattatgcaaagttagtcgattgattgtgatatttgctgaacattttggatgctttcgtctttgaaacttaaaaataacaaattctcaaaaatgcaattgtattcaagatttgatggctaaatttcactttttgtttctcattttttacactgtttttagctccattctgatgaattcgtcgatgtcagtgaaaacaatgaatgatgcgagaacattgttttcgaatgacaaagaattggtcggtttattgtgaataaatgaaaattagaaaatgttgggaaaatgatttgatcgaaatgcattctgaaattaccggcttttcgtcttgccaaattttcgtttattttacccgaagtgccatcgatttgccaatcttcggactatttatattctccccaacttcagctttggtttggcatcgtcaacacaaatagtttgcctgatacgcccgacaaatgcgacttggagcagtttctgcaaccgcccgcatatcggcagtcagtggaggaattgcgcaagaatcagaaattgccattctttacgagtttcaaaatttacaagaggacagaaactgaataccacaatatacccaagtcgtacttcgtggcaccacacaaacgttgaacggacgactgaacgcggaaaacgcctcgtttttggagaatcgctttgttcgatttgtttttgatcatttcaagatgactgtattttatttaaaaatattctttgggaatgcttgtttttgaacttttccatctttttgcacctcaattacttacaattagaaataatgaattttaaaggtttattttatcaaatcacagctatattcgctaacaattggattataacttgaattatattgaaattggaagtgaaaaatacataaaaattgataccattaatggttaatcgcagtttttggtaaagcgttaattaacatgacaaaaccaaaa

SEQ ID NO: 24898 - DNA, 2300 bp, Heterodera glycines
tgttctttggtcagattgttttgttgttttcttactcctttgtgcctttcccactctaccgtattccctgcttgatgtgtcatcttttggttccttcgtccatttgtccgtctcgaccaacaaattacgccattcaaacatcgttagcctctttccctatgaaaaaggcgtcaattgttgttgcgacttttgcttttccccctcccccgtcgttcttcaatctttctttccattgtaacttttgtgccctcctgcgaaagaggcgataaaagcattctgcctcgggcaataaaatttggcaattccacagggacacgacggcattttccttttttggccattgtttcccccgccccggccgttcattagcctttctttttttattcccgcaacacacaatgggcttcatttcctgttccaagacaggaattgcttcacccccccccccttcgtccttttgctaatgcttttcctttctttacgcttttcctcccccccccctttttcggcgtcttttcttgccaaatttgctgtcaatttgtccgcggggtttcccctcccctcccccttattccctcaaatctcccttaccccccccctcccctaaagcgaggccgaaagggaacaccggcacggccgtgccgtgccgttccccgactttgcccacccaccgctgtcacccctccaacagagggcagcagattgccaattttgagattgcatttacatgccccgtgggcacaaagacgaatggcagacgatggcatgacggggtgagaactgacaattcagtctctctccagttgagtcccggtcgattttcatcaaaactactcaaaaagggattgttaagcataggtaaacttcaaagatcttaggataagttcaatgaattcttaggcaattaattagggatttctccccgatcgtcggagacagaaaggtgggggggggaattaattacacatggagactggatgaagacatgccattttccaaatctttggcacttttgtaacatttgaactcagtcgtatgggactcattttagcggtgccaaatggaggggggagggcgaggggcgggacccacgcgtttcggcgctggcgtttcggcgctggtgtttcggcgccagctcgtttttccacttaagcttttttctttggcatccaaatccaacaatcttggtatcattcgaaagctcttatcatgctctattagccttacaaaaagcggatagattttcaagcctgtaaaaaactattaaaaaaaaacttcaaaaatttcgacttttcgaaattttcatgtataacttttttagtaattgtctaatcgcgaagcaatcgcttagaaaaatcttctaaacatgttaagctttcgaatgatatcaataatgttggatttggattagatagaaaaaagttatagccaaaaacatgctggcgccgaaacgcagtggacccttccaccgctggtattcttaccaaggaataatttttagagaattttaaaccatttaatactttcatagataattttattgaaattagccaatatttttaaaaattatgtctcagtgacgaactgaacggtgacgaaacgatcagtgacgaaatgatagggaaccattataattaggcaaaataaaagaaatacagtaacgtgaaaaattaaataaagttaaagattgctgtggacaaatggttcaggaacacaagataaaatttttaagagagaaattgcattcactttgatatgagttaagaggataattaatatttaaatataagagaagcaaagaatttcaaacaattaattgtcgtgtacaagaatgtcagaattaacaaataaaaaatttgaaataatctcatttgtatgcagaaattaactgaaaacaaattcattcctatatatgaacagagaaaatacgtaagaccgtttttagcaaaattaaaaaagaaagaaaaagacattaaacaacaacatatatttaaaaatataaataaaaaatagaaaaaataaatgcaaaaataaaattttttttaataaactaaatatttatgctaatttatgaataataaacaagattatttaaatgccatatggagggaaagtacaagatattttttgctatataatatttttaaatttatacatgtatgaaaaataaaatgtaaaacaataacatgtattttaaaattcttaaattattaaaatatccaaaatgcaataattttctattatttttgcaataaaaaaatattatatatttttaaattgatactaagaaattgcagcat

SEQ ID NO: 24899 - DNA, 2590 bp, Heterodera glycines
tctcttttgcttggactttttttggaaggtccaaaaatggcatttgacttagtttcgtttttgatgtttccgaaatgcaaggctctaaatttgaaaatttgaattttctacaaataaaattggacttgtgtatgttttttataatttcttttctcatgggactctcaaatgaagaggtacaatcggtttttttttcatagactggtcaattctcacaattttcacagttttatctatgctttaaaaaattatttaaaatttgttcaagagtaaccaaatttttaattcttggtgacctctgttagcctgtaaactttcaaaaaatttcatcaactttaaaaagttattgccaaagtaactcaacaaaccaaattttttttggataactttttgggaacataacgatatttttgaaatttgacaggataatagagaacatttagggctatcgaatgatttcaagaattaatttggctgcttttagcaaagttataatttataagtaaaattttatttggatgattttttgagtatttactccaatttcgctgggtttttgatttattttaaattttatcgtatttcaaaccagggttggcatttctccaagctcgatttattttatttctaaagataatttgtcaaaattcttacaatttattctgaaataaaatttcaatttttcttcatttttttgggcgccaaagcggcaatgccgctaaaacggcattctcaaaagacattaccaccattctgcgtgctattgctatgtcaaatgacagattcctgtgcaacaatttgaatattttataatttttttcttcgtatattctcccaggctcgctcattgcttaatccaatttttccaattaatcctccgcccatttatcccctcttttcatcttcacaatggcacacatctatatccccaacccgcgactgactcgttggcatcttcctgtgccattcccttccttgcctatttatttattttccaatccgccacaactcgagctttttccggcaatgcccccactccaacccctctcctgggggatttccaccaccaacaacccacccaatccactcaatatattttcctcatccgtcagcgcaaaacaatgccacaagaatgactttagccaaagttaggcggcgctggccgattggtttttgggcccattatatttttgctcgttggtcacaaagaccaaaggtatggcacagttttttttggccattttactgaatttatatacatagatagatagatatatgtgtgagttttgattattttagttgttcatttattttattatttactttttcgtaatattaaacattatattttgattttaattcctaaattaaaaaattaaatcacatttatacttattttgatttaaatgtttttttttatttcaaatcattggtgagtgctcatttgcgcctccacatttgcgcctccacatttgcgcctactacatttgcgcctccacagttgcgcctccatatttatataaaataatttaaatactcaaaaatatttgctataatacatttagttggacaaaccacaatacatttatttttttatattttctttgtttttgtattattttcttgttttttttattttcttgttttttattatttcttgtttttttaaaaagatgctcaatcgagccaatgatcaattccttttgtggtaagtcgaaatgacagtgcgtgtaaatgtgtaatccatctttgatcatcacgctgatcaggaccaaactgatcaaattgttcaatcagatttttgatggctcgatcattttccaaatattttttggtgcggggtatttcagctgctggacgtgtctggtcaatttcatgtggtctcattttatttctttggtattcctcttcatctttgatttttaatatgaaacttaaatttgaattttaaaaattgtcaagtaattattaatttacgttgataaggggggtttaggtgctgaaaagcgtttgttgaagcttgaatgaaagccttccattccattattggttcttccaagatctgcagttaccgaatcatgcatgttccaagtttcaggaataaaataagctggtcttcggtttccgtcgtcatcaaggcgaaaaagataggttcttaaaaatttcaaagcattatggtcgaaaaaccaatgaaatttgcattaatagtaagtttattttaaaataaaaaagatcatatttaatcaaaaagcaaaaacgatggcgacacgaaaagtgaaaaattcgaaggcggatcttggccttctgatgctttatgccgtcaaaggagacggaaaacaagagttatttggatgtgcataatgattttttgataaaatcactcccgttagcccttgggcaaggcaatttttacacatttacacgctctgtcattttgacataccacaaaaggaattgatcattggctcgattgagcatctttttaaaaaaacaagaaataataaaaaacaagaaaataaaaaaaacaagaaaataatacaaaaacaaagaaaatataaaaaaataaatgtattgtggttgtccaactaaa

SEQ ID NO: 24900 - DNA, 1169 bp, Heterodera glycines
gcctttccgttaccttggtcgtgctctccctcggcttcttccgctttttcttagtctccctgggattcttccgctttttgttggtctccctcggacttcttccgctttttgttggtctccctcggtttcttccgctttttgttcgtctccctcggattcttccgctttttattagtctccctcggcttcttccgctttttcttcgtctccctcggattattcagctttttcttagtctccctgggcttattacgctttttgttagtctccctaggcttcttccgctttttcttagtctccctcggcttcttccgctttttcttcgtctccctcggcttcttccgctttttcttcgtctccctcggcttcgttccgctttttcatcgtcttcctcggctttttccgctttttcttcgtctccctcggctttttctgccttttattcgtctccctcggcttcttccgctttttcttcgtccccatccgcttcatctgatctcgactgcttttcctcgccatttttgggccaaattcgctgtcactgggcacattgttcccgcctcttcgcctcgcccggtccccttcttgaccacatccattccgaccaccttgtcaatttgcaccttagcaaagctcaacggcaattcgtctgtctgtggaagggctgcgaaagggacggacggcccttccccgctatttatatgcttgttcaacaccttcgggtacacaccggcgagaagccatacaaatgcgaggcaaatttaaaagtttgaaatgtttcctaaaaatcgtgggacgaacaattaaaagaatagaggggaatagttggattggtcgaacattctttctgatcattctaatgtccgatcattcccttattgatcactctattttcttccgatcattcctttctctgatcattctaatgtccaatcattcccttattgatcactctattttcttccgatcattcctttctctgatcactctaatgtccgatcattcccttctctgatcactctaatgtccgatcattcccttatttgatcactctaatgtccgatcattcccttctctgatcactctaatgtccgatcattcccttatttgatcactctaatgtccgatcattcctttctctgatcactctaatgtccgatcattccctt

SEQ ID NO: 24901 - DNA, 1070 bp, Heterodera glycines
tatctcacttgacagacttagttgcacccccccccccccccattggctgtagcatgctaaactcacgaggtacagtaacttgatgaccaggtacagcatgctaacataggagcccagggtacggccaaaacgcatgcaaaaaacttaagagaaaaaaaaaagcatatcaatgttttattaacatatttatttgagtaaattatggtgttttaacatcctacagtaaacatacagtaacggggcgtacggcgcacctcgtgcaactcgagcgtctcgttcaggtactgcaccagtttgcccatctcttgcgaccgcttgtcagagtgcatgctgcgcagtgctcgcgcgtccgaaattgccgtctccaagtcgacgccttaaaaaaattaaatttaatttaaaaaaatatataccgtaattagaggaaatacagaataaataaatacataattttatttattaccgctctgctggtgaagcgttttccaaatccaattcggcagataaaacatcactgcctgcagtgccaaaacaattggcacccactaaactttaatacatttaaaaagggaaaataaattcaaaaattattttttttacaaattttggttttcattaaaaaaattcttttttttacgaaagaaattacaaaaaaaaataatggtgattagcctaaataaaatttttgtcgtatattttaaaagccctcttaataaaaaataattagtttaattattcaattaatgaactatttaattaattaattaagtatttatttaaattaattcatttattatttaatttttatttttattaattagctaaataattttaattaattcatccatgactcatttttaattactcaattaattaactaattgtacctggtagtaaccaaattggcgctcatcacgttcattaatttcggcaggaatttcttcttctggcgccacataataagtgttttggatgaaacaataatcttcagcatattgttcccaaccgcctttgaattccatgggcatctgaaaatttactaaatattttattttcaaaaaataaatttt

SEQ ID NO: 24902 - DNA, 1654 bp, Heterodera glycines
atatatatctttttatattagttgttttttcccaaacaaaaaaaaattctaaaaatctaaagcaaattttctgaataatttttaattaaataatatattttttattgttaatagttttgttcggcaaaatacttttcttaatgttaatttaattattaaaaataatatctaattaattacaaattttaaaatgaactttctaaatattattttttaaatttatatatatatatatttttttttaacaattaaccaatttggaatgaagttttttcaaccaaacaggttcacattgacctagtgggcacaaatccgatgaaattggacccaaacattggcatcaattttgagctggacgaacaacagcagcagcagcagcattctgtgaacgatcatcggaaacgaggaggaggaggaggagacaaaaacggaccagcaacacaacaacagcaacaacatttttatgcaagagaaatgcgctttctgaacggtgattcgacctctgatctgctctgatctgattttttcatgaaaaattgtgttaaattttttcttgttaaaagaatatatacacaaatttcttaaatatattttcggttaaagtttgaaattttgcaattttttaagacaaatgaatgtcctttttcaaggacgccaagaaagttagtgcatgcatgggctttcatgcgacagaaaatggaagttccttttaagggcaaagatttatttccaaattttatgtacaattttaaggtaggtacttgaacttgaaaatgaattctccaattttgaaatgtacttaaattttttttttgttttatttagaatttttaataaatttctgtctctcatcaccttctgctgtgctcttttcatccatctttggagttgcagcatcaatcacaatgtccggcaatgaaatgtgccgttttgcatgggcactcttttcatttttgtgatcacaagtgatcaggatgatgtcatacgccgtgtttattcttgatctcggctttgctccgtgttcgttgaaatcctataaaaatttatttaatattatagtatttgaaaagatgcctttttgtagatactgtattgattacagcactaattagccaaatacaggcgtttaaaattaattattgtatttattacagcactaattagccaattactctgtacctgttgtagcacaacactttggtagttgcttattcggctcattgccccacttgcactgttccgtccatccaacagtgccgtttccgtgtcaatgcgtggcctcagccggtgccgttgtcgtcctgctgacgtttttcggcgtatgcttgtccgaacactgcgcatcagacgacggattgagcgtcgggtacgtccgccacgccaaaagccccaaaattcgcctaaaaaattttaaaaaacccctatgttcatctgcctcgggtataaatctcagaaacaatgctttttataccgctctaaaatttaaataataaataaaattcattcatccaatttattatttttgacagatttttggcaccaaattaatcccagtgttataaagctaatcaccccttttgcccttcttgtattccgcttgcacattcagcaggcacacaaacgttacaacaatggcaatgatcagataacagtg

SEQ ID NO: 24903 - DNA, 1974 bp, Heterodera glycines
  misc_feature (11)..(11): n is a, c, g, or t
  misc_feature (1966)..(1966): n is a, c, g, or t
atagcttaaantagattaaaaaaattacagaaacaaataaattttatagctaataagtaatttttaaaagttagttgtgcattaaaaataacaataataaaaaaaatatctttctaaaatacaattgaacattttaaaaccccattaatttattttaaataagattaaaacataaacctttagtccaattttataacatcaaatttaaaaaaaagaaaccaaaaaatctaggagattacaaaaataatttaaaacctaaaaaaatatttttaatttatcgaaataaaaataaaaattaaatttgtatgtcaaaattattgcacagaaataagttacctgacagattataacctaaaatatatactttaaaatttaattcaagaaggacacgtaaagaattactataagtattataaaagatgaatgaacatttagaaaaacaatacattatttttaaattaataattttattaaaacgaaaggaaaaatatttataagaaattactacggcgaccgtcagactgaacaaaaatctgaaatggtagacatgattataaataaaaatatataactttaaaaccattaatccaataaatatacgtgcaaacaaataaaaattggataattaaaatacaatcaacataagttaaaggaaatttgaatttaaaaaatagaaaaataattgcgagaggaaataataaatttattaaataatttattataaaacagaattaaaatattttgaaaaggatctttttcttaagataatagttaattatgactcatggacaatggataaaatatttgtacaaatttagtctaattatttttacatttcatcaggttcgaaaccaggagatttaaaagatcaaagtaaaataataaatataaaatgtttagtaaactaaaaaagtagttttgaaatttcattttaatttttaaaaattaaaaaaatatttttatttatcataaagtgaataaatataaaaatcattagtaatagtaataaaaactagaaaataaataactttactaaaaatattgactacggcttgtattcaacttattatcgatccccacttattagccacttttgaataccgttaaaaatggcattataagagagaaagcaataaattactttaatttataattaaaatttaattttttgttgttagtaaattttcggtgaaaataatttgagattttataaaattgaacaaaaaatcacaaaattcggccaataatgaaagaacaattattcatatcaaaggagaataatttgttaaaaattgaaaatacttatttaattcaaatgcccgattatgagaatttaaaatagaaaataataaaatgattaaaatatctatttgaaaatgattgtatatattcacaaagattatacggcgaaagaatagttccatttgaaattaaaaataaaatttttcctaaaaatgaatggaatttggccttgtcagtacattttccaatttcaataaacatttcaaactcgttcgttgagcaaataaaagtgtgtcaaaattattgtaaccaacaactataaaacataaaaaaaataaagatttatttggaaaaaatattaatttaaataaattgtataatgcatttgaaataatatattagtaaaatattattaatacaaaaaataaaaattttattaaaaaaattacctaaaaattgcaaaatatatacaattccagcataatagaatcataaataaggaacattaattttacaaatgaaattctaaaaaaatgaattacttaattatatatgctctgatcagttatctaaattagtcaattatagaaacaaataagtataattttattaaaaaatcgtttaatatttttaattttataaaataattcataagcatctattaattaatttgtccaattcatttgaacattattaaacttaaaaaataatttaatattcacantatattaa

SEQ ID NO: 24904 - DNA, 904 bp, Heterodera glycines
ggaagaaggatgagaggaagagaaaaaggaagaaagagaagaggaagagaaaaaggaagaaagagaagaggaagagaaataggaagaaagagaagaggaagagaaaaaggaagaaagagaagaggaagagaaaaaggaagaaagagaagaggaagagaaataggaagaaggaggagaggaagagaaaaaggaagaaagagaagaggaagagaaaaaggaagaaagagaagaggaagagaaaaaggaagaaagagaagaggaagagaaaaaggaagaaagagaagaggaagagaaataggaagaaggatgagaggaagagaaaaaggaagaaggaggagaggaagagaaaaaggaagaaagagaagaggaagagaaaaaggaaagtggttgattaattagtgacaaagggtgaggattattttttcaaaaagacaattttaataattttgcataagaaacataatgcttattaaataaaaaaaatttaaatttctacggctgtgtcgaaaaaattaaataaatcgctaatataaataacaaaataaaaaaatcagctgtgcaaattaaattttaactctccaattttcttttcccctgagtttgaaacctgaaaaaaactctctaaattaattttatttattaattttttctcaaaatttgctttaggtatattatttccccgccttccctctcccctccttctccccgcccttcctctctctctcccgctcccccctcactctctctccctcccctgcccctcttcctctcccctccttctccccgcccttcctctctctctcccgctcccccctcactctctcaagctcccctgcccctcttcctctcccctccttcgccctcacggtcccaaagaggaagtcattaatgtgattaaatgata

SEQ ID NO: 24905 - DNA, 1222 bp, Heterodera glycines
cacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagaatgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagac

SEQ ID NO: 24906 - DNA, 2024 bp, Heterodera glycines
tcaaaaaaatggtttgaaaaaattaattatttgcttagaagcatctaaaaatatctaataaataataataatgtgtttttaaatttatttaatctgtttttgaaaacttgaaaaaacatcggtcacttgaaaaaataacttctaaaattttgtccaggaaaatccaggtttttcgtgttttgcctggacctggacctggattttttttcacatttgacctggacctggatttcctggacaaaaatccaggaaaatccaggtccaggaaaaatccaggttgtcaaaaaatgacctggacctggacctggatccaggaaaaatccaggcctggatccaggtccaggtcgaactctaatatttatccatcaacatcttaaaagaaaagtcaaaataaaaagtaaagggaattaattcacttctcttgggaaaatgcgcaacagctgccaaccaatgtcgaagtgagtcgaacaccgtccgattctcataattccctaaagtcgaactccttggataactaaatgcattttaaagagttggttgaccttgtgaaatgaaattcttttcaaatttcgtgcaaatcatccgacgacagtgcctcctctccaaccaccgctttcattgcctgcacgtctgcccctttgtgtcagatttccaaaaaaatgaatttttttttatttaccaaaagcgctgctaaaaaattgttttttggaatttaaaaaaaaaaattttcgtccgggtccggttgcgccgactcttcatgaacgccttctcggccctaccaatggcaaacgtatttctgtgacttactctcttttccatttttcgttatttcagcatttatcgtctgaacttacgcacttgtcggggcttcagtttttggcattggaatgttgtgctactacggacttaccacgactgtcgacagcgctgctgttcgttctaagtacgtttttcttggcttatgcgaggatttgttctttaattcacttaaatttcgccgacacattcaaatcgctcctaacaatcctttttatcctgttttttagtttatggcctgattatgttcgtcagagacttcagtcgacctacgcttatttggctggtagccttgccttgactgcggctgttggagtggctgctgcccgtagtcctggaattttggctcttaccagcgctccatcacttctggttagtcatcggagacgaccctgggatttggcgcggcggtaccgttcccagacgacacttttttgcctttccgccagccaaaaaaattttccgttcaaacaaattttacgataaacgggtgttgtcattgccagaaggcgccgctggattaaaatgaaatttgcttatattctaattgctttttaggtttggtttggttctctcgctgctattattggttctggcttggttggctcattgtggcatttttggtgcggttttggctcccctttgttttgttagtggacccgctcttatgcgagccgcttggtatacggctggacttgttggaggtgcagcttttatattttctgaattatttgttaaatataacaggcctatccgccactgcgatctttgctccatctgacaaatttttgaacatggctggccctttggcgatgggtttgggcgttgtcttcgttgcgagtcttggcacattcgcttttccaccaaacactgcgcttggcgtaagtaaaactaactaaattcaaatccaaatcatcgtttttgtttcttaaggtctcgcttcgatttttgtctatggtggacttattctttcttcggtgtttcttctccgtggcactcagcatgtggtcaaaatggccgaaggacagcatttttatagccgatttaggggttatcagatggaattggcttcagttcgtcactatgacccgatcaatgcgtaagtaaaaacagacatcactcatattctaatgtttaatctttccttaaagtcaactctcgatttacatggacattttaacatttacattcggatggcaatgattctc

SEQ ID NO: 24907 - DNA, 1169 bp, Heterodera glycines
tgtcgacgaaaccgtccttgtcaatgtcttcgacggtttcctgtacagaaatttttaagtattattaatgaatgggctccaatagcaattaaagatttattaataataaatcattttaaataattaggcaacaatactgggtaaatatgagaattagggtgaggtgaatttttcccgttccaagttaagacaagtgaaaaatatataaagtgaaaatcattgaaaaagggactttaataagcaataatctaatttgatttttttttaataaataaatttgctaatccacctgcaccacaatgtctctcatatggtcacagtcctccgggtgcatgaaacagccgtattccgtgcggtccattttaccgtccgaattgtagtcagccacctgtaaatcaatttttgagtttactgtatggaaagcatttaaaaatattaaaatttggccgttagcctctcgatttaatataaattagcaggtctttttggcctgcttctgaccttccatcgacgttcgtctcgctcaatcattttgacgtattccggtgaaatctcctggccctcctgcggttttccgtaaatcaaatttcttaatttttttagaattttccatccttctcgccctctgttagattttcttcacctgtagtcttgccaatcgagcaagccattcttcagctgctcctccttgtaatttttccatgtccgctcaacatcattgttctgtaaaaaaaactttattttatttttaaggattagtcagatataagaaaattaattgaaaaaatttaaaaataaaaaacgaaatttataagtgaaccgaagcatagaaaatcgatcaaatcacagcggaattcaaaatatttgtgagaatagccctaatctatatcaacaaattcaaaatttaatgacaaattttttggtcgaattattgagccaaaattataattttgccaaattttatattttcgcatatgaatttaaaatggtaaaccaacattgtattcctgtttttgggaattcttctccgaaattaaaattttcggtttttaatggtcgggtgagagaaatgccaattttggcgatttttacattgaagccgaaaagttttaaaattgtaagtatctgttaattaatgtggcagaattgcagatcgtgttggcaatatt

SEQ ID NO: 24908 - DNA, 1365 bp, Heterodera glycines
gaaaaatgaacaaatttagacgtttcatgacaaaaaaaaatttttttttggtgctttttcacccaccacgccgtccgtgtagaggcagtttctggcagcgacgtcgcaatggatgatgcccttcgagtggatgtggtccagtccgccagctgcgccgaggcacatgtagagtttgacccgcgcgctccgccgctgctgcttcaagtagttggtgaggctgccgtccgtcgccagctccatgacgatcatcaggggctcctggccaaccgcgacgccgtagaactggatgacattggggtgtcggagctgccgcatgactcgcgcctcattcatgaactccttgatctgaaaattaataatatgcggacgcagtcttccaacccaccccccttcctcacttgctctttggtgctcgtctgagacacctctttgatggccaccgccgctcgagtcccctgctgatccacgtagacgccactcttgacgatcccgaacgtgccgcggccaagttcattgcccaggatgattgaagtgtgcgacagctcccagtgcgcgcggggcacggccctgatgagagcgacgtattgttgctgaaaaaaagggaaaatgaaaaaaaaagattccaagctgtttgacttacggtggtgacggaaactccggtacgcagataattgtcgacgaatcgttcgattgttcggaagcccttgtcggagttgaggtccacggtgaacattcctttgtgtcggcggaagatgacgtggttcagcaagccgccgacgttcaccgacagtgcatacacacgctccgtgcccgaaatttcttctgtcatgcgcaccaggaagtccccatcgttcggcagcagctccactacgtcctcgcgcggcaactaaacaaagttgaaaagacattaaaatgtggaaagtggggggggggggggggtgggacggtgacggctcctcaccagtccgtggtagtagggcagtttccacatgtcaacgtccattgtgcttggagccggtgcgcacgcgtcggtggtgtaataaaattgaaatacgagaaataatgggagagggaagtgacaaaagagtgaaatcgcatcccttttatgtaaccacaaaacatctcaaaccaagcaattcgaaaaagtgattgtaaatgaaaaatttttttatataaaagcattctttttcctgaacgtccttcatttgggctcggtcggttattaaatgcctacattcttcgtatcgtcaaaatgcatctctctcattttggcctactatttcttttgactgttaatagacaaaaattgaatttaattcgtgacgtttatacctaactcgatatgtaaattagaatagagccaaa

SEQ ID NO: 24909 - DNA, 1874 bp, Heterodera glycines
tcgtccctgtccgcgtgcgccgaatatccgtcgctgttcaccgcctgtgtgctgctcgccgcctggctgtaccctgtggaacgacgaatgtatccggcgactgtgcaggtgtgtgaaaagcgattttttgcgacatccttttcaaaaaaagatttggttttaaaaaatttgatcaaattcaaaatttgtcttcttttgccctttcatcggctgggtgaaaatgcacgaccacacacacccaagggattcgaacacacgccaataaattttcgcaacaaaatattttttggcattttggggtcaacttttcaaaatggataagatgtaggtcccgccgccgggaaaaattttttggaaattttaatgcaatttgtttataaatttttttagatttttcaaaaaagatttgcacatttcttgaaattttttcatttccctccaccccatgggagccaaagcataacaatttgattttgccatttctttgtttgtgtttttaatttccttttttgccccacttttgttagcccgtgctgatgctcaacgccagcaaatggcaatgggcgcgcaatgtgcgacgaatgcagcgtattattaaaacattattaactagaattctgaagaaatttgtagaattacatttttatttgctttcaaatttgtcacttcttttgtttataaaattattattttaaatttttttttggaattttatatttttaaaatgtttattatttttattttttaaataattttattcgacagagtaaaatcaaatttataaaaaaatataaataaatctaaaaaaataaaataataattatttatatttttaaataaagttttaatttttttttaataatattgaaacagatatagaaaaaatggaaataaatttaaactgatgaaataattatacataaaaatttaaaaaagataattttttcatgggatttcaaatacactatttaatctatttatctttaattaatatgcagttaattaggtacaataattcataattttagttaattttaatgaatattcaattatattacttattttaataatataattaaatataaagggcgattaattttcgtttataaattgtgaattaatatttttagaataaattaaatttgttttaagtgaatcttttttaatgtcatattctcatgatccatgggctcgctggcggcgcgcggcgcttatccataaatgcattttttatttcttaaattcttgataattaaatgcaaattcataaaattgctttgtttaatgcgttctaaaagtttgaaaattcgtattttaatttttatgttttttattctttagcgaaaatgataaattaaatttttattctatatttttatgtattcgtgtaaaaattgctataaaaataaggtttttgaattcttttttcttaattaatttcgaaatataaaattttattaggtattaatatgttattttaaacaaaattattttatttttattatttctatgtttgttataattgtcaacgaatttctattttcttgttacaataaattaatagtatgtatggtcggtgatattttcatatgtattaataggtaaagtaattgaaatgtaaattatttttatttttaaaaattacaattataaagtgcagtcattattttttattaatatgatatgagtttcattttagcttattaaattttattttaaaagaatatataattggaattgagtatttatgaattaaattgtatttttttcatgctatcagacaattattttattgtatatctatcggtgtccttttgttaattaaaatattaaaagctttcattcattattattattattatatttcttatcaa

SEQ ID NO: 24910 - DNA, 72 bp, Heterodera glycines
ccgtattccaatttcaggctatcaatctcatgtgcctgagcgcgcacccctttcgccaccgcatgtttgacg

SEQ ID NO: 24911 - DNA, 1323 bp, Heterodera glycines
  misc_feature (10)..(10): n is a, c, g, or t
agccgagtcncacgtcgggcacagcaatgccaatgtgacctttgaattggcaaaaacgtccaattttgagcggattggcactttctctcaccgaatccacgcggttccgagtttccgttgtgatagcccttgaagtccgtaccatgttcccaattgctgaaatgggtgagtaagtcaatcaaatatagctagtaagactgagtgagttcgatggtcgaatgggttgagagggcgaatttcttttgggccgcatcgtccgaagggatttcgtccaaatctttgtagcccatgaaaaagagcgagaattttccctcagggaagtccaattgcttgagcagcctaaaattcaaagaaaaaaataataataatcagacaatggatttgtatggtaataaaagtgaccgaccgcattccgagcacgttacagtagaagggaatggacacgcgtgggtctctgatacggtacatcgtttgttggaagtaaaagccatccgtggcttcgtccttctccttgaccagctttttgatctgtaaattgccaaacggcggacgttggtttcggttatttgtttgaacccacccagaaaacaaagttttcaaattaattttatgcagtccaacctcttcagccgggacggctccttcgttttgtgatgtcattgtcaaattgaaacaatctttctgaagcttaggtgaaggggaaatcatttagacaaaattatgaggacaattttcacacacttttttgatatgaaagccaaaaataaaatgccatcattttgagtacggaatccttttgagtttatacaaaataaaattcaaaaaatctgacatcaaaaaggtaatggacttcgtcgtcgtgttggccctgcgcttcacttttgcatcatcttcacgtactccgtgtacttcttgttcagtgcttcattcagctcctccctcctctgctgttcccacaattcctccgcttcctttctcatttgttcctccgttttcgtctccatttgcacttcttccgtcggtcttcgcatggccctttctgtttcaatgaattccctgaaaaacgaaaatgtttgttttttttctgtccataaaatttatcgttcccccgcttaattttctttttttttgcccccaattttctcacttataattcgtcagtgcattgttcttcaatgaaattatcggattcggacttttggtcgattgtgacgggaatagaatgtcagtgactttgccgatttggactaaaagaaaagggaattcgttttttaaattttaaaatgagactcaaatgggattacttgcaacccaagactcggg

SEQ ID NO: 24912 - DNA, 1962 bp, Heterodera glycines
  misc_feature (9)..(9): n is a, c, g, or t
  misc_feature (50)..(50): n is a, c, g, or t
tttgtcatntcgtttagccctcccctctttctctccccttccttattccncaatttcttactcaaaatgcgatgcccccgaaaaaactatttcattgagtgggaaaaaatcgaccgactaaagtgtacagacaaacaaaaaaacatacttttggagtcaataccactttagcaaatatttctaatgcttaccgtccccgtccccgtcatccgactcctgctgcaggtcgtcgttgttttttccacgtccttctttcagtttttctgaaaattaaaatgattattattcaaaacaagaaggaaatttgtttaagcgaaagagtaattgggcaatatgtacctgatccaatttatccttactcgcttccaaatttgcagacataataaaatgattatatctaaagaggaatgaaagagatatatgtacaattggcgcttgctgcctattcaaatagagagatgcaagggtgaactgtagtgaacgccccgtgaaaaaaagagtcaaatgatataccgatcgattcgtctcaaggagctaagcatggaaaaatatgtcgcgagttgtggaaattcaaaaaaaccggtttttgaaccggttcaaagctcgaaaaattgagagatttcgcactataactttttttcaaacgatcgaatcctgacaaatttggtaccatttgaaagctcttgacgagcttaatctaaaaatcagggaatgaagtcgaaccgcgccatctaaaaaccgacaagtataaatcggtttttgaaccgattcaaatcttatagtgccaattcagtaccaaacgtaatttataattgttttaattggcgccgtagggaaactggtgcaaataggtcattttggttattgcgctaaaaaaccgccgcacactcgactacggcggccagtattcctccgccctccgtctcgccccactacttgcttgaaattttatttagaaaaattttttttaaattacagctcgagattcccaatcgctttttttatttctcgtttacggaatttttacacggactttatttgtaaggtaaaatttgcaaacgttaatcaaataattgacaaaaacggatgatactgtggattgtgtgggtttgtttattcattggccaattttcgttttgtccctttttctttctccacagtaaaatcaatggccaaagtcactttgtcctcattttggtcgtaaaatcctttgctcgagtccattaatttcttaattttgacaatttcatttggtgtttggtaaaatagaacaagttttttggcatcgttaggaatgggtctcaccaattatcgctttcctttattacatatattttggttttttatttttaattaaaattataataaaggaaaatatggattggatgactcattcttagcgatggacattttttttaaattgccactcaccgcaaaagtgatgaaatatgggaatccccagctgttcgatttgttgttaaaagaatggtggtcaatttgtccagtcaaatcctccgttccgctcttttgcggaacaattcgaagggttgccgaacatttgcaactccaattttttccttattaattgaataaaaagtttttaaattaattaacattttaaatcactttcttttggggcggtgcacaaaatgacaaagtccaaacatttttcggtgcttccctttttcgtatttatttgtgcccaaattttcaattggactccttttatttgcacatcatcactgaatcggccacttcccacttcccctcgagcaaattccgataatttctcaatttccaacgcgagtgttcctccgttttcccgaggaatgttccagtcggaaatgcgtccatttgaggcaaatttcagcggtttgagcccgggcactccacggagattgggatgacaatagaactgataaatgccgaacatttcttcggtggtcaaaacaccgcaaggaa

SEQ ID NO: 24913 - DNA, 1556 bp, Heterodera glycines
ctcctaccaggaccacaaaccaaaacaaattgataaaaatactggggcccaaaagatttaaaaagtttaatatttactcgaaaatttaaaattgataatttctaaaacagaaacatatggaaatttggttttaaatctatgtattaatataatcatttaaatcattttagtcttaggtaactttaaacagaatggtggcagaatgcccgaatggtgagacgttaaattattttacagtgaattattactagggcatgtatttttgttaaaaacatgaaaaagatgcttaaatagttgctaaaaactgccaaaatatttgctaaaaattatcaaaatagctgctaaaaactgcaaatagttgcaaaaaaactgttgccaaaatagttaaaaattgccaaaaaaatttaaaacattccaaattaaaaatgcatgattttagtctttcaaaagaatttaaattttatgattattcataaagaatcctaaattgtttaagaaaccactttaaaaatttaaattaatttctacctaaaatttaactgaagaagccaatataaaaaaggcattcgtccagtatcttattattcgacacacacattttctccgttgaatgaatatgaattaatgagcaaaaataaaagcaaataactgaccactccttctcagcgccctgtctcccccggaggtcagaccaaaccaacgccaagtggagaccacccccacctcctcgccccgcgggcaaccgaaaaaaaatgctgatgttcgatgtactttagtaccccagagtagttagtccccagctatcgtcgtcatgattgattgctttttggtgacagctgccctttgaggcgtgccgccgcgcgcgggtttaccgcgcgaacccgtgcctgtggcacgggttcggggggtgggagggggtgcgagtgaggcggcgcgcggttttaacagcatcatcttttgctaatggagaaggggggcgctgaccaatgccattgacatattgattcgatactccaaataaattgggctcattttagcataattataccattaaatttataatggaattgttttatttatttattatttatttattttttgttagatagtacagtattactttcatggcaccacgacgcaaaagaaaggcggctcaattggtcgggcaggacgaagcggtggtgaacggaccgagcgcacaggtgaattgtgttcaccatcaaattttcacatttaaatttcatatgctttttattttcacagttgccaacgaatgacggacaacaattggcgtcagcagcaccagtgacaaacaatggcaccgtccaacaagcggagaacgacggaactgatgcggtggcggcagcagcagcaattgatggcaccggcggacaagtacaatttttgtattttcgttagctaagggcgggcgcttttggtttaaaaattcaccggatggtatatgaatattttatgacatctaaattgaaaaaaaacttgttaatttggaaaaaatttgggccaagtgttgtttaataaattctctattatattta

SEQ ID NO: 24914 - DNA, 1119 bp, Heterodera glycines
tcagattttcgaaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcgacgctcatttcagtgtaagttagtcctttaccggggagtat

SEQ ID NO: 24915 - DNA, 1777 bp, Heterodera glycines
  misc_feature (1707)..(1708): n is a, c, g, or t
gtttataatatcatttgaaattttcattttcatttctttttattataaataattgtaaaattgaagaaagaaaaaattacagatcacatattttattattgaagaaaaaatggatggatctggtaagaaatatttcattaataattttatttattatattttaaaataaaaataacaatgtttagacacttaatagagaccgtcacgattggtattttaaacgatctttctttcttttttgatcgctttttcggagctttgcttttatccaacaaaaagattgaattacttgtctgatctttaaaatgtttggtgctttgctttttgagaataaatgaatttttcgcctttttgggttttgagagaatatttttaccatatttggaaattttataataaaaatacaataaaacatcataagaataaaaaaaaatcgagaagtttgtttcgtggaggatttcttggaaaatttttcaaacttttttgtatttggaattgggcactattaatataattttaattataattaattaattattttattttaagaatacaaaatggatctttttatattattttttttatttttagatttcattcgctccgttttcaccgtttccgcttcagtttcatttgtgcttggcattctgttcaacacatttatggcatggatgatcatcaaaaagaccccggcaccaatgcttatctactcaaaaatactgatggcaccgtgtataattgtaaatgtttagctttatcactcatttacatttatattaaaaaaacaatttttaatttaaattatcaaatttaatttaatacattttcaggacattttcttgtccctttgcgcatttattgtccaaccaattccagtaaaatttgtaaaataaaattacaattttattaaaaactaggtatttgattcgctaaacttattataatatccatcccaaggttgtctcgcatggttattttgctgtcgtgcagaatggctttttccgcaacgcttccggcttttacaattatacggtaatttataattaattaaaaaaaacagtataaaaaacaattattaaacttttaaggcaaatgtgctgtggttccaaatgcttattctgtttgtgtgttgtacaacaattcaattcgtgtttcgctactatttgctgatttggtcctaataattttaaattaataaaatatttaaaaatgattaagtaatttttattggggatcatttttcggtaaccattaggctgtatgccatttgggattgacaaatgtgatccatgaccagtgatttctttttccgattccatttccgggtacaaagcacgttgaaattattttttccaatattattttggtattaatttttcattttatataaataaatttcaaatatttttttaaatttaattccttcattattcttcagcgatggccaagtgccggcccggctcaaatacttgaccagtttgatcatcgtctttctgctgattgcccatgtgctgctccattatctgtccgactttccgtatgccaaatataacgatgaaatgcgcaatttgtcctcgttgatcaccgccgaaattgggcttaccgaaattcggttttcctcctttacacctgcggtacaaaaatattaaataattttaaaaataatttgttataatttaaaaataaatttgaaaaaaattttattannattgatttataattaaaaatttttaatttattgttgataaaaaatgataattttgtttctttaaaaata

SEQ ID NO: 24916 - DNA, 1039 bp, Heterodera glycines
tgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggttcggatcgaaatcgaagtcataatcggttttcctgacccttaaaacccctaaaaagcgttttttggaacaaaagatgaactttagttaaaaatgaattttcgatttattgttagaaatcgtgtccggggttcggaattgatcgaaatcgaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggttttcctgacccttaaaacccctaaaaagcgttttttggaacaaaagatgaactttagttaaaaatgaattttcgatttattgttagaaatcgtgtccggggttcggaattgatcgaaatcgaagtcataatcgggttttcctgaccattaaaacccctaaaaagcgttttttggaacaaaagatgaactttagttaaaaatgaattttcgatttattgttagaaatcgtgtccggggttcggaattgatcgaaatcgaagtcataatcggttttcctgacccttaaaacccctaaaaagcgttttttggaacaaaagatgaactttagttaaaaatgaattttcgatttattgttagaaatcgtgtccggggttcggaattcatcgaaatggaagtcataatcggctttcctgacccttaaacccctaaaaaagcgttttttggaacaaaagatgaacttt

SEQ ID NO: 24917 - DNA, 994 bp, Heterodera glycines
  misc_feature (15)..(16): n is a, c, g, or t
  misc_feature (29)..(29): n is a, c, g, or t
gaacacacccaatcnntttttggtaccanttcgaaagcacaaagtctaaagaagctaaaatatataaaatctcaacgtttagacaattaagaaaaaagatctgattaatcaagtaattgttgattattttcggttgtaacttctttaaatgtttatcattattcagactttgtgctttcgaatgataccaaaaagatagggtttgttcgaacatgaacaaagttattgtataaaaacccgggattgtcaattggactcataaaactcaattggactcataaagtgcactagagccatattttgtttttgtttgttgtttatgaaaggttttagcaaaaggcactagaatacttaaccaaataacttaattttggtcatttgaatgattattaaatattttacaataaggaaaatttttaaacataaattttttatcaagaaaaaaatttgtgtccatcaatttttttagaaaatattaagtattaacagcacaattatggtgaataaaatgtatattcacgatttttatccaaaaaaaatttacaaaagaaaagggtcccccctatggtttttgataaaattcaaaatctatcactttataactagcgccaaatttgcttaataggccaaataattgtcatattcgtgatcagcgacctttaaaacccccgggtatttggtttcaggactttttaaacaaaaaaaaaattttgaccaaaaaaaagttgaaaaaaatttcaaaattgaccacttttacagtagcgccaaagattttatcgagtcatttttctgtgtttttatagattttcttggtaagggatcagggtaggggggcgggaattaagctgggcgctatgtactatttcaaatttaataagtacgaaatctaacaaaaaaaactttttttcaatttttagggtgtgactcttccgggccatcgtttggaatttcgcgaaaaattgttgtgctcattgtcaggccaatttgtgacggt

SEQ ID NO: 24918 - DNA, 1609 bp, Heterodera glycines
tttcttctcattatccaatttttatttgtattttttaatttaccattatcatgtcattaagtcattgtcttcgtttattaatttttcaaaattccccttattaatgcaacaatttggcagtaattggtactaaaaagccgatccattttccctatggcaaatgcgtgaagccaaacaatggcattttaaaagttcatttcctttaaataatttctatgtgtttaaaaggaagaaagtttgttgaattctacgcaaaaagccaagaaatgtgaagccaataaaatttatttattttttaaaatgccatcattaaaaatcttttggccaattttgcccggggcttcttcacgtgaatgaagccaatcactgaagcggtgttgaatgatgtcttactatattataatctttctatcgccggtggattatatgttatttaacaacatcgcccaccagaaaaattgaaaattgaaattttaaatttttcaatttggaaacatttccctcccccccccccccccaaattcccggaccccaaaatttgaaggtaaatttggaaaatgaaattgcaaaaagccaaaaaaagaattgtgcaaaagcaaataatgagtgaattgggcggcagctttggcccccgtttttgcagctgtgttcccctttaataaataataaaaattcattttttaattcctctcaaatccgcttcaccaaacttaaaatggaacaaaaagcatttttggagaggggcggaaaatggcgccgcgcccggcggggagacggggacaaaagcggttgaaaaaaggcaaaaaccggcgaaaattcacccactttttggccaccaagcctgaacaaattaattccttctgctactggtgctgataaaatggaaataaataggtaatgtaatttaatgggtcttccccttgggattctatgggcattgttaaaaagggattcggattctttcgacttcaatgcaataatcccttggttcgtattgttctaacctacctgtagggagagagaaatttcgaattttcaatttccggataagaaggtcagcccttgtttcgggggttgggtttcgattccatggggactcaattaccgtcctcaatagtcttgtcgatttcagattttttcatcccccccccccccaaagggtcccttcgttcacattgcctccgttatggccaatttgctcagtcaatgcgttctctccaaacggtcgccgttcggaaacgaatcgcgctcatatgaaatgcttagtgctgcgtgtgctgttggagtcagctccactttttcggcaccagttggtggttggttttctcttcttcaaatgttttccgtttgctatcggccgatcattcacaaaacgaccgatcactttcccatctgatcattcagtctctccttgttagtctcctcctcactgatcatcctccattttgcttggcaatttcgcccattctctctcattccatttttgatcgcccatttatttgacatattattccgatcactttcctcttgatcacgagcgacgaccctcccccttccatttgatcggcatccatttctctctctctcctctctctctctcttcctcttt

SEQ ID NO: 24919 - DNA, 1332 bp, Heterodera glycines
  misc_feature (1273)..(1273): n is a, c, g, or t
cttttgttgtttgccatcgttttggcacactcagcagagaataaataattttattgtatgtggcagaattatttatttgttaatttgtgaaaataaatttaaaaacacaccaatccttttatgtctaaattgattaatgtttaaaaaaatcattcattcaataagtaagttttgtttttttgcgtcaaatttatcgacttttaaagagcaacagaattaaacgactcttttttggatttttacttttaatttgccaatattttttagtttttctttttcatttatttttccactcatccaaattgtttcttccatttatcaattgatctttgaccaactccatttttcttattaatttcggcataaattttcttccattcttttcttgaatatttatattcatttgtcattgctataaattgttgaacaatttcaacttttttgttcatccgtttttgatttgttaaatttataaagtcctaatgctttgatctattcataaatatatttgcgatttgtctcgaatttgttcgcaattttcccatcaatttttctccattcttttgctgtatattttctttcgttttgctttattttctctttaattttatggaatttctcaataatttctcagtttttctgatcattttcattttctttttttcccatttttctctaaatatttcgcccaaatgttttttctttcaattttttattttctgctctaatttcaattttacctaattaataaaaatgcaattaaagcggacaaaaatatatataaattcattttttgaataaataataaaaatgaattaaatcatctgaaacaatttgttgtaaataatgtgaatctaaagacaattgattttatttaataaaaaattaactcattttctaatattgatttgtatttaaaaaatttccgcaattttttcatgattcatttttgggttttctctttttatttataaataattttttctttttttattttaaaataaaaatgcaattaaaatgaaaaattcatcggaatcttctttttcgcgacatgctttttcaaaaaatatttttttggaaaagaagagtgccggcgttgcctaaaggagccgctgggaaaatttttgaaacatgcaaaaaaacggacttttataattttaagcctatttttaagaagagctaaaaaatattcgtccgtctgtggctcaaacaaaaattaattttaatttaaaaattaattaaaattgaacattataacaaactcttttaattntatttaaaaaggctacaaaggaaaatatgaataatttttgacaaaattatgaataaaat

SEQ ID NO: 24920 - DNA, 1296 bp, Heterodera glycines
gaattctccaatgaaagtcctctttcgaacatcgaggtaaatgcaaaagcagcggtcatcttcttcccttccttcctgtctctgtttgggcattaggcatcaatggtcgctcggacaactgccatcggggaacatggcgaatttttaggaggcagaaaaacggcagtggaacattaaatgccttagcaggtgtcttcaacatcattcagaattttggtaataaaaagcaattatatcagcggcataaaacacccataacagtttaaacgtcctgtgatggatcatcataatcctattctgttattcaagcataattcagatctctttgataacattttaattccaatcgcggcttatatgcctcctaaataatcgttgcgtgccaaaactggcgctttttgctctctttttaaaaatttgggggggggggtgggttggcggcttcataggggtggtgtatttttcgttttattgcatttttattaaggatttctttgaaaaccctgaaaataaacgtaattaatagggatggtaaaaatatggatataaaatcgcgaaatatggccataaaatatggaccaaaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagccaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacattccaggaaaaaaatatggatttccat

SEQ ID NO: 24921 - DNA, 1682 bp, Heterodera glycines
  misc_feature (28)..(28): n is a, c, g, or t
  misc_feature (55)..(55): n is a, c, g, or t
  misc_feature (1629)..(1629): n is a, c, g, or t
acgaatatgatgtttattttcgtttcanaattttggaaattttttaaaaattctntattttttggcaattttttggcccttggaaatttgggctaatattggaaaattcatatctagcctaagggttgaccaattttgagcaaataaagctttaaaaatagagaaaaatcaggagaattttatgggttttatatggattttctagcataaatatgaaaaaagttattccagaaattctggaaaaattcgaattttcagaaaaaaattcagaaatccgttctgaaaagtcattcttgaaaagtaaaatacttcaaaaatccgcaatttttttctctataatataaattttattttacatttttatcacatttttaaaaaaagatataaaaataaaagtgattttgggattcgggaccaaaggggtgagcacatgatttttgagtggaaaaatttttctcacaaaaatcttccaaaaatatgtctttaggggttatttgggccgctgatcacgaatacgtgatcagattttacttttgacatcgtcaagacctcagaatccccgtgtgattggggattctgaggcatcattttgaggggggggggcaggttcgaatccggacggtgtaacattatttttttgtgcatttttacgttattttcaatgattttaattaatttaaaatattttgttgagttaataaataaaaaattatatttaatttaattttttttgataaataaattttataagtttaaattaattatttttttaattgatagaatttcatgtatttttttaattaaatttgttaaaaatattttcattttaatttaatgaatttactaatcactgttgtatcaatttatatttaaagatttgttgtaaattaataataaaagaatttatgtaaaaaataataattatcttttaataaagaatttcatatttttttaattgaatttataaaaattaatttcatattaatttaaatattcaattattgtacatctcaaaattctctttttaattaataaaaggaataattaatttattttttaaaatttataataaattgcattcaatttttgtacctcttctgatcattgttgcacctcttctgatcactgttgcacctcttctaatcacttttgtacctcttttatcacttttgtacctcttttatcacttttgtacctcttcatcaaatttgtacctcttctaatctctgttgtacctcttctgatcactgttgtacctcttatcaaatttgtacctcttcaatctctgttgtacctcttctgatcactgttgcacctcttctaatcacttttgtacctcttttatcacttttgtacctcttcatcaaatttgtacctcttctaatctctgttgtacctcttctgatcacttttgtacctcttcatcaaatttgtacctcttctaatctctgttgtacctcttctgatcacttttgtacctcttatcaaatttgtacctcttcaatctctgttgtacctcttctaatcactgttgcacctcttctaatcacttttgtacctcttctgatcactgttgtacctcttatcaaatttgcacctcttcaatctctgtaaggccaacaaaatttngaataacgggcacgaagcgcccgtccaaggccaacaaatttaaaaacgggcgc

SEQ ID NO: 24922 - DNA, 1571 bp, Heterodera glycines
ttgaataaatcgtcaagagtgaattttttaagcttttccattaatctaaaagcaattctgacaataaaagagagaaaaaaaattgaccaaaaaccgggacccaaaccacattagtaccgaatattggatacctattaatttataattcaaaatcaaaatttagcctttttttgaacaaaatgaaaatatgcgataaaaaattgagtttcatgctcactgctatgaattgtttcatttatttcgaagttaaggtgaccgaagcagcatttgatgagagagagagataagtcaaaattaattttgccttaagcattagccaaaagaaaatcagaaaaattccatcgaacaattgtgactgtaataagagcttggttttctaaaatcgtcctcttctgtcggctttcgttcctttcgccgttttccgtccctttctttgccttcgctttctccgcttcttctgctgaccattcattcattcgcctccaccgacgactgatcagcttttgatcattcggctgagctttgtttgtcctcggcctccgcttcgatttgttcgtccgtcctcagccaatgaatgaatttgcctcattatcctcacaatcagcagcaaagcaagtctctcctacaacaatttcttctcctaattaattcgctaaattatggcccttttctcgcctcattttgggcattgtttttgccaactttttccgcttttcctgccttttttctgctattttatcgctttgtctttcgccgtgcctttccccccatcgaatgggccttgtccctccgaactgatgctgaaatgtgctgaaccgctacaacagttgggaatatcgccgggcaaaaatttggtgctgctactgctccaactccaatctcccaaccaacttcggaacagctgccagtaattttgaactctgatcagaaatttgtttaaagatgaaaattgttaatgaaacgaaatgatcattttagagttgattgtgagatcttttaaacggtttcaaacaattaacaatgaaacaactaattgaagcagaatttgtcggactaattaaatttgaatctttccctgctgacgttcattgtcccccggcagagcttacgccactgctttgccctgcttccgtcggttggtccctcgctgcggaatgccctcacaggcggaaattcttcgccaaatggaaaatgcgcatcagtttctctgttctccgttctcgggcgacgaacaaagccaactgttggcccatagggtttgtattgggcgaattctcggccaaatgggcagcggcggaaaaggctgtgaagcgacgggtggaaacggaggagcagtggggacagcaaattcgaattcatctacggccattgtgctgttccgatgcaggtaaatttgagacggaaaatcgtggaaagggtaaaaagagagagagagggggagagagagaggcagagagagagagagatcttagctcaaattgtggcatttatgcctccgaaataatttgtggcgcgtaggttttacgattctacccgcccgctgttgattttttatttattcttattttgga

SEQ ID NO: 24923 - DNA, 1419 bp, Heterodera glycines
tcaaaaattttctcatgaaaaaaaaatttgggggaagaatttttgagaaaatttccaattcttagtggtgtgtttttaaaaattttcggtcgattcttaggggtgtatttttcagaagtttttagggccgattcttaggggtgtattttccgtttttattgcatttttgttaacaaattttccaaaaaatggcgaaatatgcataaatatgtacaaaaagccaaaatatgcaaatatgcacaaaaatctcgaaatatgcaaaaatatgcaaataaaagtccgatttttatacgcaaacacaaaaaagaaagggtttttcctactatttagagcatgtagaagccaggaaaaaaatatgcatttgcataaaattcccatccctagtgattagtaataaattaaataacatttgtaggtggagaattcccccacttatatgtatgtacgtgtataaatctcatattttccaatcaaaaagaatacgctggacttcttttattcatgatgtagggcttgtaattttatatggatataattcgtaatatgaccataaaatatggatcgaaaatcgcgaaatatggacataaacgttttcaaatttagggattttttatttgttcaatttagtaaaatttttttatttatttattatgagtagggcttcattttttaggcacaaaaaatcgcgaaataggcacctaaataggcataaaaaatcgcaaaataggcattaaatgggcacaaaaatcctcaaataggcattaaaataggcaaacaaaattttattaacgcttttaggtagcaaaacacaaaaacttcaattttataaactttttttgaataaagataaaattttaaaccaaaaaattttattaagaaaataaattttggtgtcaatttttgaaaaattttttcaattcttaggggtgtattttctgaaaattttttgggtcatttcttagtggtgtattttccgtttttattgcatttttgttaacaaattttccaaaaaatggcgaaatatgcataaatatgtacaaaaagccaaaatatgcaaatatgcacaaaaatctcgaaatatgcaaaaatatgcaaataaaagtccgatttttatacgcaaacacaaaaaagaaagggtttttcctactatttagagcatgtagaagccaggaaaaaaatatgcatttgcataaaattcccatccctagtgattagtaataaattaaataacatttgtaggtggagaattcccccacttatatgtatgtacgtgtataaatctcatattttccaatcaaaaagaatatgctagacttcttttattcatgatgtagggcttgtaattttatatggatataattcgtaatatgaccataaaatatggatcgaaaatcgcgaaatatggacataaacgttttc

SEQ ID NO: 24924 - DNA, 1171 bp, Heterodera glycines
  misc_feature (68)..(69): n is a, c, g, or t
  misc_feature (112)..(112): n is a, c, g, or t
  misc_feature (1158)..(1158): n is a, c, g, or t
agaaagtgtctctctattccgcaaatgaattaggtttcattaaatcaccttcctctaaaaaattattnntctgtcggacactatagtaaagttcttaaaccgtttgctatgncaagacagaaagtgtctctctattcctcaaatgaattaggtttcatttaaatcaccttcctctaaaaaataatttttctgtcggacactatactaaagttcttaaaccgtttgctattgcaagacagaaagtgtctctctattcagcaaatgaattaggtttcaattaaatcaccttcctctaaaaaatatttttctgtcggactctatactaaagttcttaaaccgcgtgctattgcaagacagaaagtgtctctctattccgcaaatgaattaggtttcaattaaatcaccttcctctaaaaaataatttttctgtcggacactatactaaagttcttaaaccgtttgctattgcaagacagaaagtgtctctctattccgcaaatgaattaggtttcaattaaatcaccttcctctaaaaaataatttttctgtcggacactatactaaagttcttaaaccgcgtgctattgcaagatagaaagtgtctctctattccgcaaatgaattaggtttcaattaaatcaccttcctctaaaaaattatttttctgtcggacactatactaaagttcttaaaccgcgtgctattgcaagacagaaagtgtctctctattcctcaaatgaattaggtttcatttaaatcaccttcctctaaaaaataatttttctgtcggacactatactaaagttcttaaaccgtttgctattgcaagacagaaagtgtctctctattccgcaaatgaattaggtttcatttaaatcaccttcctctaaaaaataatttttctgtcggacactatactaaagttcttaaaccgcgtgctattgcaagatagaaagtgtctctctattccgcaaatgaattaggtttcaattaaatcaccttcctctaaaaaatatttttctgtcggacactatactaaagttcttaaaccgcgtgctattgcaagactgaaagtgtctctctattccgcaaatgaattaggtttcaattaaatcaccttcctctaaaaaataatttttctgtcggacactatactanagttcttaaaccg

SEQ ID NO: 24925 - DNA, 1502 bp, Heterodera glycines
  misc_feature (10)..(10): n is a, c, g, or t
aatcagtcanccgcctgcggatcacgcgcggactgcttccgtagcccgtagtctcgccccacctactggccgccgtagtcgagtgtgcggcggttttttagcgcaatactcgatattcaaggctaaacgcttttcgtgcattatataagaagaaattttatttttattttttggtactgaagtgtccattttcactgggactcagttgtcccagtgtttagatggcgtcggtttgatttttaccacttttttctttaatctttcgacttaactcgtcaagagctttcgaatgatactaaatttgtgtgggtttgacccttttaaaaggctaaaattgcccaattttgtccatttttttcgacaaaaaaaattgcatttcgccatgaaatcgtcggttttacgccaaaaaatgatgatttctattattatacgccattttagcgtgctgggtcgtttcttaaaaactgccacctgggcgagaattaaactacaaattaaaacaactatatagaaatattttatctaaattttatgatataaagtttgtaaattaatatatatattccagtatttcttttttaaattttcttattctttaaaatgttcaccaaaaacatgaactgacaagcataacaaattctaaaaaataaactatttaaaatactaataaatacagacttttgttaatgaacattcagcactttcatacaaacatttgcaaaagcttttgtcgcaatcgtagcgttttctagatttgtatatagcataaatcatagtaataacagcaatcatcgactatatcatttaaaaatttataataaatttaaattttttttaaaccttttttaaagttgcaaaaccatattactggtgctataaagcatgagtcaaaacatgaagtgccacaataagtgctacaatatttctttgcaactttcaaagggaaattttaattataataagcttatcagtaaaaaatttaaataattaatttatcaagaaaaaatattaaatatatcgttgagctcatttgtaaattttattaactacaatcatcagaagcaataaatttattaatattttaattttactgagctccttctttcttgttttcatttcaacatttattaaattataattttttaactgttttataaatttgaatttttaaaatttcctaaaatcaaacatttaaaattctctaatttacagttttttttaattctataaatttattatatcaagtgcaaaaattacgtatatgtaataatacggtctttctttcatttttctccttaattacccccccccccccaaaaaaaaattcgatttattttcattgagcaacagcaacaaacacagatcagcagcttagaaggcagagaacacgagcagctataaacaccacatacacaattggcagagtcaatttcatgataataaaaaaaattgttatcattttaccgccaccaccacaacgactgtttcaatcaaatcactaa

SEQ ID NO: 24926 - DNA, 1032 bp, Heterodera glycines
catttcaacactgagactcaatcctccagcattccaatcactgggactcaacccaacagcatttcaatcactgagactcaatcctccagcattccagtcactgggactcaattctcctgcatttcaatcactgagactcaatcctccagcattccagtcactgggactcaattctcatgcatttcaatcactgagactcaatcctccagcattccagtcactgggactcaattctcatgcatttcaatcactgagactcaatcctccagcattccaatcactgggactcaattctcctgcatttcaatcactgagactcaatcctccagcattccaatcactgggactcaattctcctgcatttcaatcactgggactcaatccaccagcattccagtcactgggactcaattctcatgcatttcaatcactgggactcaatcctccagcattccagtcactgggactcaattctcatgcatttcaatcactgggactcaatccaccagcattccagtcactgggactcaattctcatgcatttcaatcactgggactcaatcctccagcattccagtcactgggactcaattctcctgcatttcaatcactgagactcaatcctccagcattccagtcactgggactcaattctcctgcatttcaatcactgagactcaatcctccagcattccagtcactgggactcaattctcatgcatttcaatcactgagactcaatcctccagcattccagtcactgggactcaattctcctgcatttcaatcactgagactcaatcctccagcattccagtcactgggactcaattctcatgcatttcaatcactgagactcaatcctccagcattccagtcactggaactcaattctcatgcatttcaatcactgagactcaatcctccagcattccagtcactgggactcaattctcctgcatttcaatcactgagactcaatctccagcattccagtcactgggactcaattctcatgcatttcaatcactg

SEQ ID NO: 24927 - DNA, 1781 bp, Heterodera glycines
tatttaacagggtggcaaaaaagacaacatcaaatcggtatcaatttatttttaaaattccattactcggatagaaagtcaattaaaaaagctctatcacagtcaattgcattggaataaataaaaaagggaattattgctttaagacgctttttgcgaatatttaggaaaaatcgtaagtattcgaaaataaaaagtcggaagatttcatcgcaacggaagaacactgattcctcagaagggaaggacaagttcgacaagtctttcggcaatttcgttcactttttcagtggtttcggcttcggcataaatccgtacaattggctcagttcccgagggtctgaaaaaagtcaaaaacatttcaaaaaatagcaaaaaagaatccaatgacctgatgaaggcacgtgctttgtcgaattcactgataattgcgtcaattttcgcctgcattccctcggggcgaattaacaccgtttcgcggtcggctgcggtctcaaaaatggaccgatctttcacctaattgtggtccaaattaaaaccataaagtagggggggggggtgactgaacctcaactttcttttggacattcggaatgtcggcgtaagtctcggccaaccaatcctggacggaccagtcaaagtgccggagaagacattccaccgctaacatatcagcgatgccatccccgacaacataaaagcacaaaaaatgcaatttaggagaaaagaaaagaactcacctcattaacaagttgagagaacattgacagcaattggatgtgacgaggaattatttcattcctcaaaaaaagagagattaattggcattaaaaaaggctaaaaccctgaaatttcttccaaatacgcgtaaaagcggtcgctgaagcacaccgtgccgtgcccattcgcttcaaaatagagaccaatgtcaaagttcaacgccgcctcctccaaatgcttaacgcccgtcttcgtaatcaccggttcaatgcccttaaacaaaatggaatttaaaccatggtaaatttaaaatcaccaatttttctgtgaagaatctggtcgaattcccgttggcataagctgtttgcacaacgccaaaagagaggggaattttgtggcccaatttttcagcgacagaaaattgctaaaaataaaattattaacgaatataggcaaaagaaaagaaagggcagagacttgagcaatgaaagtggcaaagagagcagcgatatggtcaccgtcgagcagaacgacgcccccaccgccgttggaattggttgccgaagggtaaaagtaaatgagacggtccgcgtccccatccaaagacgcacagcgcgaatttaaggggacagagtcaaaattggcggggattttggagttgattttgacaaagtcggcaccgcactgaaacgacggaaggaaatgcgaaggaatggaaaaggaattaaacgaattaaagggcacctcgtggttgagcagaagagactcagtgtccgtgttgagtgcatgcaattggacagagtcagtcgaagcggccacagacaatcccttggcgggggcggaaaacggagtgccgtcagtgatagcatcgaaatatttgttcacccaaagggcgccgacgccattggcacaatcgacgaaaagttgtttggagtagcgggaacaattggacaaagggactaactgaagaaggaagtaattaaacagtttctgaagtgaacatttgggtaggattttggtcactttgtgctttatccccctccccaaaaaacaacttcaag

SEQ ID NO: 24928 - DNA, 2238 bp, Heterodera glycines
  misc_feature (50)..(50): n is a, c, g, or t
  misc_feature (55)..(55): n is a, c, g, or t
  misc_feature (57)..(57): n is a, c, g, or t
  misc_feature (65)..(66): n is a, c, g, or t
  misc_feature (68)..(68): n is a, c, g, or t
  misc_feature (89)..(89): n is a, c, g, or t
  misc_feature (97)..(97): n is a, c, g, or t
  misc_feature (99)..(99): n is a, c, g, or t
  misc_feature (108)..(108): n is a, c, g, or t
  misc_feature (125)..(125): n is a, c, g, or t
  misc_feature (129)..(129): n is a, c, g, or t
  misc_feature (131)..(131): n is a, c, g, or t
  misc_feature (136)..(136): n is a, c, g, or t
  misc_feature (138)..(140): n is a, c, g, or t
  misc_feature (143)..(143): n is a, c, g, or t
  misc_feature (149)..(150): n is a, c, g, or t
  misc_feature (157)..(157): n is a, c, g, or t
  misc_feature (160)..(161): n is a, c, g, or t
  misc_feature (168)..(168): n is a, c, g, or t
  misc_feature (170)..(170): n is a, c, g, or t
  misc_feature (173)..(173): n is a, c, g, or t
  misc_feature (186)..(186): n is a, c, g, or t
  misc_feature (190)..(190): n is a, c, g, or t
  misc_feature (192)..(192): n is a, c, g, or t
  misc_feature (197)..(197): n is a, c, g, or t
  misc_feature (200)..(201): n is a, c, g, or t
  misc_feature (214)..(214): n is a, c, g, or t
  misc_feature (228)..(228): n is a, c, g, or t
  misc_feature (232)..(232): n is a, c, g, or t
  misc_feature (239)..(239): n is a, c, g, or t
  misc_feature (241)..(243): n is a, c, g, or t
  misc_feature (253)..(253): n is a, c, g, or t
  misc_feature (256)..(256): n is a, c, g, or t
  misc_feature (270)..(270): n is a, c, g, or t
  misc_feature (274)..(274): n is a, c, g, or t
  misc_feature (276)..(276): n is a, c, g, or t
  misc_feature (281)..(281): n is a, c, g, or t
  misc_feature (283)..(285): n is a, c, g, or t
  misc_feature (288)..(288): n is a, c, g, or t
  misc_feature (297)..(297): n is a, c, g, or t
  misc_feature (302)..(302): n is a, c, g, or t
  misc_feature (305)..(306): n is a, c, g, or t
  misc_feature (310)..(310): n is a, c, g, or t
  misc_feature (314)..(314): n is a, c, g, or t
  misc_feature (322)..(322): n is a, c, g, or t
  misc_feature (326)..(326): n is a, c, g, or t
  misc_feature (328)..(328): n is a, c, g, or t
  misc_feature (333)..(333): n is a, c, g, or t
  misc_feature (335)..(337): n is a, c, g, or t
  misc_feature (350)..(350): n is a, c, g, or t
  misc_feature (364)..(364): n is a, c, g, or t
  misc_feature (368)..(368): n is a, c, g, or t
  misc_feature (370)..(370): n is a, c, g, or t
  misc_feature (375)..(375): n is a, c, g, or t
  misc_feature (377)..(379): n is a, c, g, or t
  misc_feature (383)..(383): n is a, c, g, or t
  misc_feature (389)..(389): n is a, c, g, or t
  misc_feature (392)..(392): n is a, c, g, or t
  misc_feature (406)..(406): n is a, c, g, or t
  misc_feature (417)..(417): n is a, c, g, or t
  misc_feature (419)..(420): n is a, c, g, or t
  misc_feature (431)..(431): n is a, c, g, or t
  misc_feature (433)..(433): n is a, c, g, or t
  misc_feature (438)..(438): n is a, c, g, or t
  misc_feature (441)..(442): n is a, c, g, or t
  misc_feature (446)..(446): n is a, c, g, or t
  misc_feature (450)..(450): n is a, c, g, or t
  misc_feature (458)..(458): n is a, c, g, or t
  misc_feature (462)..(462): n is a, c, g, or t
  misc_feature (464)..(464): n is a, c, g, or t
  misc_feature (469)..(472): n is a, c, g, or t
  misc_feature (482)..(482): n is a, c, g, or t
  misc_feature (485)..(485): n is a, c, g, or t
  misc_feature (498)..(498): n is a, c, g, or t
  misc_feature (502)..(502): n is a, c, g, or t
  misc_feature (504)..(504): n is a, c, g, or t
  misc_feature (509)..(512): n is a, c, g, or t
  misc_feature (522)..(522): n is a, c, g, or t
  misc_feature (525)..(525): n is a, c, g, or t
  misc_feature (538)..(538): n is a, c, g, or t
  misc_feature (542)..(542): n is a, c, g, or t
  misc_feature (544)..(544): n is a, c, g, or t
  misc_feature (549)..(549): n is a, c, g, or t
  misc_feature (551)..(553): n is a, c, g, or t
  misc_feature (556)..(557): n is a, c, g, or t
  misc_feature (563)..(563): n is a, c, g, or t
  misc_feature (580)..(581): n is a, c, g, or t
  misc_feature (584)..(584): n is a, c, g, or t
  misc_feature (586)..(586): n is a, c, g, or t
  misc_feature (591)..(591): n is a, c, g, or t
  misc_feature (593)..(594): n is a, c, g, or t
  misc_feature (605)..(605): n is a, c, g, or t
  misc_feature (607)..(607): n is a, c, g, or t
  misc_feature (620)..(620): n is a, c, g, or t
  misc_feature (632)..(632): n is a, c, g, or t
  misc_feature (636)..(636): n is a, c, g, or t
  misc_feature (638)..(638): n is a, c, g, or t
  misc_feature (643)..(643): n is a, c, g, or t
  misc_feature (645)..(647): n is a, c, g, or t
  misc_feature (654)..(656): n is a, c, g, or t
  misc_feature (660)..(660): n is a, c, g, or t
  misc_feature (675)..(675): n is a, c, g, or t
  misc_feature (677)..(677): n is a, c, g, or t
  misc_feature (682)..(682): n is a, c, g, or t
  misc_feature (684)..(686): n is a, c, g, or t
  misc_feature (694)..(696): n is a, c, g, or t
  misc_feature (699)..(699): n is a, c, g, or t
  misc_feature (705)..(705): n is a, c, g, or t
  misc_feature (712)..(712): n is a, c, g, or t
  misc_feature (718)..(718): n is a, c, g, or t
  misc_feature (723)..(723): n is a, c, g, or t
  misc_feature (725)..(727): n is a, c, g, or t
  misc_feature (731)..(731): n is a, c, g, or t
  misc_feature (738)..(738): n is a, c, g, or t
  misc_feature (740)..(740): n is a, c, g, or t
  misc_feature (745)..(745): n is a, c, g, or t
  misc_feature (748)..(749): n is a, c, g, or t
tacctcttctaattacccttctacctcttctaatcaccttctaggtcttntaatnantattttannantgtgtatatcttttgtaagtnttataatngntataaggtnaagaaattttgaaaaangggngngaagngnnngantgaggnngtgaagnggnngaatggngngtnaatatttaaaaangggngngaagnggnngtttgaggtaaanaaagtttaaataangggngataagntnnngtataagggnaanaaaaattgaaaaangggngngaagngnnngantaagggtgngaggnagnntaanaagntaaaaaangggngngaagngnnngtttgaggtaaanaaagtttaaataangggngntaagngnnngtanaagggnaanaaaaattgaaaaanaggggtgaagngnntgattgagggngngaagnggnntaanaagntaaaaaangggngngaagnnnngtatgagttnaangaatttaaaaaangggngngaagnnnngtatgagttnaangaatttaaaaaangggngngaagngnnngtnnaagggnaataaaaattgaaaaannggngngaagngnntgaatgaggtngngaagttgtttaanaagttaaaaaangggngngaagngnnngtttggnnntaanaaaatttaaatgggngngaaangnnngttttggnnntanaaagtntaaaaangggagngaagngnnngttntgagggngngaagnggnngaatgattactacaaaattaaaaatcgggcgcgaagcgcccgtttggccccaacaaaatttaaatgggcgcgaaacgcccgtttggccccacaaagtctaaaaacggtcgcgaagcgcccgttctgaggccgcgaagcggccgaatgttccccacaaagtttaaaaaccggcgcggagcaccctttgaggccgcgaagcggccgaaagtcctccacaaaattatgaatgcgtcctcgcgatgcctgtagaccaaaatcccttatcacatccataaattcatttcaaaaccgcgcatgcactagcaacgaagtcctttgcgcgaagcgctcatgtcagcgcccgcccatatataccaaaagcatactgtctacaccgagcaactactgcgccacccgctagtttatactactatagagaaacgttgcagttcgtcttcaaaaacaaaatctcccggccgaaggccgggagcgccctgaaagtagtggaagggtcttacaactttttgaggcgcatctgggaaaaataagggttttccggtccggtggccaactgagtcccggcggctaatttctcacttttgcttgcgtttgaaggcccgtaactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttgtccagttcagtccccgttgaataactcattaggctttgacctgagcgcagggtggccagcagacttattgtagagctcggtgagctcgatttttccagattttaaaatttcgaaaattttcaaaatttttcgagctaggcctaaaaaacggttttttggtttttgaattttaagaatttttaacgaattttcccagaaaaacggagaccacttccaaaacatagtttttcgagctctatcgactggtattttttttggaaaaatttcgattttttcccggaaatagaaaaaatttttggcctgagcgggacatttgagtcccgggcccataactcgtcaggggtcggttttagacaaaaaatgccttagagcaaaattgtagagctttttaagatctatcgaacggtgtgctatatgccctgaaaatttcaaaatttttcgagctaggccccctagaaattttcaaaatttttttttcggacgaaaatgggggtgaaaaatatttttctggggtaaaataaggtgctgagtacgaatatgatgtctattttaagtttcataatttttggaattttttaaaaatcctttattttttggcaattttttggccctcgggattttggcctaatatttgaaaattcataacaaatcgaagggttgatcaattttacaggaataaagccttaaaaatagagaaaaataaggagaattttatgggatttatttgagtttttgactctagag

SEQ ID NO: 24929 - DNA, 1679 bp, Heterodera glycines
  misc_feature (63)..(63): n is a, c, g, or t
gtacatcgatcactccgtcatcgcttttcttcgttccattcaaagattttcgacaaaagaggnaccgatttacatttccctattccatcatcacactctacgaatggccagcggatttgggatgtttttgttcgtgaaatttggccaattttttctgaaaacattcgctgtttgggctttaccggtcgtgatcatttggacaatttgcgtcgtcgcacttcgccgacaattctcactgatctcaaccaattggtttcaatccattcatttggtctgtcgcccgctgcgtttggtgatggttttgatgtgccaaattcaacaatttctgctggccaagcattgtccaaatggttgcactctccgagaaaagatggccaacccaagcgatttcgttgtggcagaaatttgaacgcacaagcggacttcgattgggtcaacagtttcaaggaggtgtggtgcggagggaggggggagcagggcaaaatgtcgccgcaaatttttcttttaattttaaaaaattattaaaaatttagttatctagcctaaatcaaaaaaaaatcataaataaattctaattttttttttattaaattcaaggaaatgtaaaaaagtttcaagtttttttttctgggaattctgcaattagttttattaacacttagtttctaaaatgagttgaaattttcatgaaaaagcggaaattttttatattgttttccatacattttttagggggggggtcgaccccccccccccccccccccccccatcgctcgcaaagggggccagcgaggggggggggcggtgtaaaagaggtggggggaggtggttcgcggcgagttgggggtcgcaaattttcgaaattttcttaacaaattcattaaaaacccccaaattttccccggcggcgcctatcggcactgccggaccccaaaaatcccaaacccccccttcgcaaaaattttttccgacccaccccccttttttatgtatgttgttttcccggcgacgttttggggcgtacccggtctgggatggggcattccgaggtattttctgaaatcagaatcccgatcccaaaaaatgtcgtaagtcggaagtttttgaaaagttccgacttttatcaaaattcggaaatccgaattctgtgccatccgtgctggtgtggtcccacatttttggcaaatgactgattgttgttttccaatcaaattgtttagcattttcttcgtgccaatgccatttcttccgtcagttacgaaattcatttttctgttcgtgcgccgtcaatgcaaatggtgccatttgaattggtgaacgaatggacaaaggaaaagctgacattggccaaagcaaatgaatttgacaaaagttggataatgaaacgatgcaaaattggggagaccacggcggttaagcaacagcagaagaaagatgaaaattgggacaacaattgtaacaatgtgtacttttggctttttagtgccaataattgcatcgggtgagcaattaaaaaaaacatttgatttttatccaatttgaattttgcgcttaattaaggcctttgtctccgccaccggcagaagaaacgggacaaagcatcacaaaagggcgaaatgagtgagggacaaacgaacaaaaacagtgatcagctgaagaagaagaagaaatgaattaat

SEQ ID NO: 24930 - DNA, 1688 bp, Heterodera glycines
tttaaagaatttttttcgaattttccaatccgtaaatctctcattctgcccctccatttgtgttaaggtgattagcgtacaaaaaaacagcggagaccaaactttcttctgctggtgcgtcattattggcactgtaagttttcaaaaaaaaaatgttaatgccgaatactgaccaactctgaaatttgtttgtatacatattatttatatcatcgagatttgtgtctcgatctgtttatgaaagaatccgaaagaattttcggtcggcaacaaacactgtcaagagttttaggcctgggactgaaatggcaaaaatgaccttttggactgaactattcgtcaaaaaagacttgaaaaactttaatggaccatacatagcctcgtttagaagcatccaaataaacaatcttggtatcattcgatagccccaagagtcctctattagtctgcgaaattgaaaaatatttcatttagttgcacagaagatatggccagagaatttcaaaagccttttttggccataatttttgaatgaaacgaatttttttgaaattttgccagttattatagaactcttagagctatcgaatgataccaagatagttgataatttgaatgcttctagaataaaatgtatacaaattgccgagagcacgtgtcagtatcgaaatttgtatcaaaaattgcactccccctccccccccccccacaattttaggtgttgcccgtgtcatttttcgtgtggctcttctcgaaagcctttggtaaggatggttcagcttcgttgcagttgtttttaattggtgcggcaatcagcatcttcgtggtggtcatggttctatgctgtatttgtccaggtccaataaacatgcgccatataattttacataatttttttttcattttctcaaatggaaaacgcaacgattttgcatggggcggtcggtcactgatcagtgatcaatctgaattttcgaaaattctttataacccaacggatctgggatttggcattggtcgaaatgctgtcagaaaatcagtttttccgaccctaaaaacatctaaaaagcgcttttgtgcaataaacgtgaattttggtgaaaaatgagttttcgacttttggttcgaaatcgggtccggggttcggaatttggcaaaaacccttttttttgttggtttttttaatctaagtatttttggcacaattttgaaatttcgttacagacaaagacggtcacagttcgctggaagtgctgtacaaatgttcggcgtgtggcaaaaatgtgcacagaacttatgagtgcattagtacgtacagtacagcaatttttaccgtatcccctctcaaataaatacaataaatcaaattgtcccgccgctttagttgacgtcacttacaactggtccggcggacgacaccgcgacacctttcgctaccgtaatcaaacgtacagtgtgtggggaaagtacacggcaaatgtcataaaaacggtattgcggacgcggatgaccatgaacaactttgaggcggtggagcgcgtgatgagcgttgttcagacggacaattattacaagacaagcgatgaatggaccgacgatttgataaggcgtcttgaataattgaggcagaaagccaaatggcaacaacaatttttgtgtattatatttgtgtatttctcgtatatact

SEQ ID NO: 24931 - DNA, 1598 bp, Heterodera glycines
  misc_feature (8)..(9): n is a, c, g, or t
  misc_feature (17)..(18): n is a, c, g, or t
  misc_feature (31)..(31): n is a, c, g, or t
cttgcatnngcctgcannggtcattagaaanatttagtcaaaaaatatatttatattttaaattaattttaatctaagaatcttgaaacattaaagatgtatttaaaattatatttttactctctttactgaattatttaatttttgttttaattttttaattttaaaatttgttttatttaattatttaaaaataatttttaattatttcaccttttcgttgtgccgtatttgttcagctccgaccccggcaaacatgagaacgaatttgtgctgatctgtgagtaccgaaatggccacagtctgagagagaattttatgccaaaattaaaattcaatttttgtcccatgacaaaacaataggctcgtaccatatgagaacaaagccgctggttggtctcatccaatggattgtcacaagcggaggccttgagggaaagggcgaaaaatacggtacaccaaactataagcggttactgtaaaggctgcaccaaaggctaaggagaaagaggaagatttttggaaagtatattattaacaaatttttttgaaaaaatgccattttttcacctccgtcgcctgtcagcaccgcggactcacaaaattacgataaaaaaactaatttgcttttaatgagtttttctatcggaattttttgataaaaaaataaaaaatgaaaattactgattaaaattatgggaattacggcatttttggaccccaataattacggatacggatttccgtaattgaaaatccagttatgcgcttgacccgccccctttttttcttatttaacagtaaaattgtcaagcggttattaccgtaacccggaagtagtctctgcgcgtcagctgcacaatttcgctagccttcttccgcacaaacattttgcctgttgttgtattgatgccgaaaaaggtggcatctgttgcactcatcgatggcaccggtgccgcggaaggaatttgttcatccaacgcataagtgaccaatccgttgccgctttccaccgtatccacatcacgggccttaacagtttttatacagtagcggtgagtgctttactgttgccagggatttaaataaagtgaattaaaattcatggtaatttaaattcaaataaatgttaaggggcactgtctttttatgctgccttaaattatataataccaaaaattgttaaccgtttattgttcaaattttaatttagcccggctaaatgggacattaagatgagctaaaaagcggctttttgtggggttttgcaattttttaaaatgaattaattttttcactctctgtgctatattaaaatgactaattctctgcttcccaggcacttcaacagttttgtttgagggataaaggaatacggcacaaagccaatagttgtaccaatgagagaccatggcttttgcaatttctcgtatttcccccatttaccgttagtgcaaagaacggttagttggcctccatctccgatggtatcaccgcaaaaggcacgtccaatgctcgccagcggatgacaatggcattgccgcaggttgtgccgttttcgccctcatccaccacaaattttggcttgtcgtcattgg

SEQ ID NO: 24932 - DNA, 905 bp, Heterodera glycines
  misc_feature (329)..(329): n is a, c, g, or t
  misc_feature (375)..(375): n is a, c, g, or t
  misc_feature (435)..(435): n is a, c, g, or t
  misc_feature (451)..(451): n is a, c, g, or t
  misc_feature (464)..(464): n is a, c, g, or t
  misc_feature (479)..(479): n is a, c, g, or t
  misc_feature (523)..(523): n is a, c, g, or t
  misc_feature (548)..(548): n is a, c, g, or t
  misc_feature (566)..(566): n is a, c, g, or t
  misc_feature (686)..(686): n is a, c, g, or t
ccccccccccactttctctgttttttcacgctaataaaatattgttttaagtcgattttcatgtttttattgcgtttccttcaccctactatcagttttagaaaaaatcttattttttgggtgcgaatcttagtttttgagtcattttgttttattttgaaaaaaaaaacttgggagccctgatttatattataaattaaaaattttttttgtaaataattcaatattaatttataataataattaaaaacgaatttgatgccgagtcttaaaagataatgtaaaatatgaaataaaacccaaaaaacaaaaacctttaacttatttantttataattacattatataaaacaaatatagaaacaaattattatnattttctatgtttaaaatttaaatatataatttagccaggaaattcggatcagctaattnctttttcaaggactgnttttaccgatttnctaaggacataaggnggaaaataccattaaattcaagaacatttaaattttatcttatngcgatcaaaaataattaatttcgantgccggtaggggccattnaggaaaaattataaaatttgaagaatttgttaaagtattataaccaaaattattcatttaacgcttttaggtgtgtttttgaacaattttttgaaaaatagaaaaagagtttccggcggnactgatagggccggcctggaaaaaatttgaaattttggtacagtttagtaacagatttttcaccaaatgtagagttgagcggtaatcggtaattgtaaaaaaaccggtaccggtactgaccggtaatgcaaaaaccggtaccggtacgataccaactttttcctccggtaccggtaccggtaaaacccgtaattttccaacgtaaaatttttggacaaa

SEQ ID NO: 24933 - DNA, 1927 bp, Heterodera glycines
cacaaattaaaaacaaaaaaagaagcatttttgtgacaaaaaatttttttaagaaaagaaataaatgcaagttaaaagcataggtatgcttaaaatccacgctctgtaaaaagcacaaaggagcctctggaatcaaaagaaatttgattttttatcttcttggattttcagatcccactataatatttattttcactaattgtggaactatggatgaagaacaaatttttcaaccttttgatgaagacaatatggaacaaagtcataatttcatggtataaacattcacccattattttataaatgttaattggcaatttcgaaggattatgaaagtggcacacatgacgacgcaataatggaacagcaaaatgatgactgtatagaacggaaaagctctatggtcttacaagaatattctgtgatcgaaagtgaggaatccatgctggacccacacgtaaagccaaaagcggtaagggaatcattaaaggcaaatttgtgggaatttggattttaggttcaccaatgtcccgtatgtaacaaaatcttcgtttccttcaaaggtaagtttatctttgcttttatggagctatcaattctttgaactcaggccttcaacaacacgccatcattcacacggatcagaaaccatttgaatgcgacatttgtcgaaaatcgttcagattcaaatccaatttatttgagcatcggtccgtgcatacgggcaccaccccgcaccgatggtctgtttgatatttctaaatcatgaaaaaatgtaatttttttgtactctcccattttcagtccgctctgtggcaaaacgtgtcgtctgaagggcaatttgaagaaacacttacgcacccattgcacaactaaagaggagttggaagtcgcttggcagcctttcgcttcgaacagacgcgccccagcggaaatcccacaagatgccataataatccgagcaaatgccgacccttccacgctcttcacgccatttgaacagcctaagaaacagcgcaagttggggctgggcacggacgtggcgtattgggtggacagaatcaaacgatgtgagctgttgccacctgtgccgatcagcagtaaggtgggcgagttttgaatttcaatgctcacaatcagcttttccatgcgacggagagcagagattttttgttacaattccgttgatatgatttaaatgcttgtttttcattgccatattttgattttaatcagatgtcaagattggctaatctcgtcaaaatggtcgaggaggggagtctggacatggacgggttgtatcaccatgctgggtctgttgatcaattcacaatttctttatttgttttttgcagtgctattccattcgagcgatacgaatgtccgttttgcaaatcagttttcttttcccccattgaatgtgcagaacatatggtgggttatctacgcgacgaatgggcgggggagggttaatgcggaaaactagccaaaattttcggaaaatttcctttccccactttgccgggttaatattttggatagtaaattattttcaaaaaaccttaatatttttactagtacactttaagaagttagaaaataaacaatgcatgagggggcgggggagcgtgatttcgccctcttttacacatgctcctcccactgtgaaggattcgactatgttggaccctttgctccctccccatttatttttgtaaatatccctgccgtatcccccccccccctctccccctgaatatatcctccccttcctatatacattttagattttattcttctaaatttggtttaaggaagcggatcatccgaatgcacggaaacaaagacctcacttctgcgatatttgtgtgcggtcattttccgaccgacaacaattggccacccatcaagagcatcacaaacgcat

SEQ ID NO: 24934 - DNA, 1275 bp, Heterodera glycines
tcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataatttttcctgcaccgaaggtactcactcggcct

SEQ ID NO: 24935 - DNA, 1012 bp, Heterodera glycines
aaaaattcgatgattttgtcaaagatttttcggaaaaagccaaagaatgtctttcttttctaatttttgaaaaacacatgaagcagccccatcgcagtacaaaatttgttggccgctataactattgatggagaggcatcgtagaatcctgaaacaactaccattcgtttcctctccactacaggaatcgattgatatacgataagaatcgttaattcttttttttttaaaaaaaatcattgacaaaatcactggatgaaaatcattgattaaaaatcatagatttttgcagttttgacgtcagattcttgatcagcgcccaaaactgcccctagaatttagcttctttaggcgcttttggctaaatttcttaacggaaatgcactggcatttttgatttgtctgaaaagtatacctcataaaaattgacactttaaagaaaaattaaaattttaaaaaagaatattattatttaaaaaattttctaaaatttattattaaaatttttcaataaaattaatattcttctaaaaattaacatatgaaatgaaatatattgtagtaaaaatgaagccgcaaaaaagcaaggcatactgtaacagtttttttcaataaatggcttctgtatcacaaaatttccatttttaaatgcctcacaatttaaaaatgatgccatttttaaatgttgatttttgatcgtttgaattttaaattaaatttgggggtgttccgtttcgctgcactcatttcccccgagggcacacgcttttcaatttccaaaattggcatggcactccaattaggcacctaatttctattcttggccatcttcattcacttcgtgtgctgtgccccattcattttcaaatttgcacaaaattagcggcgtcccataaaaggggggataaagccggataaagccgctgggggtgcaaaaagggggtcacgcctatctcattagcactgattattagccccccacgacggagggcaccttttcttttattcattt

SEQ ID NO: 24936 - DNA, 1327 bp, Heterodera glycines
caatcatttgggcaaattttctattatttttttttttttgaaatttttacttttgtgtaatatgtaaaaaacaaataaaatgatacaaatttcacaaatgtcgtcaaattacactcaacgctgctgactaattagtgagtgaaaaacttgaacgaactttggccagcttttggggttccacgggcttctaattacccataaaatcccccagcggcaaattttttaaaaattgtaatttaatgttcggaaaatttgcaaaatttccgctcacaaattatgatgattaatcatcatttaaccagtcacccaccaacactcactcacacactccgtcaaaattccatcaaaaaattaaggacaaacacacacccaaatcagtcatttaaatcagagtcagtcattagtcgtccaccgctcgcgaccgacggattgtgtgggcggtggttggttgctaatgggctcatttaagtcgtccgtctgtgtacacacacacttaattcatccataatacatatctaatcatcatcattagtgcatgtggaagataataatttatttttttgggcggtgctcatttgtgagtcagcgtccgtccgtcacaaaatcaatgtcagtggtagcaaaaattggggggagcgctaatgatgatgatgatgatgatgttgcgtatttgcgtgcacatacgtaccttattttgatcagcgacgcaacaattgctgctgctggcggcggatggttgtttgatcatttacggaattccgatttatcgaaaaaaattttgctggagggggggggggagggctcgagtttccgaaccaagaaaatttttggggcctcggattttacgaattgccaaattgtttaagtccgccgccgaaatttttgtactcttcggaattgcgctttgccgggaattttttattcatccctggcaattccgattccaattcccgaattttgatctcgagttttaactctttttttaaatccatgaaataatttttcattttattttcattttcccattaaaaacaaaaatcattttttatctttccacatcgatctctaataataacaataatatgcaatatgtatgcaatgatgataaaaagctctttttgtaaacatctaagcctcttaagtacccggacgaatgatggaaacatttcccgtaaataatggtggccaaatgtatttatgggatgatggcaaacaatctttgcaaaatttttttttttcatatttgacaaatatttttttgcaatttttatagtgttttgacatttcaaaaaaaatttggccatttttttaaatttttagattaaaa

SEQ ID NO: 24937 - DNA, 2176 bp, Heterodera glycines
  misc_feature (911)..(911): n is a, c, g, or t
  misc_feature (950)..(950): n is a, c, g, or t
  misc_feature (980)..(980): n is a, c, g, or t
ctttttagtgcctattttacgggttttttgagcctaaagcctacctattttggcagttttagagccaaaaaatattatccctactctattattgctacttataagaatgatttaaccaggtacaatataatcgtcaataaataattactaattaccttgcgaattaattgtccaccattattcattgagcatttcgcaaaacaatgttcagccaatcaagacgtattgttttattggttttgatcaacatatgcttttctggtgaagacaatgtgaatgcaatgcaatattggaataataacaattataatcataattataccaattttaattatgctaatgattctaatgagttgagcaacaatactgaatcaatatcatcacaaattttcatgggaaacattcaaatacgaaaaataaactctaaaaatatatggaaatacgaaccagctaaaaaagtggtaaatgaaattactgaattaaaataacttttaatttaatactttaaatcttgattttttttcattatcaattttagtgtattgaacttttttgtggataaaatcatataaacaatggaatttttactgatcaagaaggtaaatttgaaaaaatttggtctgatgaacaaattgaaaaacttgaaaagtgcaaatttaatattcacattggattctacaaacaaagagtaagaataatgcaacaaatttaaaataataattattattagttatttagttaaatgttttcaatctttcaaataatgaaaaaacaacaaaaaattttaaggaaacgagtttacaaatgttttaccaagagcagcaaattatgaaagtttttgcgaagcttgagagcttcagttgccttatgtttttcaaaaaaggagatagtgtagaaaccaacaattttanagtaaataatcaactaattaattagcataagtcatttanattattaaaaataatttgttataataattngttttgtttgttcaattcttttaatagattgactttaattcaaagaacaaatatgctaatattaatgatgccgacgcaaaacaaatcattgatgacaatctaaacttagattttggcgctcaacaaagtcgcatttttagaaatatctttcaaagttagtgaaaaaaattgtattaaaaataaaataattttcaaatttttaaattaaaattatgtataattattttaagaattagaaggcccaagcgacggagcaagctcatcaccagcatcagacgagaacaaaaataagcaaaaaggcaagataatcagttcattattatcgttgggcggcaagaacaaagagaaaaagaatagacagccgaatgttattgattttatataaaaaggacagtaagggatgagagaagatacagtaagaatcagggtaactattggtgtggagatattgccgagtatggaccacttcagtcccaaaaatgattaaaacacaaattttggcgtttgtactatttttccttatttcaacatttttttggaaaatttattaactgaaatgaataagaaaaaccaaaaatacacccgccccctaagaatcgaccaaaaaaatacacttctaaaaactggaaaattttctcaaaagtcctttttttcttgacaaaatttttgatttaaaaaatgttaatatttgctaagaaaatattagaaatagttcattaaaaaaatcaggaggaccgaacttaacattttggattcttttacatgtgtattcatacaacaataaaccctaaaataaaatatgttttttttataagtagagagcgcagggaaaaaaacatctctcattttggcgtattatttctttatccctattaataaagaaaaattggttaacttcgtgacgtttagttttttgcttaaagttaaatccgcttcaaattttgccttagataaagcttctcatttccaatcgctttcaaatgaggtgctatgtctattcctaaaaagtgcaaaaatcaaaaatctaatttttcctataatttttttatcaaatttttacattttaaataaaaattataattaaataataaaatttacttaatattaaagaaaatccattaaccagattacttagtattttaaagtcaattacttatggactaaaattaaaaaattaaagaaaaaaaatgaaatat

SEQ ID NO: 24938 - DNA, 925 bp, Heterodera glycines
caaaattccaaaatgtccacctttcaatttttcaatggtcacttttgtttctctctttgctcatgtttatgggttcccaattttgttgatttattcggcaccgccggccccgcaaataacccttccaaattgctaattttatgtgaaaatctgttaaaaatgtctaaaatttctaatttcccaccggcaggggcctatcggcaccacgggagcccaaaaatttactttttttcattaaaacaattggctttaaatcgcaaaaattagtcacttttttggctgctgattctgaaacttttcaattgggagccctgtcgccgtacgaaggaaggaggcaccttcaacatggacgtcgctttgtgattttgaagcagccgtcattgaccatttcgaaaggtaaaaggtggacaaaaggccgacaaaataacggcaagacaaaacgacacaagtaaagtgaccatcaaaaaccttcattttatgaaaaaaaaatggaaattttttcatttcatagtgtcaaaatctttaaacaaaaatgttttgtcgtgtggcatgggtattgtgtcgggtttaatatcggtcagacactgagtcagtaatcgattgaaaaaactgagaaaattagaaaatgtgactttactcaactttactcaaccaaatattttcgttagcgacgtttattcattcattaaccatccctcccctttcagtgctgctcttcaccgcttcgcttctcttctctgtgaccccaatccgaacagttcgattctgggtgggcggaacacggcgggggctggggaatacacagtataattttttatggttaccccccccccccccccccagttaaaagagccaccatcgctcccactcgacgactccgttcgccgctggtgaactgttgcaggacaaccatgtgaccgacgct

SEQ ID NO: 24939 - DNA, 2233 bp, Heterodera glycines
atgtgcgttcccgactttttgcattttgttgcgtttgcattcggctgaaagggctgaaaggggcggcgagtaattaaattgaatttaattgtttattgtttgtttctttgtccactcacttcgttttggttcgtttgaaatgcgttcgaattggccaccatttgctgctgaatgttttggtccgccgcatttgtggacatcttaaaatgtcaattcaatttcaatatttaatttgccgttaattttcgtttaaaatttccttttcattattaattttccattttaattttcattttccttcgcttttgtcctccttttccccacctgttgctgaaaatggggttgactcatctctaccagtttcagctcctcttcgtttatttgccatgtgccggggaaaaacatttggtggtgggggtggtggtaaagctgttcaacggcacaattttggtggagggcggcggacggattcaaactgaaaaaacgaaatgaaaaagggttttggcatttgggattttcatttttcaaaattatacccgttttctccgaacagtccgctgccataaaatgccatcgccgcccggggacaccgccgccaaatcgtccgttttctcgcatttcagcacatctatacctcaaatacacctatagtaattcatttttgaatttcccgggttatcccccaccctttttttccactttccccctcgtttctcccgtttttcctccttttccggggatttgtttcgtccttttgcccacctctgttgctgatgctggcgttggtgtccgacagcacggacatggaggacaacagcccctcgggggacaccagcgaagacgaatcggacaaattcagaacggaagcattgcccgaggcattgtccgggacggtggcggcattcattcacacaaaagacggaaagagagaaggaaaaagtgggaaaactgaacaaattgaaaaatgaactaaattaataagtgtttaatttctttggcaccttaaaatgcaccgcaaaaggcaaaaaaggcggagacgacggaataatttgggaataatttgggggaatgagggcaatcggaggaaaaaggcacaaattaacgaaacggggagtttcagctggacactttctacagtaagctgggatatgactaatgaggaggacaaagggaaatgaattaaaatgagacaattgaaaaaacaatgggacaattaaaaatgcaattgaaaatgcgcgaatttgcaaaaaacagcgaacagtaaagaacaatcactgcacaaggtttgttttgctgttgagagtttctctttcggatgcattgatctcggggaattcgctgcgccaaatttgaattaatttgactgtgtgggcggagggggggggcaagcgaccgacgcgcgagtcgccaaatggcgaacgggtcgagagtctcgaggcgggcgcggggattgtccccgcacgcatccccgaacaactttttgaccaatttgacccccggtgcaattccatgttctcagcgtgcgccatgggttggcattggcttaaggcccatccccgccgtttgtccgtccgtcccccgccctttcggggtcaccttcccttccccgtttcccttcccttccccgcttcgtttttcctgaaattccctcccaaagtgtcttcttctttcttcgcttctcgccgagacgaaagtgcgcccgaattcaccgcactttctgggttatctgctcgtccgtcgatgatgttgtgttactcaattcgggaggggaggagtgtatagtaaagctctgcctgtgaatattttttatgatttttaagattggccaaatttattaagaattgctccgaatttaggaaattttaccactttaagtccccccaaatttcccaaactttaataattatttcgtcctctccttttggcactcgaactctttttcaaaaattttgttacaaaacgaggaccaggcgagtttgattttttcaaatttctttaaaaatttggatttcgtctaacacaccccttaaccaattagttatctcaatcaaatccgttttttaattaaaaacaaaatttataccatttttctttttgcaaggaaagagtttcaaagagcggccggtcgcgcaatgcgttgaatgagcaagaattttctcccggtagcacagcgtgttcaccgaatctgccggaatcacctgagagcttagcgcctggccaacggacagggcaa

SEQ ID NO: 24940 - DNA, 1134 bp, Heterodera glycines
tggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaatgaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccata

SEQ ID NO: 24941 - DNA, 971 bp, Heterodera glycines
aaaaatagataaaaaaaccgatggaaatggatgatttaaaaaaaaataaaaataatatttttagagtttcgaccacctaagcaaggccttgctcgaggctatgacctccaaacagaatcccagtcagaaatcacagacggatttgttcatctaccgcgtgttccgttctctcccggccaaagacattcccaagggtttgctgaaggatttggtggccattctgagcaaagtcacaattttgtctactttcccccctactttttaaccttttagcatggctctgatgccgactctgaagtgagggactcctcttttgctgcgttgggtgccattatgaaatgcattggggaaaaggccttgggctgtttcatttcacccgaattggccaaagatgcgaacaaaatggccaaggtcgtttcataatttttgttttttaataatttctttcctatttttagattgctgaataccaagacaaggcaatggcagaagctgctgttataacacaggtaatttgtcttcgtgtggtgtggaaaattggaattttccgctttttgttcgattccgggtttggtgtttggaatgaatggcgagcataaatatttacgaaatttactaaactaaattgtaagcatcaagttcaccaaactataaggtgtctagtgttttttaaatatacttttagaaccaagccagtgcccatgccaatgatttgtctggcacttcgtcctccaatcagcagagcgatgagtgcggcacccaacaaaatgcttgtgaaaatgaagttgatccatgggatttgatggagccagtcgacatctcatcgaagctgaacatcaatttcgaaagcccaaaatggcaggaaaggaaagaggcattggacgcactgcaacaattgttgttgcaatctccgcgactttctgattcgccaaattaccgggaggtcatcgaacgcttagcaaaggtatata

SEQ ID NO: 24942 - DNA, 2412 bp, Heterodera glycines
  misc_feature (52)..(52): n is a, c, g, or t
  misc_feature (127)..(127): n is a, c, g, or t
  misc_feature (132)..(132): n is a, c, g, or t
tagaaacactcaggctgtctttaaaatttttgacagccattcaaaaattttntataatttgtgtttctataatgaaactcattgaaaatttagactgctttgcctctaaaaaggctcttgagagatntattntagaatgtgaaaattttattttcattattattttggcatttctttagcatgaattggtagatttattagtgctgacaattatattaagtagaaatcactcacaaaggaggggtcggcaagtgaccgtgggatttccaaatgaaatttggtgggtggatagatgacgcccaggttctattgtgaaattttgactatttttgccaaatgagcatgagtgccgagatatgacgtgccaaacttttttaatgaacaaacaaattaaataattatttgcaaccattcgcattgtcaaatggtgtagaggtaatgcgttagtaacagtcgcaccaggttcgaatccgctatatgcaattttttttttttaattttttttttgctttttatgaaaagtcaattctcaaaagattagttttataaaaagactttatttttaattttactttttattttggtacatatgataataaaaaatatttttaattttactttcattttgatatgtacataagataataaaatatttaaaaaatacgacaggatatttattgcacctttatgtttaatgtagtaattttttgatttctaatggaaaaaaatttaaaataaaaaatatgtttttactaaaaatttttagatagttaactttgcatgaaaatcaaaaataaaaattataaaataatatatacatgcatgggattcgaacctgtgacataaaaaagatttgactaacctactacctctacaccaatggcttctttcttggccaaaaagaattatatcttttctaattaaaaaagcgtaaaaactttggcacgtcatatctcggcactcatgctcatttggcaaaaatggttaaaatttcacaatagaaactaggggtgatttacccacccaccaaatttcatttggaaatcccatggtcacttgccgacccctcctttgttagcggagaattgcctagagcattcatcctaagtattgtacaggaccgggacctggtactggaaaacacgtacaactaagtaccgaagacccatttttgaccgggaccgggaaaagtcacggctttttctcgggtttcccaggccccggttttgcccaaaattcccggtcccgtacaacttaccgtattttctctaattatatgcccgtctccattaatctgcccgtctccaattatctacccctttcgaagtaggttgaaaaataatctccctgtctctatttatctgccccgggagataaatagaatttttattttttcgaaaaaataatttctttttctattttataaaaattaatttgcttcaattttgtagcttaaaataccccccataaagaccaacctattttagaagattttggtgaaaaaaaattccactcgaaaatatgtgcacctccatttgttcccgaatcccaatgagtagggcgagaatttaagtcaaatgactttttttgctgactctaaaggccttatgtttggcatttttcgaatttttcatgtaaaattcagaaactttttaacaaaaatgcaataaaaatgctttttttttgacacgatgacattttttggagacatattcaaaataaatttcaaaaattttccactaaataaatctgtcgaaaaataatctccctgtctccattaatatgcccgtctctaattatctccccctttctgagggggttgaaaaataatatacccgggcatataattagagaaaatacggtaaatgctaaggtaaattgtagagattttctgctctttcagacaagcctaattgttttaacggaaaatttttaactccctagaaatttttctgaactaaatgtggtaaattttacacgtcaattcacacttaaaattaacgtttattcgtgatcatatgcttcaaaaactcgtgtaaacaagattcaggattaggtgtttccctttgatttttaataaaatttgaatattattagtgggcacaacagtaaaagtaccaaaaattttaatttgacactctgctgcggctgctctcagatttttggcgcttgcaaaggcccagcgcgttgaagaatcaacttacataatgggaaaagaaaatgcatgcaggaaacagactttcttttttgtgtttgcgcattaaaatcggtacttgtatttgcatatttttgcatgtttgccggagatttcatcagcgagtgatttcttcattaattgatgtcgttagagaaaatgatcgcaaatcctaccataccataccatatcgtactaacacaacctaacataacttc

SEQ ID NO: 24943 - DNA, 1146 bp, Heterodera glycines
cccccccccccccccccccctctcgccttaacggggagggcatcggtacccatccattccatcaatgctcaaaaggttcttctgttcgttcgtcccctcctcttccatcatccgcacttcttcttccgacagtttcttcattcattcatctcttctccttttccccgtcgtccatcgcttttactttccgaaaaatgtccataaatgaaaagtgcagatgattttgtctccgctttatccttttggcactttgtccatttgtttcattttgtcacaatgttttgccaaattcttaatccccattaattttccgtttcttaggcttttcctccgattgttttgtgctttcttctccctgccaatgcgtcttcttccgttttgcttcttcctcctcctccccctccttttgtgcttcttccttttcacttttggctcttcttctccgatcgtcgattccgaaatgtttctgcccccgcgcttttacagaacaatttggcccattaatgcgaaaagaagccgtgagtaattaggcgaagcatcattaaactaaacctctttatgctttagcaagcatcggactgtccctggccgaatatatggccgcaggaaaccaaggccaggagcaatttcatttcatccccggaagcggaaggaggaagtgaatgccaaaaacggacggaagatgaagcggaagagcggaaatgaagaagaagaaaagcgaatggatgaaaagaaacgccggggtggaatttgtgaaggatgaacaagaaataactgctgttgatcgattgacccttcagtgatctgatctcattgaatatttcatgcatttttcacataactttatcctttccaaccgatggtgagcaaaagtgagcgaataaatgatggttggccgcttcttcccctccccgagcccattcatccccttcacccatctttatcacatttccatctttgcattcattttgcattcgtttttttttgtatcacttccttctataattgctttttcccttcttttcggcgctctttttttgtgaccgtcgcatggccattttgcgctaattgagcctaatgaacctgcgacgttccctatgggccccaggcgacgttttccccaaaatgaaccaaaaaatgaatttt

SEQ ID NO: 24944 - DNA, 1291 bp, Heterodera glycines
  misc_feature (13)..(13): n is a, c, g, or t
  misc_feature (1231)..(1231): n is a, c, g, or t
atgatggcattantgggtgaaaattatataggtacataccttctgatggatttgacgggggatcaatttcattatagaatttttgttcgaattcaggtccgggattcgaaattggtcaaaatgtttgcagcaattttttttaatgtgaaaatttccgagtctcatggcaaaatttgccacattttattctttttaatttaacttagcaccgaacttattaattttctagtcaacatttgctgggtgagccttccttccccaaaaagtttttgataaaaatgcgccgtaaaaaagtaccgcaaaaagaaaaatgtaaaagattccttaattaaaaaaatctaaattttggggtcaaaacagaatccaaagccgttgtggcgaattaaaaaaatggcgactttgtttgtgtcggtgtcattggcgttgccgccgcttttcaccgcggcgcgccaccgggcgatgccaatgacgcgagggaggaggcgtacgacgatgacggcaccaccgctgcggcagccggcaagaaaatcaaatggtggccgatcagtgccaaagagcctctgcggtggccaagggccctcgcacagaaacacgcgtcaagccgacacaaaatgccaatttaaaaattcagtaaaatagattcgatttaaattttcatgacacggctgctaaacatttttgccagataaaatagaaaaataagttaaaactcggtgctatttgatcccaaaaagagcaaaaatgctcggttttgagcgattgtgccatgtgctcatgggttttcggcggtctaatcacgaatttgatattcaaaacgagttgggtttttaccatttcatgcttaatttaagggaaggaaggggcacttctaattcaaccaatacgatttatgacaataaaatatttataaacccaattgaaatccttggcttttttttaaatgaaccgtaaactgttgctctcgaaaatttcaatccaacccgactgttgaaaagctcgttcactacaatttaagactatttactaaaaaactttttaagtgagacatcaaaacgtttgatcattttaaatccatttcagggtccgagctcctccgaaatgattcgttgggcttcactttccgaaagaaatgggatgctgtatccgtcctcgcctccattcgcaatcgcatgttggcaatgtcaatgtcagcgttcaaaaagatcatgatgtttagcccaaaccttaattnatctatcagtgatgaggaaacaatggaaaagataaagagctacagagcatgattttttgg

SEQ ID NO: 24945 - DNA, 1956 bp, Heterodera glycines
  misc_feature (20)..(20): n is a, c, g, or t
tcaattttacctcaaacacntttgaaatgtatttgatcttcgttgtatgggcgaaaaatgataaagaatgagatttttgggaatttttatgcaaaaagacacttgatttttccaatttttaacacatattttagcacatattttggcatttttggggtttttagcacatattcagcattttttagcacatattttattacatatttcaggatttttagcacataaaaatcccatcactaattattatttttatttaattacttttttgttttgtttttgtcccttgtcctttctcagacctttttgtttattttgtaatttgttttgtttgttcctttgttttgttgatatgttgtatttttttgttgtcaaatttggcgaccgacaaaattatttatccaaaaaaagaaatggtgttgaatctcattatttcgggaatgtgttttcgacagtaaaaataataaatcttctgttccgcatttaaaatttgcgggatcccgcgcgggattgcgggattttggaaatttcgaaaaaatttagaattaaattttgaaaatctctaaaaaagctaaatatacctggccattttaaaaaagaaatttttagaggctggcggtatacgtgaaaaggggttaatgagttgatcaaaattttgtgttcggcggtgccgacaggcgccgctggggaattttttcaaattctagatgaaatttcagagaaaaatggctttaattgacaacagatcaatgccccctcccccatacatgaaaatcagcttattgacaacatttttcacatcacaagtaggcatgttctatgtcgtcgtattcctttgatgctctcgctgaataagccaatgccggtgcgcatggcggagttaaagatccgcatcggaagtgatgaagggcgacacggctgatccagcttctgcgagcgatgtccagcgggatgatgttgcgctcgtcgggctcattcaaacggcgccatttttgtcacaacactgtgcgtcggcccgtaaaatcccgacgaggactctgtcccctgatggctcactaaataaaattaatttttattcatggtatttacagttaatgtaaccaatttttggttatgtaaattcgtttctacgaaaacccactatttgcacacgacgcctgagccactatcaccggcacaagctgcatcggagtgacctctaaggcaagttgtgcccataggaaatatgtgatccggcggttttgactacagaaaaaatatctttattaaattaccaattggcttacggcatcattgcagcacgacagcggcgtcaaaacgcctgtcatgtaaagccagcgctttgtgttctcgcatctgtttccacttttggtgaaggactgtccgcttccttagaaaataaaataaatttagtagattcaaaatattttttatattttattggattttccaccttagaaaatagccaccaattacgtttatcttcaactggtataattcttagagggctgtgcaagaaatgatttttacgaaagtgataattaatgaaatttgttaatataccttaattaaaaaatgccaattttgcgattttgagccatttttaagagaaatagtgaattttaagaaatcctgtttatcgatgtaattatttattaaagttaaataccagcaatctgacagtcgacccattggcttgatgtgtaaaccggctcgaagcgtgggaaaccaatggttcctaacttccctaagaccaattcaaaggggagcacttcgacggcagccaagtcaaatgcggcgccatttagtaaacggaaagcggggtggagcacaaagcttatcacctttgaaaaactcgattaagattaacgtgctttcaaataattcttataattaaatttgcgcccctattgtcggatttagacggagtaattgctatttaaatttaaaaacaaaaaa

SEQ ID NO: 24946 - DNA, 1366 bp, Heterodera glycines
  misc_feature (59)..(59): n is a, c, g, or t
  misc_feature (78)..(79): n is a, c, g, or t
aggtaaaaatgctatttttagagcttttcatgcgattccatttgggcaaaaaaatatgnaaaaacatataaatcgcgnnccttttcgaagaagattatggaaatggaaagatgtaaatgtcctttttcaatatgtataatcattttaatttccaatgctgtgcccattttttgcatcttgttgtaactgaagtagtgaaagccgaactttctcaaattgtcgacaaagtgcgagagcggacaagggaatgtcataaaagcaggataaaggaagtattccaacgtcaccaagaacagatgaacaccccaaaaaagcatcttataatggttggaaaaaacaataaattaaacacctatttatttctagccggtttcaaccagatagaattctgttttttccatgttaaaagcatttttggaacgaaaaagagcccttttgatttggttgttggtgagaattgttcactcagttccagcaaacgtcagtcagttcagagcgtctcttctcaaaagctgggcacatttatagcaatacgcttcgaaatcggtttcaaaattatatgactttacataagaactctgttttagcctatccggcgaactattcgaaaaaaattcattataaaagcgaatttggaccagctttagcttgcacctaatactcaattggaggaataggatcatgaagcgtggatgaagaagtgattgtcgatgaaaacatttttgaagatttttgagaataatcaactgcttagttatgaaggatgacctcaggagttgaattcacgcgagattagcggaatgctgagattttattataaataataaaaaaatgaacccgaaaatacattagtcggagggccggcgttcttactgcagtcgtttcagttcctcttcttcttctgtcttctggcacacacacttcttactacacgtctgatggtagtagcgcctacacttctcttggcattcctaaacaagcacatcatcgccaatgatggcggccggcaactccccaggcttcttggcacgctgcgccaacactttggccaaagttttcttaaccttcttagccttttgcttgaaccctaaaagtataaagatttattatgaaaagttgtataccatctccatggaaatggttaaggggatggataccatccccatagaaatgcttaaggggatggatacatccccatagaaatggttaaggggatgtataccaaccccatagttaatcactcaccggtctgtacgtctttgccagcttcttcctgcacgtcttcgtcgtcgtcctccgccatggtttcagactcttccgtcagacaactttctttcagatcttccgactccccctccccctctcc

SEQ ID NO: 24947 - DNA, 2243 bp, Heterodera glycines
tgagtaaaattggactatctctccaaaacaattattgattcctttctttcttttcctacactcttttcttttctcttcttttcctcctaacgctgcccacctctttccgtgttctctttctttatgcaaaagttaaagtgacaccgttaatgaacggatttttaggtttttacttattttttctgcggctttaactcgacgagaaatgcagaaaaacatatttttccgaaaatactttaacgctcctatccgtcctagaatttcctattttggatattctcccctaaaatcactattttgagtgttcgcccccctaaaataagttttccatattttggcgttcgcccctttttcgtccttatttcgagatggttgtaattatttcctttcttgacaaatttagatttttgaaattttttattttggaaaaatgcttattcaaaaaatttgaaataaataattatttgcaatactaaccttgaataaattattctttttaggttttaatttatttttatacaaaaaaaataataaatttcaccgctacatttgaaattttttcgacatcttttcttcactatttcacgaatttttcgcccctaaaaatcagtcccctaattatgaatttatacttcgaataatttttcaatcaattatatttttattgatcaaagtcatattagaagtgaatacaaaacaaatttatcatttataatacaaatgtttataaatttgaccaatttcaaattctttctctgttggcccgccactagtaccactattattttaagtaaaaaaaaatgttgcaatctttaagtattttaacatttagacattcgtgatctaagagaaaaaatgattattgtaaaaacataattccatttaccaaacaagaaataatttttgtctactaaagtaaaattaaaatttctaataataaaaaacattgtttaaactatgtatttccattaaaaaccaattaatagtgcaattattcctattttgcaaacataaatataaaataatattttcaaaattatgaactaacataaaaatttattaacattaattagaaattactgaaattatatagcaaaaccatgctaaatatattaaattatatcgctcaaaattataaaaaaaattcctcgtttttatcgataaaactcaaataatcttattgactcaaatatttttttatattaaaaacttataaaaatagtgcactcattcagaatgcttaaacataaaactaaaataacaaacccataaaaagtcataattaaaaatttaaaattattctaaattattaaaagcatgaagcaactaattaatgcacagaatcaaatgatgatttaaccaggaattaattaaataaaatattttctataataaacaaatacataataagattcatcactagggtagcaacttttagtgacgaaaaatcccgaaatagttaactaaaatagtgagtaaaaatgccaaaatagtgaagaaatagtgacaaaaagtccgaaatagtgacgaatagtgacataattttcagccaaaaataaagcaaaaataatttttattcactatttgcagttgcaaatgagtagggctgggatttttaagggcaaaaaaaacaaaataggtacataaaaaaataatttttaaaattaaaattcttgccacgaaaatacctttttgagaaaatttttttcatttcttaggagcgctttttgaaattttttttgtcgattcttaggggtgtattttttttgaatttttttaggtcgattcttaggggtgtattttttggttttattgcatttttgttaaagaattttccaaaaaatgtcgaaatagtggaaaaatagtgacaaaactccaaaatagtgaattttcactattttagtgacaaaatcccaaaatagtgatttctagtgaccgataatgacatcagaatcgaaaaatttttatgcggaaatgcgttttttgagctccttcaaatcaattgagcaaaaaatagttaaaacctaaaattcacgtccctacttataagaaacttttacctttgtcgcttcaaataattccaatttttcccgttttccgaagcagctaactaatccttttttagaaattctaaaataaattgcccaggcgcagcccgtcgacaacacgctgactgtgtacggcggccacgagaacgttgcgcaagtgcagctcggcaccactggtaaagaagcaggggcggg

SEQ ID NO: 24948 - DNA, 1569 bp, Heterodera glycines
atatacaattgtcacgtacacttaatgataccgaatccattgtgtaccgattggatgagaggtgaacaacttttaactggttatgtggaacgaggagaccttgtagaaattcgccgtggatcttacatggtttttgcagtttttattttttatctgaccatttttttcttagcattgggctgtctttatcggacatatcagtggacaaccgcttgtaattcatatttcgacagagtcatccgatatgggaattagcacaaagaaggaatttgtccggaagatggccaagggttgtgctgctattgtaatgcttctcacatccatctgttcaactttacaaagactcgtcctttctctccgtttttcatttctcaatttgttcaaggtccgcagcgacccttttctgaatgttatttcgactgacttctgtcgtgtcaataattgtttggatgcaaatcgacgaccttttccaccctcaattattgtcgaacgggcattgactaaggcgagttatgcctatttaattatgtttaatttactacagatcctttttagcttggaactggtgggtataatctcatcaaaaacaactgtgaacactttgctaaatggtgtcgttatgctcttcgagaaagcgagcaggtgaagagttttttgtcattaaaccaatttctttttttgactggctgtagagcattctgggccatgcggggatgatctgtgtgacggcgatggctgtaagcacttcaattcctgcgggcatcgctgccggtgcggtcagttttatcgcgttgaaggcgggtcaagcattgagacggaagcgaattgggtggtcaatcatttgaatgttgaccactgttaaatgcgcacgaaattttgtaaaattcattccaaaccattccttgcattgtcagtttatttcttatttgtatctatatatatggtcgttttggaaataaatgcatgtacaactttgtaactagtattaaatgtttccattgtccaaatgcatcgaaattgcatactgataagcctgtcaaccgttaaaaaaacattcttcatcgatgattctttttttgcttatacgttagttcaaaagctatcaaataaattttttccctcttgacgtattatttttatatctctaacataaaaattcctttatttgtggttatttttttagcttttctaaaaattaactgctgccaaagtcttcatcatgtcttcaaagcctctctacggaaaggatgttgtgagtttttctgtctaagcagtttaaatcttaaaaaattgcttatcacaataacttgataaatatgtacacgaataatggcgacgtcaattttaacttaaaaatttagcttacggaaggttcggagatctcgcgtgaattggaggtaaatattcattcatcggattgtcttttcatttagggttaccgttaagggcaaattttataataatcacttcgatttcaatatttttgtgacaagtttcgaatgataaagaaactggcccacatctttcgtttattaaataaattccatttagacttatttatcattttta

SEQ ID NO: 24949 - DNA, 1351 bp, Heterodera glycines
atgtccatatttcgagattttagcccatattttatggctatattttgcgattttatatccaaaattttccgagccctagtcattacggaacctatggagcgaattgggttacattgacgcatggctcaagcgaaacatgaacttttattttgtaactcaaattataaatacaaatgtaattttttacaaacggaaaggcagtcggaataaaagtgcaaattcgtttactaaataatgttttgttggccattttctttcattttctgccgggtattgctccgtaaatgagtacgacgattccgagcagaatgagaagggagaacagcgcgagatgaatggtcacactccaccaggcgaaccaatacaaagtgtgctcgcagaaatgcctctcgaacatataaagctaaagtcagagggaggcggtgaatgcgtggcattcttttctttccttcacctgactgtgcatgtaacgcgacgcgccgtacacccaaacggagcctaaagcgaaagtcgcccggatattcatcagccagcaattgctaattattacccaagatgaggacgacgaggatggcgaacagtccgatgccctcaacggcataagtcagcgcgggacgacggccgtgcgaatgacgcatttgacgggtgtcccttctctttgtcgagtcagtcggagaagcagaaaggcttaggaaaaggcgtgccgctccattgatgatcaaaaggatgccggaaaggatcaaataaatgggcacgttgggttggatgaggcaattgtacggattcgcattgagcgcacctgcgaatgggtcgggcgaatttggagagactcaaagcatttgggcacgaacgaacccacgaacagtgagacgacgccaaaaagcacttccaaaacggagaaaactgcgcacactgccggtggaattttgttttttggcgaggcattcgcccggtcaacgtcatcccctcgggggacggaggagtgccgaacgctgggaattgcggcgggactttgctggggtcgaatttggagaggttggaacggtggcgaggaggaggagggcacgaaaaggggttgtggatgtgcataggctgctgacaatgagtgcgagtggggcgaagactgaacgctgttttgggggtactgtcgttgttgttgttgttgggcatacggtacggaagatgaagcgaaggacggcacggcactgcccttctgttgagtataaacgggcggaactctgagcagtgcctgggccgatgcattgggaatttggagctgctcatgggaccgcctgctgtgcttgagcaataaaagggacaatccggcggatttccttctcattaagctgaa

SEQ ID NO: 24950 - DNA, 1093 bp, Heterodera glycines
gactcgctgtgcttgcccactgcatttcaaatagctggtaatttttatttctccggcctaatccagaaaaaatcactatctcttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctgggtaatttttatttctccggcctaatccagaaaaaatcactatctctttttttgg

SEQ ID NO: 24951 - DNA, 2119 bp, Heterodera glycines
caaaaaattttaacgcagaaatgctatttttgagcccctttcttcatagcatatgcgcagaaaaaaatatgttaatccatataatttgcaaccctagatatgacaccgaaaagaaggaaataagatttattatatatactatatgtttatacagaaaatggaaataaaatttatatgagacgaaattaaaattatttttaagaaatttaattaatgtgaatttacgcactaaaaatatgcctaaaaattgccaaaaattgtgtaaaaattcaaattgactttaaaaataccaaatggctaatgagcgtttttatcatttttgaaatttctctggccatccacgacaaattttgtctaagaatttcctgcccaaaaggaattgctcctcgatattttttaattttctccagccatccccgacaaaattccccgtcttttttgctccacgaagggcggggagtacaaaaattgtgaaataattaaactaaaatttaaaagaattaatttcagcctaattttaattaattaaatgcaatttcgctaccaattcggttaatttttgaagtgagctgctgttatcattacgcacattggcccaaattgaaagcttcgagctttcttcgtccacctccaaattgtccaaactaaattcacaattgtacccaatgccgccgttgggcacattctggcacgacaaatatttttgctcaattggcacaaatttgttgtcatattctttaaaatgagaaaatttaaaattttgtactttgctattttttatttgattttttttcttgaaaatatggagaaattttttctgtgccattgttgagtttggccaacattgtcccattttaggaaaataaataaatgaatttcgcccgttttgcctgggggcaatggcaaatgccatcgcaagagaatttttatacttttttaaataaatgaatttcgcccgttttgcctgggggcaatggcaaatgccatcgcaagagaatttttatactttttttaggtgtattcgaataaaaacttaaaaattggaaatttgatttttcaaaatttatgggttcgattcattggttaactgtcactttgcaaatagcgtcaattttttttttgtaatatttacatttttaaaaatatttaaagatattttacgaattttaacaaccattttcagattgttagcaagacagaatccaaaataaatttatgaattaattagtttaaatttgacaccattaattaatcattatcgaacacttacggatcatcacattgctcggcattttgtcagtatacgtgctcacactgagcagcaagaaagcaaagaaccttgatgaaaggcaatataaaaaaatgaacaaatgcttcacaaatttaattacatggaaatcaattaatttttaaaattagtaaatttcacactaattagagacatttaagaagcaatcattttttgggtttcttttttcttacattagttatgcttagtttgagcatataaaccttactttttttgaagacttttcttcctttttatttttctatgctttttttcaacataaaatttaaataaagtgcaaaaaaaaatttaaataatttgaaaaaataatttgttttactttttgttttaaaaaaatcatggctccaacgagaactgatcaaaatttctcctgatcagtgatcacccaccattgatcccccgcgccaacttacatgatcaattttttaactttgcttctcattcctcccatatctttgctactcttaattctgagttttcgcttttccttcagctttatccctttgtttgttgttttgtgtccattttgtgaaacatgtcttaattcagttttttcaatttaaaaatataattttaattgctgttgaaattgagccccctcaccaggggctttaaagacataatttaattgccgtttttcttgaaattgagcccccgccccaggggctttatatttcaacccctttcaaaaagtgggcttttcaggctaattcagcagggggggggggaggggggaaggtttttcaataaatgcaataacttacattttatgttgacctcccccttttccatgtcgattattttttcggt

SEQ ID NO: 24952 - DNA, 1882 bp, Heterodera glycines
  misc_feature (1745)..(1746): n is a, c, g, or t
  misc_feature (1761)..(1761): n is a, c, g, or t
  misc_feature (1763)..(1763): n is a, c, g, or t
  misc_feature (1765)..(1765): n is a, c, g, or t
  misc_feature (1776)..(1776): n is a, c, g, or t
tttaaatgaattttgactcattattttgaagaattttttattttagatctgtttgtgactgcaaattcatcatgtgctccaaagagcgagtgagtggaaattatgtaatataatttaaaaaaagggttaaactattttaaaacaatcgaatcctgacaaatttggtatcgttctaaagctcttgagagctaggtctaaaaatcagggaatgaagtcgagccgatgcaaacccggactcgaacaaaaaactcaaatttaattttcgccaatatgaattatatgtcttgccttcagaatactattttctgtttatttcatgcagactaggcctaagcaagcctaagctgaatccaaggcctaagctgaagcctaaacctcagttgtcccagtgcactgatggcgtcggctgggttcatttcctgatttttagactaagctcgacaagagctttcggatgtaccaaaattgtcaggattctatcgttaaaaaaagttagagtgccaaatctcccaatttttcgagtgttggtcggttcaaaaaccggttttcacgggctgttcattacagtacacccaaaatttttaggagcgtattcagaaaaaagtaaaaaacactttttttaaattttaggaatgcactcgtaaacgggcaaacagtgatggatgttatttatttgaggtgatattcaaattaataattaatttgtaaaattaaaattctctaaaattttgtttatgcagtttttcgttaaaattataattcacggttttttttattctgaaatttatttttgatatataattagttagaatttttttcgggttttaaagcagtttttcgttaaaattaataattaaagttttatattctgaaattatttttaatatcgtatttgttagaatttaacgaatttaatatatttttttaatttcatcctcaatttttttgaatttatccaaatgggaattttaaaattttagtatgagaccggaattgccttcctgccctctcaaatccgaccgtcaacacatctgcgacgccgagagcaccagcagccacatgttcaattggaagattttaaaaaaaaggtaatctgaccaggggaaaaatcttttttttggtttcaaaatttgtgtcgcggtatttggtgatttgtaacttggggccccgacatttgggtaaccgacacttaggattcctttttttgagaccacataaactccgggattctgttaaaatcctttggccactatttcaaccctaaatgtcacattaaatactttattttaattttaatttgcgcgattaaattaatatgtgatatagtaattttaaaaaagagatacagtatgacaatgaattttgatattttttttactgtatttattactgacaactttaccgggtcgcaaatatttttatttatttcatttaaaaaatgttcaaagaactgtgagcagaacaatcctgaaaatataatttaaacaattttacaatttttaggaacaatttccttgcccgaaatgtgaccgagtcttgccctccaaacaaggactgtcaaatcacctgaggacagcacataaatcaggtgggcaatgacaatgtgtttattcaagaagaaaatgaaaaattttttatcaaaaattgggaatgtttgaaaaaaagttggttagaatttccaaaattttactcccaccgttgcgctctgaattaatcctctagaaatttttttataaaaaaacacnnaaaaacaaaaaatcnantnacaaaattaanaaaaaattaaatattacttcctaatttttaaagaaataaatttctttttatgttataaagatatccctagagggtttaatttttcaatttttttcagacaacccaa

SEQ ID NO: 24953 - DNA, 1453 bp, Heterodera glycines
  misc_feature (8)..(8): n is a, c, g, or t
atatatanccaaagattttataccaagcttatttaccatttaaataatttgttttagcttacaaattagttctgttaaaaaagcattgcacaaactgtcatgacaattttttgtgcaggtaacaaaagacaaaacaaaaaattttgtcagaactaaatcaagaaaaaatcatgatttttaatcaaaaatagttattataataattacataaaactcacctgtacttcgttagttaaaatttccagtcgttaaggcatccataaattttaatttcaactgttgaccaattaattgttcgtaaacattgcatagatatcgcataacaatttaaaatccataaacataaactaatcaaaaaccaatctaattcttcgctcttttttatcataaacagtttctattacaattttacatagaccattactataaacaaaacaattcatttttattaaataaaaaacaataaagcattagaagagcaaaacattttaaagaaaaaaattttttttattagaaagaacaaatacctaaatcattttccatatcaaaaacttttgacaaaaaaaaagaaattcaaaaaagaattcaaatcatttttaacgcaaaaactaaacaaaacgccacactaattcaaaacatgaacacatccggacaaacaatcaactttattatataagattttcaattttccttcaattcgatcacttttcaatgacaaaatttcactttttctttcgaattaattttaaaaatttttctgaatatttaaaaatatattttaatatttaatagtttacatatttccgcttttcctccttttttcacaaatattccgccatctgtgctaattccccgcgcgttttattggccattaattctttcgaaagaacgcaaaaacaaaaaacaaatcgaatcattaattgccaattgacttttaaaatattttacgggaaatattctggcaaattttaatttagaagctgagcagcaaatgcagaagaaaaccttcactaattgggtcaatttccgtctcgaagaggtggttttccatttagactttgttttggattttgttaattgccttttttaggcatttagctcaacttaattaagtttactgatcaatcaattcactttctttgtcccctcctttgctttgttccattagctcttttcttcctttaagcattcctcttctggcagagtgaccgaccttttcatagacttgcgtgacggcgttttgttgtgccgtttgttggaagttttgactggccaagttttggtgagtgattgggcttaaaatagaagctaatcaggcattaacggttccgttcttacctttgattgcgttattaagctcgtaactgcggaaagtgccgttgtcgcagtgtcaaaaaacggacaatcgaacgggtgagtgattttttgtgccaaaactcagattttgcatttt

SEQ ID NO: 24954 - DNA, 1550 bp, Heterodera glycines
cccaaccatcatttgtcacagttcaaaataggtgtgaatttcacaccttaaaccgtccgtccctcctccctccctccctcaccaattcaccaccacttcatccaaaaccaggtgtgaatttcacacctcattgccctattgacccccattcacatttcaaaaaaatcccgacccaacacctcaacacccacgggacccctccccaaactacgcaataggtttaggcttaaacagttcacccctcccgcaccctcccccaaactacgcaataggtttaggcttaaacagttcacccctcccgcaccctcccccaaactacgcaataggtttaggcataaacccaacacccctcccgcgcacccctacccaccgatcactcactctcgaccccctcccccgccaccttttgattgacaggtggcggcaccttcaaagcccaaaaccgcccaataggctcgcgtttgtgcgggaaattttcccgcccaaactacgcaccggggcggttaactactggttcatgcaacggcacaacttttctttgcgcacaccgacgtgtccctttgaaacggagccgtcaaaagcaaacggtgggcaaatggacgcgggaagcgacccttcgattggcatttttgatgctcatttttaattactttattatttattttaaaatagttgcataaaacaggaggacggatgtatggacgtccttttttattatttagcgaaaaaaaacaataaaaatagagaaatgtcgcaattattcgaaatgccccgttttctcatttctcgttcgataattagggttggtcgtcgggaagcgccgctccgcaccacaatttttgcaaattcgaacaattgcccccgcgcgtgccttgacctttgaattggaatgggaatttcgaaattaattcaaatatttgtgtgtattggcacacgtcaatttgagttttgccgttgatggacagccaattctggaagcaccttaaccggaaaagagcacagttattaaactgtgatgcttttgactgtgccttttgcaattgctgcgtttaaagtccctgtgcattcgcaattggtcaacgaatgcgcactcgcgcaactcccgcaacaacagccgactcagcaagttcgacgtgccatgtccggcagtgtttggcacctccgtttgtccgccggttgtgctacaacttcttccgcttgaacttcttggcccctcgtcctcctcgttgttggccaacagtgtcgccgcctgttccaaaaatgacacgcgaagcattgcctcggtgggcctttgctgttgtatgttttgttgcggctgttgtttaaatgtgccgccacttttcttttgggtttcatttttttgaattttcttccattaaaacccttttcaattgaaccaatgatctaatgacctcaaatgagagcaattaaaagcattggcaaatttcaataaaaaaaccccaagcaaatacgaagcaattcatccacaatgctttaagcaattaatataattaaaaagtgaaaattatattaataataaagaatttaca

SEQ ID NO: 24955 - DNA, 2214 bp, Heterodera glycines
  misc_feature (64)..(64): n is a, c, g, or t
tttgagcatgaaagtgctagacagactggattaagctgtttgtgtaattataaaaatttacttntgatttattgttctgaaatttggttaaatgaattaaattaatcaaatattttagcttaattaaattaaaaaagaatgatttgctgcacttttgccgcaaatgcacgattttcagcaggcaaccttgcaaaagataatggcggatggattttgggaaaaatttaaatattttaagcgtgattagttgtgctacccatccatcgatgggatgcatcaaaaaatgggcagttgaaaattgagggaaacattttttgtcgagcggaatttcttggaagggatttgttcataatgtttttcggcaaaaaagattaataaattctctttgttaagtaaacaaattagacctttttggtttggtagactaattgttttttaattattatatatttgtccgcaaaatttcattttacaaggctctttaaaattttttcaaggattttaggacgtaaaaacaaaagctaagtaaaaaggaagaactaattacaaaaaaaaaacattggattcgaattacgaccaaaaaagatgataaaatgtaaaaagggttagcaccatgtcgaaattgttcatggacgatgcaggtcggccacctgagcagcaccaactccatccatcgcaagcattccatcattccgccgtagctgttcaaaatgggcgacgaaagggtcagtcatgtccgaggtggacatttgccagagtcgccgctcaatagctctgcccactgccttaaaaaagccgaaggagtaatcaatgttatttgtctttttttgaccattgcgacagttaagaatttggattttaaactagagtagcacggggctggaaattttgggcaaaaccccttaattacatatttatcaaatgaaaatgaaaacattaaaattagttttatttgatgtgggcccatcgctgccgaaaggcaacaatggggatttagcatgatttggtaacagatcttgcactaaaaataggtaatcattttagtttttttatttaaattaaaaattttcaatactgattttaaaaaaagttttctttactaattttcattcttgccagtgcttgtgtttctcggttgacctatcaggaagtaccgtcccgatcccgtgctaccctttttaaactttaaacttttggacatcccaatttttaaattgttgacttggaaaatggtcttccctatatcataataaaaatctcctcaaactgctattgtgaatagtttaactatccaaagatcttatggcaaggaaatttgctgctcattggcatttgcccttgttaaataatccggcatttagcgcttggccagttcgaaaggcccaaaattcaaattaatgcccgcccgttcagcttctccgggtctcaaacttgagttaaatactttgcttacaattagcgaccagttggtggcgctgctaattgtaagcctagtaatgctaattacaaatttgggaattcccattagtttggcaaaatgtgtgccatctgtcgcttttgtttgttggcatttcaattcaccgctgacaaatgagctatgcaatcacacattcttcgcacattgaaaaattggaatttgacttccaaaaattcaaattaaaccattttaaattactatacctacgcagtgggcaaatagttaactaattcttgtgaattattttgccttttttgtgagcgatgccaacctttgggatttttgttgcagtacgggcaaattgtcggggcgtctggcagcgcttggcccatgtccaacagcgggctgcccgaggaatggatgcttcatgagacggagaacaatggcattggcaccgtttcgtcatcaccaatcaccactaacttgccatgatggctcattgtcatgactatgagtcaaaacttggacaagcgaaagttcgctggggtatttagtttagtaaaaagtgccaaatgggaagggaaagggggcaatatgcaatgggattccgtgagaaaggcaattgtatatttaaaaggtgaaaaatgaaaaagtgacgacgccttatactttgaaaggtcaaaaatgcttttcttgattatttgtgctttttctcccaaattcctttaattttctttttcaagtttcttccaaatttcccgtgtggaaaaattttttaaattaaacaaaaattttta

SEQ ID NO: 24956 - DNA, 1542 bp, Heterodera glycines
aaaattattatagcaaaccatttatttcccaatgctttccgccaatttatttgtatcttgggaaagatagacgcaaaataattgtttagtcagcaaagggcaagatatattttctaaatcaaaatttagatttgaaaatttttcttcttggaaaaaattatcaaatatttatttaataatcatttcaatgaccacatctaagtttttagattaagttttacgtgtttggatccgtaaaactccttaataaatagggatgggatttttatgtgctaaaaatcctgaaatatgtaataaaatatgtgctaaaaaatgctgaaatatgtgctaaaaaccccaaaaattccaaaatatgtgctaaaatatgtgttaaaatatgttttaaaatttggaaaaatcaagtgtctttaggcatatatattgcccggcatgtcatgggatatcgcgcgggattcatcgggatcccagtccgcaatcccgcattttttggaaaatgcgggatttgcgggattaatcccgcgggatcccgtcccgcaaagaattttgagttccaatcccgcagcgggatccgcaaatttgattttttgtgcgggattatgcgggattttattgatttttttgaacatttttctaagacagaatgccaaatatttttaaataaattaaataataaatttaattaaagttaactcatttttcatcgcaaatttcattcaaaatttgtgaaattttcccggcggcgcctatcggcaccgccggataggcttttacttaataatcctgtagaaattgagtcaaaaacgcgtcatttggtcaattttagacaaaatctgttaacaaatcgcattaaatttcataaaatttctcgcagatgtcgataggcaccaggtatggcacggaaagacttccgatttccgacatttttggggtcggaattccgacttccgaaatttttgatgaaaagtcgtaaattttttaatttttttttaaaaccagtaagttttgtacaatttctaataataaattgaactgaaatttttaaaaatttcccggcggcgcctatcggcaccgccgtactctcctccaagttcccaaaaagtttttgaaaaaatcgcgctgtaaaaaacgtgtaaaaatagtcactccttccaaaaatgttctaaaataatgaaaaatgacaaaaaagattttgataaaataattgaataattttttcaagcgaatatactaaaaacatttgtgaaataccttttacttggttaagaattaaaaaatttagcctattaaaatatttagaaatttttttattatattgtatatttttttgaaaaatttccgatttcttgcaccgcaaaaaagtggttttgaagaaaaaaatagtcaaatttatgaaccgttaataatttgatttccgatcaactttttaccgtcggatccaatcgaaaaatcttagtcgacccatcagccccttttaatgcatcccgccagcccctaaaaatttattttttcagctttttttgatttttggaaattttttgaatt

SEQ ID NO: 24957 - DNA, 2255 bp, Heterodera glycines
agctattgtcgctggccggtgacagcggattgaaatatctgtgaatttacgaatgacgtgttctacacttgggtgaaccgcaagcatatccattacgtgcgaaaaaaccagacaaaaaggtggccgttgtggaaaatcacgaatgttgccgtaagttagcaacaaattttacaaataaaaataattgaaaattaaaaataataaaaatgaatgtcgaaattttgcaagactcggccaaaatagaatatttgtaaataataatgatcccaaaattttggtcaattaattaattaatgactgacaattttgcaatttaattatattaaaaactacaaatttttaggtgtccggtgatgccaatctgttcgaagaaccaaactttagccataccggactctatgatattggagtaagaaatttcgtttactcaaataatatttaattattattttaataaaatattttataatagatttaaatcaaagagaattcgatttgaaaaatgacatcaaaattaattttaaattgttttttagacatattaaaaattaaataaatttagtttactcgcatggaacgaaatagcaaaaacaactttctaaaacgattggacaagaaactgctcccaggctacatcatcgagatcaacggcaaactgacaaaatcccttgatgaaaatctgccgattacgatcagtttactaagtcagactgatgatcccaaatttgccgagattgagcatataatcaaatgcaaagaagaaacgggagtgaaatgtccaggtgaaaatatgaatgatgagatggtttgtttaagcaaattttacggtgccaaaaaacacaaactttggtttcgaaaattttgataatttttttaattagctttcatatatatagtggagaaccagattaaattctttgtataatttgacaaggaaatttaaattttcataaaccaaagacaaagaaaatcattaggggttcatttttaggctttgtggccacggaaagactgctttttgtaactatgtgtcgaacttcgaaccattttactaaaaataataagacattctgaaaacagtgaacacatttacagaaatcaattaaaaattcttccgttcgttttttgtcaaccacaatcataaaaaagttacagcaaaaaatattttaattttatatattctttttagctttttgtccattgcaacttgtctttttttggaattcttcgtcagcagctgtacaattaaatgtgtttgcgctaaacggcattgaaaacatcaacatttcaacgaacaaagatcttcctcaattccctcatactgctggaaaagagatcaaattgaggatccacattgcgcatactagtaagattaaaggtttactttaattattaagatttttgatttttaaaatatttattttagggaggttagggatccagaattgaccaaaaagtgatcagattcgtgagcagtgaccccgaaacccccggggaagcgttttctcgctttttatgacaaacattttccatataaaaaggtcctccctccttttggtttttttaaagttttctccaattggaccttcacagatagcacaaacacaaatattatgtattaaaatttttctgcctaacaaattttttttaattttgaattttcaaaatgtgattattatttttttttaataattttgtttcaaatgcttatttttaagaatacttattaactgagcatggactatcagaagaaattccctttggagatgaagaaaagagagcattgcccccttggcttgttgaattcatccacgtaatttataaaattattggtacttttctgttttgaaggcgcaccccatttctgatcaataatatgacatacatttcgaccaatttcgaaccccggacccgaacaaaatccaaaattctttatcaccaaaatccacctttattgtccaaaaccgattcaaatgcattgaatggaaatagcaaataggatttacgggcattccatgcatttgaatcggttttgaacaataatggtgtatgttggtgaaaatgaattttcgacttttgtcagaattcgggtccgaggtcgaaatggatatcatatccgtgatcagtggaccgaataaaattgttgctttatgcctccaaaataagtctgttaatattggacgctctttgttgctttaaaaatgaggtgcggcgccttcataacagaaaagtaccaaatttttaattaatatgca

SEQ ID NO: 24958 - DNA, 1007 bp, Heterodera glycines
tcaccagtgtattttttaacaccaaattcattactattcttttttaaaataatttaaaaaaaaatcaagtagttgatgaaaagtcatggacaaaaatcaatgatttttaaaatctgagttcagattcttgatcagcgcattttttagcctagaaaaaatacatgaaaaatttttaacatttttttgtcgggacaccaattcttgaccattgcccacttcccgacattttgctcctcaaggggtaggggagcaaccttgtaatggttgaattgtgtagaaagatgtcaaaaccaaaattcgtctttatttgtaaaacataacttttcttgatcatgtaaatggaatttgtagaaaacaattatgaaggcagtctcgtccgaaagtctcacttttaattccctttcaacaggtggaggaaattgtaaaggccgcagaaaattccaatgataattgtcgtgagtgcgacagtcaatccgccaagtgcatacacaaaagataaattcactccatatagatccgccttgactttgttttccaaagcaatttcctgagcaaagaaaagaaatttttattgttaagttttaaaaagtgagcagctcattccacccccccccccccccgcatcgtttccccttgagaattttttaaaatttactaacatagaatttaaaaaaaaaataaaaaaataatttttttataagaaatattagaagaaattgccaataaatttctgcgaatatgcgaggggaaatggaaatgaaatacacccgtttaaaactccctacatactcgaaagtcgaaatcggcagaagagacagtagtaacacaacaaaacaggatgaaaaaaagagcaacttaaaaggaaaaacaaacttgttcataacttttggtacattgtaaatcattgtgcacaaactttgtcaacacgcaaagtacaagttgaagcggaaaagcgatgaataggagatgaagcgggtggaaaaactgagtcgggcgcaagcgcggaa

SEQ ID NO: 24959 - DNA, 1839 bp, Heterodera glycines
aaaaatggcaatgatcagtgatttattattttaaaatagcgcgcaaattaaaccctggtgttttgaatttgtcttcggcaagaactagaattgctcatacagtttagttctttagttagcgtatcggaattcgtttaaaatccacaaaagatttgcaatagtatgacctaatctgattgttgtattttttgaagctctggtttaggattcttcttcagtacaacatttgtgatgtcgaaccaacaaaatggtgatgtcgctgttccggcagcagttgctccgaatgaacaacctaatcaagtccgttttacactttattttcccggagtatctttttctccctcttagaacaaccaatttcaactttggccctttctcaagtccattttgacccgtcttgtcatgttctggctgatctcgtcacttattcgaaactttttcggccctaaacaggaacgtgacgccgaccaaaatacatcattgaccggcggtggaaaaacgtacccgccctcttttaatatgttcatggcaaatgagcattttgacttatttgtttacctttctgcaaaggtagtgcaaatttctgttttttatgttgtacagtataatatctttttgcaattttagtccgaacgcttccatgatttcgacaatgttgaatctcttttttggcatgaacatgatctcgtttacggggattggacctccggtgccattggtgacggctctcgacaaaaggcggtgacgatgatgccaactccggaagtgctccagcggaacggctcactgtatttgcacgttttcctggtcaaacagggacagtctcatcatccgcgtgccaaaaattatggcgggagggaagtgagtgaaagaaaaagaaattataatttacccaattaaaatcaaagattgtgtactccagccatcaactgaacaaattcaaaaagaagtactaccaaaaaacagccaatttgctgacaggcaaaactggacaaagtgaattggaccgtcaaaaggcggaggagggagtgaagttcgacattttgaactattggcatccgaacattaccgtcagtttggttactgatttttcagcctggacaaggggttcgcttttcacaccgatttgatcttaagattgttttcggtttttaggtcagttgccggcacctttcgatgaggccgtcaaattcgacccagccagcaatcgctattacccaatcgttttcttcaatagttactggaacttggccaccgaataccaacctgttaacgacaccgttcccgcgctcaatttgaccgtcactttcgcgcccctttcgctgttcaaatggcaactttacgcgtctcaacaagttttgtataataccagttaattgtaagtattgttgctttttgagatgcgtggaaaatgggcccaaatgttcggcggggaaatcttcgaggagagcgacgccgaccaagacgcaatcaaacaggcactgatcgagacgagtcccgtgctgttgggcataacagtcgtcgtgtccattctccacaccgttctcgagtgaatttcacattttttttttcttgttcctttagctgcttatattctttctattttcaggttgttggccttcaaaaatgacatccaattttggcgcacccgcaaaagtttggaaggcctttctgtccgttcggtgctcttcaacatttttcaatcactggtcagaaatttttgaagttttctcccaccctgaatttttgacagattgttttcctgtacatttgcgacaatgacagcagttggctgatcaaaatgtccatcggttttgggctgttgatcgaatttggaaa

SEQ ID NO: 24960 - DNA, 2370 bp, Heterodera glycines
  misc_feature (177)..(177): n is a, c, g, or t
  misc_feature (190)..(190): n is a, c, g, or t
  misc_feature (286)..(286): n is a, c, g, or t
ttttgttaggggggggggggggggggggggaaaggaatgggggcgcgtgaccatgatgatgatgaacggattttcaaaaattctgagcgaattttaaccctaacgacgaggagacggaagcatccctttgcttccaatctcttcccatcatcctcgttatttgcccaaaaatcctcnccttctctacccnacttcgtttagtctacagcagtgaaatttaaggtagaaaatattgtttaagtagaaaatagaatttcaatgtttgactcttttttctctctctcgngcgtgcgtaaataataatacgtgcaaatggacgagggggggggggaaagagcaatggaagtgaatgaagtgtaattaaagaatttaatgattttaaccttaataaatgaacagcctgctgctggactgatttggatgctatgcaaccaaaggagtgtcaattttctaaccaaaaaataatttttattaaacaaaaaataggaaattttagtattaagaagttatttcgtccagagtgccgcactcaaaagaaattgagcggagagaaattggaattggaaaagcggctaattccaaaacaaatttgtacctcattaaggcgacatgggactgaatttcccgtggtgaccagtccattcaaaaagaatgtattattgtacagcaggacagaaaaatgtatcttgagatctgcacggaggcggctaagtttaaaaaagtccttacaacaaaattaattttggcaaaactgcaaaaatgccccccggcgaatggatgtaatttttccccttcgtactgcgccatcaaatttacttttttaaatattttcgagattctcgacgcaaattgctcacataaataaagggtctccgccggagattaatgggagagagagaagatggcagggagggcccaaaaataattttcggccgtacaaataaatttgagagagaaagagatggaagatgaggagaagaagagtcattcactcgcatattaaacagtgaatttgtgatgagacagtttttgttaatgggccattatcattcattgactgaggcatcaccagttaattggataataatgccttttgacaccactttcgaatttgggagggacaaattaattaattaatttccttggacgagcaggaggatgaagacgaaggaacagttgtattcatccccaaaaatggagcggcataataaaaaacaacaagcaaacattggacaattgattaaagaaaattgtgattggctctgtgccttggccaggactaaatccgcaaaaaaatgcaataaaatgataaagaaagcgaacacagaacaattgctttcacttgtggaaatttgtctaaacctagtcgcttcgcgtttccgactgaccacccgccagaaaaagagattgctaccccatgtggataccgtacgccaaatgagcagagcgagaagtgagcggggcgcccgacgtgtgcttgtccagaaaggcgcaggatttggaggactgtttgctgccgtattaacccccgttctaattgaattggcaaagtctgttatgaccaaaaatgcataaataccccacactgctttgtttttatgtgcattcatcatcatcattcattcaataaaacatggctaataagtttttacttgtcccacaagaatttacaggggtttgacctcaatgtcggacacgagtgacattaatttggatgctgtacgacacgatttgaaccgagacaggggcgaacgaacaaatccctctgctaaaaatgtcaactacaaccaacagcttaggcggtatttgaaaatgaggagggatctaacaaacatgccgacaaaagttgagatgtcaaaaggaataagtgtactgttaaggagaggtggcgaagatgaagatggagaggttgtggatactccacctcgaccacccgctccaccaccaccaccacctccaccgtcaggtaaacgccctccgcgtggaccaaatcctcccgctcctccaccacctccaccgcctgggagacgtcctccacgtccacccagccctccttctccaccaggaagtccaccgcctcgtccacaacgtccccctagaccatgtagagctgctgcaccttctcggagaggtggtctcatagagcaatggcggaaaagacaatatgatatacaacaacggcggcccgtggtgcgggatcttttggcggaagcagctgctgctccattgcccgaaagtgacgatgaatatgactatatgctggagagtggattcgcgctgccagcaccatcacagtactatggagatttgcctgtactacccgacaacgcagacgaaattgaggagatggacactgttcagcgcgaggat

SEQ ID NO: 24961 - DNA, 976 bp, Heterodera glycines
aggggggagggacccttttgttttgcaaaatttttttttgtgataaaaaagcatcaaaatttgttatccggggttttagaggtcgctgatcacgaatctgacatctaattcgaggtcatggaccccaagaaccccagggaataaattttcatgactacatattaaaaaaaattttgcaaaccaaaagggtccccccttttgtgtttactttttgataaattcaaaagggccctctttgcaagtagcgccgatccaatgatcagtttctttggccataacttttttcttaattggttatttctggaccaggattccatgttagacctctggatttcctgtacaacaatccatgaaaatctaggtctaggaaaaacccaggttcctcgagacctggaaaatccaggcctgtatccaggtccgaatttttgaatatacttgacaatttattgttgtaattttttttttgttttttttgctcttttcttggatttattaattcccggggacctttaagctttcgttgataccaagaatgtgtgaattggccaagtaagaaatatgttatggccaaagaaactgaacatattggactcataaagtgcacaagagagtcttaattttttttctcctcccactatttgaaataatctcaaaacaacaacaatcccttaaggaatggcgtcagtcttggcaatcagattatccaaattcccggtcaactgataacggaggttctggttgtccgaatgcctttatcgccctcgcaaacaaaacaaatcaaaaacgatggtggtggtttggtttccgattgaattgtaaaaagtggcggcgaaaagggcggcgccgaatttgtcgcgcgaaaaaattgaaagaaacgacgttcgccggatcggagcggtccgaaaaaaatgaacgtgtctcgattttgcgaaaaatcgtcgaaaccggtactttgttttggtacgcgaggtcgttt

SEQ ID NO: 24962 - DNA, 1395 bp, Heterodera glycines
gcgatagcgctttaaaacagcacactaatgcaattaatgttttgtatgttttaaaataacaaatgagaaagtatactgtctacaccgagcaaatactgtgcaaagcatattgtctacaccgtgcaattactgcgcgacacgctagtttatactactatagagaaacgttgcagttcgtttcaaaaaacaaaatctcccggccgaaggccggaagcgccctgaaagtagtggatgggtcttacaactttttgaggcgcatctgggaaaaataagggttttccgctccggtggccaactgagtcccggcggctgatttctcacttttgcttgcgtttgatggcccataactttttttctaaaactctgatcaaaaaatgcttgctggtaggaaactaagttgaagtgttttctaattttcaaaaaaaattccaggcctctacctatacttggaagggctgcagaaattggcaacttttcagtaccaactttgcccagttcagtccccgttgaataactcattaggctttgacctgagcgcagggtggccagcggacttattgtagagctcggtgagctcgatttttccaaatttaaaaatttcgaaaattttcaaaatttttcgagctaggcctaaaaaacggttttcgggtttttgaattttaggattttttaacgaattttcccagaaaaacgaagaccacttccaaaacatagttttcgagctctatcgactggtatttttttcggaaaaatttcgattttttcccggaaatagaaaaaatttttggcctcagcgggacatttgagtcccgggcccataactcgtcaggggttggttttagccaaaaattgtcttagaacatttttgtagagaattttaaatgctatcgaatggtgtgcttcatgactggaaaatttcaaaaattttcgagctaggccccctagaaattttcgaaaatttttttggggtcctaaatttgggtgtaaaatttttttcttgggtattttggggtgctgagcacgaatatgatgtttgttttaagttacagtatttttggaattttttaaaaattctttattttttggtaattttttagcccttggaaatttgggttaatatttgaaaatttataactcggtgatggtttcatcgatttaactataataaagccttaaaaatagagaaaaataaggagaattttatgagatttaattggttttataatattcaaaagaaaaaaagttattccagaaattctggaaattttcgattttccagaaaaaaattcagaactcggttctgtaaaggtgtttttgaaattttaaataatgaaaaaatccgcaatttttttctctattatataaattttatttggcatttttatcactttttta

SEQ ID NO: 24963 - DNA, 1897 bp, Heterodera glycines
tttaattaaaaaaatacatgaaattctatcaattaaaaaaaaaattaatttaaacttataaaatttttttatcaaaaaaaaataaaattaaatataattttttatttattaactcaacaaaatattttaaattaattaaaatcattgaaaataacgtaaaaatgcacaaaaaaataatgttacaccgtccggattcgaacctgcccccccccccccctcaaaataatgcctcagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaatcatgtgctccccccccctttggacccgaatcacaaaatcacttttatttttatatctttttttaaagaagtgataaaaataccaaataaaatttatataatagagcaaaaaattgcggatttttgtagtattttacttttacagaatgacttttcagaagggagttctgaatttttttctgaaaaatctaaaatttccagaatttctggaataattcaaaaacccgaaaaccgttttttaggcctagctcgaaaaattttcaaaattttcgaaattttaaaatttggaaaaatcgagctttcgaagctctacaatagtgccgctggccaccctgcgctcaggtcaaagcctaatgagttattcaacggggactgaactggacaaagttggtactgaatttttgtagaagcacacagaccagggggttagagatagaggcctggaattttttttaacttttagccaacacttcaacttagggccctcacagcgagcattttttgatttgagttttaggaaaaaagttatgggccccaaactgcgagaaaaagtaagaaatccttccctgggactcagtcgtccgcgctgaatttttttctatagttttcccggatgcgccgtgaaaagttgtaagaccgatgcacaactttcagacccctaccgatagccgttctcgagattttggttttaaggatgagttgccttgtcaatataacatatatataactagcgggtgcgtgaaccgtcggctatttagctgggaaaaagcgcttcgcgctttgggagcttcgctacctagataagctatgggttatgaagatatttgaaattttaaaagattatctgggatttttaggccgcttcgcggcctcgaacgggcgctttgcccccgtttttcatattttgttttgctttgacgggctgtaaagtacataagtaccgccaaaactaccgcatagacgcgctttctcattttttttatacatatttgcagctcttcttgttggccgtctgtaaggacatgcgtgttcaaattgcgcgaatgcttcggaaaatgtttatgccatttcggaggcgtggaacgcaaacaatgacagttcaaactgtacacaccaattacagtagccgaatgcggcacaatgccaatgccaatgtctcgatccgtcccgcccgaggagggaattaactagtctcgacatcacactttcgaaattcatttatccattttttagcagcggctaaatttaaaaaaaaaacaatttttaaactgttttttcacaagaattatcaaaataagaaatcgagattcaacattcttcattatcttttcgtaactttgacaataagttttttagcataaagaaaaaaaaaattattttcataaaaaaccggatttaaaaacttatttttttaaaaatttttttgaatattttcctgtttttcacagttttttgaattcagccgtatttattacttaaaaatctctttttctttaatatttgcaattaaagtaatacata

SEQ ID NO: 24964 - DNA, 1610 bp, Heterodera glycines
  misc_feature (1538)..(1538): n is a, c, g, or t
  misc_feature (1577)..(1577): n is a, c, g, or t
  misc_feature (1598)..(1598): n is a, c, g, or t
ttattcttccaattgcatacaaaaaacaattctttaccaattatgattaaattacttttttactcgatcaaaaagactaaaatcggaatccatgacaaattgaacctttggcatgccattaaaattttgcattaagctttgaataaaattatgcaaatcaaccaatcagtcagttgaaaatcacacactcgaatatgccaaaaagtttttgaatgccgaaaacgaaaattcgacttcgcatgactaaataggcgcgtatattaacattgcaatgacatctgtcgggtggcaaatgtgtttgaagatgttttaatttagatgttttaatttcctcgaatttattttttttttttttttttttttttttttttttaacaaaaacatccaatatttttctactgacgaatatttgcaaatttccattgattattgttattaatatatgtaaaataaaggtttttaccttttacatttatgaaaaattttactttgcgaaattcataattattatttttttgaattttaaacgatgaaaaactttcttggccttttatttatcattaatggcattgatggaattgatgaggatttttttgaagacttgtggaaaaatctaaaaccatcgacatcaaaaaacaccaaaaaagaaaaattcggaggaattaaggaagaaacatttcaaaatgtcaataaaatgataaagtccgaaaagtgcagtgaaaacgaaatggaaaacaacgccaaaattatcgcaaaaaatttaaaatgaacatttggaggaaaaaaatgttaatttaaaaacaaaaatcaaagagccaaaaattgaattggaccaattggaagaagtatcatttggaaatgagtttaatgagcaatctgatcagaatatttcgtctaatgatcaaagcaattcagcatatatggtaatgaatggtaaaactaacagaaaaataatttttaaataaaattcgaacgtacgattttaattatttataaaattttaaatatttatttaggagaaaaaaaacaagaaacgaaatagaaattgatcatttgaataaatttaatttgatgaagaaagaattacgaaaagaaaatgtttataaaaatttgacaactactcaattagaatccgaatttacaaagaaattcaatttgaaaacgaattggaaaattgatgaaaaatagaaaaaaaaatggtgttgcattgaaaacaatttatcgatggaagagaaaaaacgatttaatcactcgtaatattttttaatttgccaatttgagacgatggacgaggaaatttggcatcacataaattcgttagcttgtgtcaaacccaattttatccggtgacactttgctaatgcctaattaacagttctctatgggtgaattttcctattttcctattttccttgtttctttttttttctttttaatttctctcactttggcatcatactatctttccatttcactgatagaaaacaacatttttatttcgctctataatcattagggcttcgatttttaggcactanaattgccaaaataggcaaaaataggatctctcaaaattntttaggctttttaggcgctanaaataaaagcct

SEQ ID NO: 24965 - DNA, 1082 bp, Heterodera glycines
gcgccaccgggaaaaattggaaattttgaccattttaaaacagattttcactgaaaagtggcaatttataggtcaaattttgaaattttaggggaattttggaggccggcggatatcaatagtgccgctataaatttgaaaaattgggagtttttggtagcaattttacataaaaatggctatttttgctgattttttccaaaaatcagtaaatcatgatctcaaaaaataaatcatcattgagcagttgaatcaatttttccttgttttcgacaaatataattttaaaattatctccaaagtttttgttaccactttttatctccaatttttgggctacaaaaccttccattttaaaaatatggaaaaacaaatgtcaactctttattatttacttaaattgcttattatgaaaattttagcacattgtccgaccatcattcatcagttccagccttaaaattgatcgtcgaatggagttcgtcagttcgtcatgaatttcagcgagttccgatggaatctgtggctcatgattacactttttgtcggggccgcttccaaagtgtcaattatgacacatatggtcaagacgaaattccaattcctttggccactctcatcgatgactatgtaaagcgggaaaccatccaagactggaagtgtccgaagtgtggtcgttcacccggtcgaaaggaactgaaattccattcgttgcccgatgtgctcattttccacctgaaacgttttgaattggtatgatgttctggctaattgtaaacaatactctcagaactctagaaatcagaaacaaataaaattacaattgattttcagctcaatgatggaattgcgagcaaaattgaaagccgtgtccaagttccgctggagggtctcgacatgggtccgtatgtgttcaaccccgatgttcgagcaaatacactgccgaaagtaccttccaattgaatgcaaaaaacgttaaaaattacatttctttagcatcggcgtgaaagggcgactgactttttgcacaaacaccctgaaaatagcatttacgacttggttggcgttgtttctcattttgg

SEQ ID NO: 24966 - DNA, 1713 bp, Heterodera glycines
  misc_feature (1576)..(1576): n is a, c, g, or t
  misc_feature (1689)..(1689): n is a, c, g, or t
agtgataatgcattttttaaattattttaatcattttatgataatttgtcaatagaaatgaaaatgataaattttaaagacattaattcaatttttagcgctgctgtaaaattactgttttctgtaattctattttacaaataaccgaaaatgttcgaaaaaatcataaatttttacaatatcatttttttaatggggggggggggagggacgagctgccgccgtattcggaatggctgaatttggaataataaaataaatataaatacaaatatttgtaaatgatagtgataggaaaagaagcgctatgtataattcccggcttggtgccgaaatgagcctggcgccgaaaggtcggcgctaaacgactatttcaatttttttcatctttatcctccatgaatgggtcgatcgattacaaatgttttatgataaaacagataggtacttgttctaataatacaaattaatttttgtcattcatcattttccttctgcaaattcattattcctctttgtcctgcttctgtttgtcgtggaaataattcaggagcagacagtataatccagtccacacggcaaaaggaactgcacagaaactggccacttcatcaattttgtagaaagcaaaggctgtagatatagctgtgccgtatatgtagctatagaccataatctaaatttacatatgtatgtatatcagcagggctcccattcgtacttggatgctaagtacgcacttggcttttatgcttggaaattttaactgtatttatttccaagattgtacttggaaaccagaattttggcatatgaactgaaaaatgtcaattttacggaaaaaagtttaaaatttttggaattatttcatgaataatcattaactttttttgttttttaattttcaaactaagtcggtaagaaactgcttttttattgtgtttcttgtcaaaaagacatcattgtcgaatcgatgggagtttcggcaataggtctatgttgaaaatttccaattttttcctccagggcgcctatctgcgccgctggacccccaaaacccttatttttctttaaaaattggcacaaagtcgcaaacaatttctgttttgcttcgactcattttttgctttaaaaggggaaattaatggaatccaaaaagttggccatcacataaagttcaacttttcgaagtaaaaaaatgaattgatactaaaacgaattatgctgaaaggaatcgacctcaaaattcccaatctttttcgagttgaagatggtagcgagacagctgaacatgttcagtccgtaacagctaagagccatggcagtgtttgtatttccgaagcctaaagtagtttttcattgaaaatagcaagaataatttatttttgtttttttgctgtacagttgaagcggtacacttagtacgaatccgcctatacgaatgggtgcgaccttatcagggctgtacgtaattacggattacggaaattacggggtttggagttatggattggacttttccgtaattttgatccgtaactggcttttttagattattttcgaggcgacttctcgncagatgttttttataaaatgaatttagctatttttattaaaaggctacccacatttcgatttcatttgacttattcttggtaacttgtagtattattagcatacatataaggnggggggaggctagcgaaggggaaa

SEQ ID NO: 24967 - DNA, 1310 bp, Heterodera glycines
gggatttatttaggttttctaacatcaatatgaaaaaagttattccagaaattctggaaattttagatttttcagaaaaaaattcgtaactgccttctgaaaagaaatttgagaaaagtaaaatactacaaaaatccacaatttttttctctataatataaattttattttaaatttttatcacatttttaaaaaaagatataaaaataaaagtgattttgtgattcgggtccaaaggggggagcacatggtttttgagtggaaaaatttttctcacaaaaatcttccaaaaatatgtctttaggggttatttgggccgctgatcacgaatacgtgatcagattttacttttgacatcgtcaagacctcagaatccctgtgtgattggggattctgaggcatcattttgaggggggggggcaggttcgaatccggacggtgtaacattatttttttgtgcatttttacgttattttcaatgaatttaattaatttaaaatattttgttgagttaataaataaaaaattatatttaatttaatttttttttgataaataaattttataagtttaaattaattatttttttaattgatagaatttcatgtatttttttaattaaatttgttaaaaatattttcttttagatttaatgaatttactaatcactgttgtatcaatttatatttaaagatttgttgtaaattaataataaaagaatttatgtaaaaaataacaattatcttttaataaagaatttcatatttttttaattgaatttataaaaattaattttatattaatttaaatattcaattattgtacatttaaaattctctttttaattaataaaaggaataattaatttattttttaaaatttataataaattgcattcaatttttgtacctcttctaatcaatctcagttgtacctcttctaatcacttttgtacctcttttaacaattttgtacctcttctgatcacagttgtacctcttttaatcacagttgtacctcttctaatcactgttgtacctcttttatcacttttgtacctcttatcaaatttgtacctcttctaatctctgttgtacctcttctgatcactgttcttcctcttttaatcagtattgtacctcttttaatcacttttgtacctcttctcatcactgttgtgccttttctcatcattttttgtacctcttctaatcactgttcttcctcttttaatcactgttcttcctcttttaatcacttttgtacctcttctcatcactgttgtgcctcttctaatcaaacacagttgt

SEQ ID NO: 24968 - DNA, 1717 bp, Heterodera glycines
  misc_feature (41)..(41): n is a, c, g, or t
ttttcaaaataagaacatctggggccaaaaataagattttnagggtcaaaaataagaacatttcgcaaaattgcttcaaatctgttagagggccggcggtgccgataggcgccgccggagaaatttttaagaattttaattaattttgctaggaattcgccaaatttttctgaaatttccctcttttagatgagaataaggcactaccctccaaatcagaacatttcttagaaataagaacatatagaaatcctgaaatattgaccaagatgaaaaaagttaagtacaaagaaactatttacgaagttttctgatttaaaatttatgtgcttctgagaaaggcataaacaattttttatattattgtaattttaaaattggaagaatccattaaattattaacacattttatttagatttagcatacaaaagcatatataacaagacaaaagggacagaaaaggaatggtgcaacaaattaaaaaaattttttacactgcttaaactgatcatcatgaatatgaaaatgcccaaataatttaaattgtccaaaaaagataaatcaggcggcgaaaaccaaaataaaaagcgatcagcgatttgattaaattcacacaaatttcgtgcatttttgaattggcttctcctctcttttctattcgttccgcttgttttctgatccgttcatcaccatatccatattatcattattatcattagcattgtccatacgctttgttcttcttcttcttctttgactattctctccgctgcttaggctttttgcagaaaattggaaattaactaattggattaattagttgatgagatggattttcattggactttcaagttcacggggccttgaaattttcagaaatttaaattccgaagctcaaaaaaaaattagaaaaacggaattgctttgcttaaaaaatttcagctgctttgttgacaaatgaaaggctttttgcttaaattttaatcaaaataaattaataatattaaatttaaattattattaaacttaaatacttttaatgaattgcgaaattttctatgttccccaaataaaatatttcagcattgtttcaatgttttcttcatttttgtagttaagaattgataattttttgattttttcaagaataatttttgtatcaatgatcggcttttcatttgatacaaatgctttcaaatttcccaatgattctttatcattgagaaatatgtattttcagcatattttcatcattttccaactgtttacaatgtttttgtgtagttttccaaattttcatccattttaaatccaaatttggcaacacataaaatgccaaaggcacgcttttcccaccatccaatttcaaaattggaaccatcaatttttcctgcttttataatttcattgaatgatgatgacgagtccaccaattcagtggccaatttgaagtaatctatcaatgtgaataggcaattaattaatgcaaaatttaaaaaaaattatttaatttttaccagttttagagtgcattttttgcaaatttgatatgctttgactccttttgcttgataaaagcatgaccaatgctaataaaagggtttttggcggtaaattgaaaaaaagcatttttatattttgctctgaaattttttttaaattaataaaataattaaaataaatctgaaatcgcaacgaaattttccaaaataggca

SEQ ID NO: 24969 - DNA, 1296 bp, Heterodera glycines
tcaaattcgatgccacgcgtcaaacaaacggcgaaaaagtcgcagtcgagaaaggagcaaggttccttccaacaccagcagaagatgaggagcatgcgcacccaattggccaccaaaactgctggaccaaaacgaatcggctataaggaattgccaccagtgaaaattcaacaaaaacgacaccacaaaaaaggcaaaaacaaacggaaatggaaaattcaaatttgtcaaaaaatataggtgctctggcgttgaaagaaattcgcaagtatcagaagagtgtcaatttgctcatcccgcgccgtccctttgtccgcctcgtccgcgaagttacgcagggaatgaccgtttccgacgacatcaaatggcggggcttggcccttctcgcgcttcaggtgcacccacacaaaatattttgactctattgcagttcacacgaccataaaataattggcgctattatggaaaagttaccgatttttggattttatcaaaaagtaaaaacaaaagggggggaccctttttgttttgcaaatttttttgatatatagtcatgaaaattttttccatggggttcttggggtccatgacctcggattagatgttagattcgtgatcagagacctctaaaatccgggataacaaattttcatggtttttttatcaaaaaaaatttgcaaaacaaaagggtcccccccccctttacttttgaaaaaaattcaaaaacggtgactttgcatatagcgcccaaaattttttcatttgatggttttttgactaacgccctttttgatgggttttgactaacttcatagcaccgtaataggtgcaccgtaatatctagagatcggattttgcagcatttgctgaattttttggtctcttggggcgttctaataagcatttataacttgattttaggcttctaggtccaacctttttatgctgatttttgcttaaattggtattttcatgcttaatgctgatcatgtaatttttgtgcttaattgacattttttgtaaaattttgactaaaacaccgtctcaacaataaaaatgaagaatacacccctaaatccctaaaaaaaattttttttcttgacaaaatttgatttaaaaatgtcaattttgctaagaaaattttaaattgtcagtgcgaaataaaaaattgagaatttattgttactaataaaatttttgcctaaaaatcaccaatttttatgttttttcgatctttgtgcttattttgccattctcatgcttatttcgtgcttaatataacaatttttggtgctg

SEQ ID NO: 24970 - DNA, 730 bp, Heterodera glycines
ccgtctagagcttaacaaatttaaaaaacgggcgcgaagcgcccgtcagagcaaaacaacatttgaaaaacgggcgcgaagcgcccgtactatgccgcgaagcgggcgaaaaggcccaacaaaatttaaaaacgggcgcgaagcgcccgtcaaagcaaaacaaaatatgaaaaacgggcgcgaagcgcacgtccgatctcaacaagtttaaaaaacgggcgcgaagcgcccgtctgaggccgcgaagcggccgaaaaggcccaactaaatttaaaaacgggcgcgaagcgcccgtctgagctcaacaaatttaaaaaacgggcgcgaagcgcccgtcagagcaaaacaacatttgaaaaacgggcacgaagcgcccgtctgaggccgcgaagcggccgaaaaggcccaactaaatttaaaaacgggcgcgaagcgcccgtctgagctcaacaaatttaaaaaacgggcgcgaagcgcccgtcagagcaaaacaacatttaaaaacgggcgcgaagcgcccgtctgaggccgtgaagcggccgaaaaggcccaactaaattaaaaacgggcgcgaagcgcccgtctgagctcaacaaatttaaaaaacgggcgcgaagcgcccgtcagagcaaaacaacatttgaaaaacgggcgcgaagcgcccgtctgaggccgctaaacggccgaaaaggcccaaactatatctaaaaacgggctcgaagcgcacgtc

SEQ ID NO: 24971 - DNA, 1260 bp, Heterodera glycines
  misc_feature (1175)..(1175): n is a, c, g, or t
  misc_feature (1247)..(1247): n is a, c, g, or t
ttagggaatagagggtaaaatctatcccactttaaaagtgctttacatgggcaatagaggctggaacaattggaaaattttgcgcaatttttggcaaatattaaaactaccgttaatttttttaattttaaaaattcaatttttgttgttgtttgagctattaaaaaaatcttttattaaatctttctaagttcaaggaaaatcatgattacattcaaaattttagtactgttaagaacaaaataaaaacaggtgtatcattcaaaaaataaataaattttatttaaggaaaatgtgtcaataatcaaaatattttaccattttaatcagtaaaatatatacagttgaaataatttataatagatttaaattttgtattaagttttgtcaattttttgttttgttttgtgaaaattatttgatttcacatctccaggattcgaacttggttactttttttcatttaattaggcaaaatgatgtcctacataaatgataaacaaatgagccaaaggctaataaaataaagataaaagaggctttaacaaaaaatgtgaaaaattacaagcaaagaccaatcggtacttgtctagtttaggtgatacgtttaacaacattttcagatgcctacaaatgtgttttataaattaatgaaagtaagttttaagggctttttggggtcgctgatcagtgatcacaatccgggctcagatcagcgcgaccgttcactacatgaggtttacatggacaatgaattgacaggcttcctgtaccaagggtaccctcattgtcaaggtgcccatgaggatacctaccattcatacaaattttcgtattttacatatatattcttactaaagtttaaataatcatttattgctgtttagataactttaagctcactttcatgtattaacaaaatacaattaaattttcaaaattttccccggcggcgccgccagaccccttaactcgacaattgttgtaaaaaataatgcagcaaaaataaatttcggaccgaccaatttttcgtaaaaataacaagcaaaatgaatattttttgtaaaaaaataatcgtcttgtctcgtggctcgtatctcgtattttattttgagcatgtaatatttgtgatgaatttgcattttagtgcttatttttggccttaattgtcattntttgtaaaatattgactaaagcaccgtctcccagcaataaaaacgaaaaatacacccctgagaatcgacaanaaccgaaaaactc

SEQ ID NO: 24972 - DNA, 759 bp, Heterodera glycines
aattaattcattttttttaaagcagaaaattattgaataatatattttttgaagtgaatggcgatgcaattaatttgaaaaatgatggacaatttgatggaaacaatgaatcgattgctgagcatcaacaactatttttttaatgaaaatcgcttaaaaaatagtcaaaaatttcaatttttccggacccaaaaactccatattttttgatcgactcaaatcgcaaaatttggccatttttgtggacaaatctgttaacaaatcgcattaaaaattacaaaaatttttcccggcggcgcctatcggcactgtcggtaccccttgtccctcaaaagtttttaggaaaaaccgccgcaaaaaatggtgtgaaaaaaaaacaaattcgtcgcccggggcaaggggttacctcacccccccccccaaacccaaatcctgggaccgtccctggtgcacaatcaaaaatataacatttaaacatttgaaggcgtgttttgaataaatttttatgaagctttttgatcaaaaatgaggcttttgaaaattttaatctgggagccctgagtaaaattgtcctaaatatttgaaattgattagggtaccaacagattcaatctgaaaaacactgtccaccatttgttcggcattaaaacattcttataacggattaaatattattttccgtccattttaataaataattcatttatgtttttaagctggcgaggaaaagctctcgcaattacaaaatgatcagaagaa

SEQ ID NO: 24973 - DNA, 867 bp, Heterodera glycines
ctaaccttaggtcaggctcgccgtacggacagcgcactttgcaacagtggccaatgtatggactgaacgaacgcaaacaaaaaatgtgaattaattattaaaatttaaattttcaaagtaatgaaaatccaaaactaattaaacttcgaaaaaaatttgaagacaaaaaagaagcagaaataaaatgattaaacttatttaggtgaaaacaaatcacaaatgaaaaaaaggggtgggtaaaattttttgcgaaggggtccggccacgtaaatagataatcttttatgattttcaaaccgataaccttccataagtgacgcatcggtaaccaattgggcaactgtccgtggtcgcagcattgtccaacatatccacgtcgttgatgaacaggcgacggcatgtctgcaaaggtgcgatgccatcgggacacacttaaaattgggaaattgaaaaaaaattgtggccattaattaatttaaataattttttggaatgcctgcaaaacaacgcccttttgacgagtctctatgtgtgccgggtgcacattggcacttcccagcgatgcacgcgttaaatggatcgacgcaatgaatgtccttataaaaataaaatgaatactgttaaaatttacaaaataataataataataataattattattattattattattattattattattattattattattattattattattaataaacatagatgcttgtatttttaagaaaatattaataaaggaaggatacataaatgaaaattgaaaacgattttaaaattcgcaaaatctctcaacatgttacaaatccataaatgattcaaaaatgaaaatatcaattttggttcaaattttgt

SEQ ID NO: 24974 - DNA, 1351 bp, Heterodera glycines
aacgtcgttcaaatggcgaatgtggtcgagttgttgttggcaaaacctggagataaaacccatactatcaaccgacacagcagcggacagaccaagtgctgagcaaaaagatcagtcccacgccgatagcttggcaagtctttggccaagcgccaagttggctgaaaataacttgggaaatgaccccaaagcataatggcacggtcgcaaaaaatgcacctgaaattgcaatgggcgaacagtgccaaaagcatggtgaacgagtagagcagacgaagcgcaaattgccgatttgaaatgcacaatgaactggccggattggtggaggtgcacaacggcacgttgaacagcgcaatgccaacgggcaaagcgataagaaaggcaccgacaatgtgccgaggggcccactggtgaagacaaggcaaaagcggacggcgactgagcagaggaagtccgatgagaacgacgacagctaaacagagcgaagcggaaacattgccaataagcgacgaccaaacggtgccatccctaatcgaattttaccggtgaggaaaaccgaagccgtagcaatgtaaaggacaaaaggcagagagacggcgatgttcggttggacgaggaacagaagggagcaaatgataaagagcagagcagacacttggcaaaatgagtgggaattgaggaagggcccaataatttgccaatgacaccgaaaatgtcgatgaacacgccagaatagcgatagcgtggccgtcgcgaccgttgctgctgcttcgactcggcggcggcggaggccaacagaacgggacggatggaaccgccacggttccgttccaactgagcactgagctgaaagaggtggccaggaattgccgttgaaataagtgttaatcaacggcacccacttgcttgtgcttcttcaacccattggccgtgcttcgaatcgctgagtgccgttccgacgaatcgcctgccgcaaaatgtgcacggtattcattttcgatgtccttttggttgaagttcagcgtccagcgattgagcgacttaattttgacaaagagaaatgaaacatttaagttttgaataagcggcactttttgatggagccaaaaacccttcgcgaaagtgccgttcgccccgtggatcacttgtgccaaccgctggtcaaagtcccgatggtccgtgtcttaaaagggaatgccattcattcccttccgcaagtgatttttggcatttgaacccaccgaaacgggtcaaagaggcggcgttgtggtggtgggaaatggccgtgtcgagtcggtcggccattgacaccgtcgaatggcccgcgtcggagccaatctcctaaacatgg

SEQ ID NO: 24975 - DNA, 1294 bp, Heterodera glycines
tttattaattaatccaaaattaaaacttgcattttatttatttaagccagcaaaattgttgtctattcttatcaatttattaaacaaatatttcttactgttcattttaaattataaataaatttttcgtattgttctaattatttcaaaaagtttttcaagttttgatctgcattagttattcgtttttaatatttcatgctagagaagcgttcgttttccataatatttattacgtatattttgatataatttcaattatgtattatcaaacaaattttgtattttaaaaacacatatattattttcatatataaactcagaatatttgatcagttcctaagctatttttgctctattatatatttatctatctaaatgaagttcaattaatttttttatttacattttcgttatttattttaggtatattttattaattaaattgcttggacataggttttaatttaaatgaactgttaggcttctattaaagtgtcaatgatctttttatttatttcatatacggccttttctcgctcaagtgcacatttgttgatatgaccgtgcaatagatcggctatttcggagttggaggctggctgaggcggcattaagtggcgggtgggatggttggatcgaagccgacagctcagggcgcttttgaaactttccctccgtcttcgagggagacaccattggggggggggggggggcggcaatgctttgattagcccagaaaaagaatttataatttaattaattaaatttttagatatatctactttattaattttattttacagttttttaaatgataaattcaaaattttatttttaaaagattaaaaaaaagttcttagtttcaactaaaatataaatttaattgcttgcgcgtaattccaaagatgatttattattgttttaaatatattgaaaaatattttgatttttcaatgaatttaaatttatttaagatttccagtatttattattaactttctcttatatatattttaattattaaactttttaccttttaatataaatttttcaacacatctttttataaaatttttgtattatttttttttaaattttaattttaggtctttcattcctattactcttggtgttttcagcatgaagatacaaaattaaatgttgtctaataaattgtttaatttgaagatagtccattaatgattcatataatatattgaaattattgttttctgaaaaagcgaatatagtctggccgtaatagtctcgccgtaatattctggacgtaata

SEQ ID NO: 24976 - DNA, 1157 bp, Heterodera glycines
caaaaaagagatagccattttctggcatagagaataatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagatagccatttttctggcatagagaataaatttaaaaattccctgtagaatagaatggccattgctctccgcgcccctctgcccatgctgggaaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgtaaaaaagagatagccatttttctggcatagagaataaatttaaaaattccctgtagaatagaatggccattgctctccgcgcccctctgcccatgctgggaacatttgtatggtacaaaatttctcgcaaaaaagagatagacatttttctggcatagagaataatttaaaaattccctgtagaataaaatgcccattgctctccgcgcccctctgcccatgctgggaacattttgtatggaaaaaaatttcccgcaaaaaaaaaaaagccattttt

SEQ ID NO: 24977 - DNA, 1160 bp, Heterodera glycines
tgagcatttctcttttacaatttttgtaagaaattccatgcattttaacacgcgcaattacccaaaaaaagaagaattccacaaggcaaaccaccgccgatggaccaactgactgattgagcgccgcgaaaaatgaatggggggggggggaaacgcaaaacgttgcagcaacgaagcagcagcagcagcagtatgcttaacataaatgttgaaatgggtgtgctgctgctgttgctgcgctgggctttgctttgacgctgatcacttctgacggcggacgaccgccgccgcaaaacgctgacaaattaaaaggaaaagaaaataaaaataaatatttgcaaattgcgtttttgctctctctctctctgctgattgtgagttgagtgtgtgatcgttgagtgttgttgtgtcggggataataagtgatcggccggacggcgatttgtttttcgagtgatttgatcccccccccctttctcccatttcgtacaaaaatctctttcggcgaattgcgcacgccacagaaacaaacacacacagcgaaattgcgcgactcttttctacattagtgcgctatgggtgatttatgaatgaatgtatcatttttggttatcgtcgctcatttgttattattaaaagtaattagtacgggcagagtggaaaagaaaactgacaaatgagagggatggatgtgtgaatggggtgcttatcattaattaccatcatcagtcaccgttttcttccctctctttccctatttctttttttatgtttcgtcccattttcatcacgatttgtgatcattcattagtgtatcattacggatgaaaaatgcagagcggtcggtggccagaacagaaagagaggggaagaaggacgagagtcttgactgttgactgatgaatggacgtgatgggtgggacacacaaacagaaggcgaaagagagaaggggagaggaacagaagtaagagagagagagagaggagaggaaagggagagaagtgagagaggaggagaggaaagagatagtgcgtgtttgtgttatcttatgttctctgcttttactgctgctgctactgaaggagttcatccgtcgcattcattattcggtcgcttttcaagcaattatgagggaaaataacgagaaaaatccctctcc

SEQ ID NO: 24978 - DNA, 845 bp, Heterodera glycines
gagatagtcatttttcttggatatagataaatttaacaattctctgtgaaattaaatggcgattgcgctccgccctccctctcacgctcgagcgcttttgtagcgtatgaaatttctcagaatacgagatagtcatttttcttggatataagataaatttaaaaattctctgtgacattaaatggcgattgagcaccgcgcttgctatcatgctggagagcatttgtaacgtataaaatttctcaaaataagagatagtcatctttatgggatataagataaatttaaaaattctgtgaggaatgaaatggtgattgcgcaccgccctccctctcacgctcgggagctttagtgcgtcataaaatttctcacctcccgccatagacagggttggcttgaaattgtaagcgcatgtggcatgaaacatgctgcatccttttcctttttgttgttgttgtgtggttgttgcagcaaagcagcagccatccggcagaaaattgaaaataatgaatgggaggggcgggatggggggggggaatttggaaagggaggtatgagggcggaggagagggatgggggggggcggcgtgttgacaatttgggcatgtgccagcgtgcgggtcattgttggcaaattctgctgtttatgatccctgaccttttcaccactctcgacttttgctcggcatgttcaaatgctttttgttttttcgtttctttcattctttccctttttaaatttgcctttttcacttttgccttctatccttttcgcttctctctctttcttttctcattctcttcctttcttctctccttccccccctctctcctctcctttttta

SEQ ID NO: 24979 - DNA, 1522 bp, Heterodera glycines
acattcaaataagcacagtaattattttattaggctatgcattgtaatgaaaattgaaaatgccaaaatacgcactaaaatatgccaaaatagaggatttaaaccaggggggacgcgaccgcggcaatttgaatccgcaatgcgcgactgtgatccgcggatttttgggactaaatctttataaagaaaatttattgcagcgattgtcttttttaatattctgacttaaaaaaacttttggaaacgggttatttttcttaaaaaatttctttgttgggcttggacgggcgcttggcgcctgtttttaaattttgttgacaggcgtgctttccgttttaagctttgttgagctcggacgggcgcttcgagctcgtttttaaattttgttgagctcagacgggcgcttcgcgcccgtttaaataaaataaattattttaaacccttcccggatttaattagagggattttatatttttttccttttaattttttttttttttggtaataattcatttaacttatttttaataaaacaatttataaaataacttttaaattgattttatttcaaatttgatttttaaaaaggataataaatatttaattaagcattaaaataaccaaaaatatatagaaattaatgtgcaccgtccgtgtccgaaccttcccctccccctcagaatgatcctcagaatccccatttacgaagggtttctgaggccttaacaatgttcaaagtaaatctgattgcagatctgttatcaggatcctaaaatacccttaaagacatatttttggaagatttttgtgaacaaattttccactcaaaaaaccatgtcaaccccctaaagtcccgtattccatttgaagtaatgattatactcggattgaaaatccaaaaatgccaaaatatgcactaaaatatgccaaaaaatgtatggatttaaatagacacaaaaaatggcagaaattttgtcaaaattcgaaattcgccatataaccatttatatgcactaaaaattttcactgaaaaattaaaattttaaaaaagagaatttttttattattactcaaataagtaaaccaatttgagcgagtaactcccgagttaaataaggtctgagaatatgtgttaaactacaaaaccaatggactgttaatgtttaattgcaactgcgtcagcaccagaaaataattttgaaaaaaagttttctgacgtaagagaatttttttggtatgaaaattaagggagggattcttggaaagcaatgatctgctaatgatagggggatatttaagattaaactacaaatgagcccttaatgcttgataataattgtgacacaaaacattgccagcgtaacacttacacctattaattttcaaattcaaaaagcggaaaattgtttgcctacatgaatttagcgtgacaatttaatgagtttatatttctgccactggtacttaatttataaatgcgtaggatgaaaaatattagtcataaaaattgaatatggataat

SEQ ID NO: 24980 - DNA, 1806 bp, Heterodera glycines
  misc_feature (1688)..(1688): n is a, c, g, or t
tttgggaacaattcttttttccattttctgaatgtttctttatgaatgcgcaattccttggcaaattctttctgttttccttggccatttaaattcatcaattctttcaatgagtttgagctttttctcatcataaaaactctttttcattctgttggttttctttaaatttaattcatttttccatttttgtattaattgccgatttgttcctaataattttgcaatttttctctcaattttgctttgatctttccctttgtattctcctttttctctcaacttttctttaattgcatcaaattttttaacagtttctcttttttgttgatcagtttgattcttttttaactctgaacacttttgagaatgttttgatcattcaaaccgttcatttgatcaattgggtcatttcccatttcatcaccgtttagttgaagaaaattaacaaatttcaaatttttattttgcttcttttgttcattttactgtttgatcactcccatctttgtcccatccgtcgccaaatatttcatcaaagtttggtcgaattttgaccgattcaattataaaagctttgacaaatattaataataaatgccacaaattcatttttatatataatggaaattgtataaaaaattctgtaatattatttatttatttcacaaatattgctcaatttttcccattttcttggcattcatgtaaatatcgataattcactaatttttaatatgaaaactgtttaaattttaatcgtaaatcagctcctttttctgcttttatacaaacgctaacatttgcttttttccttcccgttgcttttctttttatggtgagcggaagtgctgctcgagaccgaaaatttccattgacccgagacttaattaaaaaattttcttattcatttgtcaatctttaggagtttacatgaaattttttttgcttttttcccttgttttagccatcgtccatttttttttacttcctatttttcaactatatgtaaaaatatacaaaaaaaaaatttaattttcatcttaataattctataaagtttacacatccaataatatctcaggctaaagaaaatgacattaaactttgtaattttcagccaattttttaagaaaaatttataatttttaataaaatctattaaagaaaattggccaaatttttgagaatttccctcttcaaagtttaattttaaaaattttaatgtaatcatggtaatattaattattctcagaggcaaccaatctttactatatcaattttatctttcagagatacttcttttctatttatagtaaaatcaaatatctattttttaatgtttgcttttaaaaaatcaaatattattaaattattattttttgcgaagattattttttaaaaatctgagtaaaaattgaattctctgttagagattacgtaaatatattatattaatttttgaaatattggttaaagaaaaaataacaatgaataatatattgaaacgcgaataaaaaatttaataaatttatttaaagcaaaaaattcgatttcccaaaagtaaaaaaagtttgcatttaaaaattgctttttaagctttatcgaatggtgaatttcatattcggaaattttcaaatttttcgagctaggccccttagaaaaatcggaaaatttttttggacaanatggggttgaaaatatttttctggggtaaattatggtgctaagcacgaatatggtgattatttttcgtttcataatttttggaatttttaaaaaaaactataatatttttcaattttt

SEQ ID NO: 24981 - DNA, 1498 bp, Heterodera glycines
  misc_feature (84)..(84): n is a, c, g, or t
  misc_feature (96)..(96): n is a, c, g, or t
  misc_feature (206)..(206): n is a, c, g, or t
  misc_feature (1463)..(1463): n is a, c, g, or t
  misc_feature (1481)..(1481): n is a, c, g, or t
gtaactaatctgtgttctttgccgatgcatacaacaagggaatattaatgaaaaaataaaaagaaaatataaacattatttcanaattaagaaatntaataaataaaaattcaacattaataattatatatttttatattgaaaaaatgattaatgattgatagtaattgataaaaaatagactttttgactttttccgaaaaatntagaccgaaaaaaacattctgaaaatcataaataaaatcataattttgtgttttagcgccaaatggttgatcagcgcttaaaactatcctaaaaagtgctttgttttattttggtcatgcatttttatggggtgggcataacggaaaaataccgataccgtaacaaattgttttttgactatctcgccgtcagatttttttttgttaaaaagtagtcatctctcagtattttaattataaaattcagatgtttattaataaaaccacggtccataacacaattatttaaaattcccctaagaaacaataatattttgggcatcaaaattttcgatatcattcaaaattcgcttttccgccttccaaaacttctttttcttcatcggtggttcttcgccgttcacgatgttcacataatcggcgtcgcgcgcacgctgatccattcgaagaacttcgatgaagcgccaaattgtagggaacactgaaggaacttattttagaagcaaattgtggtccagttcttgccccacgatgtcgttcagcgcagcggtactaatttagtatgtgaaaattttgaagtcccttaaattcagggttctgatttttgccaagaattcttacgcaaattgggcgcaagcaatgacagaagagttcgcagatggaacatttccattgcactgcaaaacctgcacaagcgcctaatttccgaaggacttcaaaaggtaatttcctgttatcagaaaaagaaattgtctccttctcaaaaaaaattgtctcccgtttaacgctacagaagtgaccttttcgtagaaacggctcgtatgatcatcaccgcactcgcatttgtgacaaatcagcatattcaattttgtaattcggacttttctacttttctatttataatttatttattttggctattttattaatttaataaataaaacaaaacttactgaaatataatttggattcaaaaaaatgttaaaattttattaaaaatttcttattctttaaaaatatttaaaaataaaaaataattttacacttaacattgaatttctgaataaattataaaggaagtctatacttttaaaatatatctaaaaaaataataagcatttatgaaataaatttaaatatttttaaaagtttttcctagtgattctacaaaaaataaccgcaaaaaatatttttattgcacgcctgaacagaaaaaaagttatgagttatgcgtttagtctgaagtatttcacccgntatattatttatccaaantaattttaaaaaattaa

SEQ ID NO: 24982 - DNA, 2656 bp, Heterodera glycines
  misc_feature (2528)..(2528): n is a, c, g, or t
  misc_feature (2606)..(2606): n is a, c, g, or t
gacaaggggcgggcgcgaagcgcatgcccttcgaggtgcgcgagcgaggagcggagcgacgagcgagtgtaccgagcaatacgaacctggcctcttgcccggtagccacgcacggcggcgcacccggggagcgggggggggggggttaattataattttcaaaacaatttcacaatttgttactgaaaactccgcgcacaatataaattatgttgtgtaatttgcttacgaatacacactgccaaaaaaacattttttgttaaatttcatttatttattatttttatcataaaaaatagattaacttaatgaaaatatacggtaactgattatacggtcgacatcggaaaacaattaagcagatttcaaacggagaagttaattaaacaagcaaaacaatggataaaaaatgtgcaaaatgggcttaaagaagactttgatcaaaggtaatgtcggttgaaacagcgattgattttttgttaaaatttattattacatttgtccaagaatttcaacttttgggatattttgagccattttgaaattcttatttagggaaattttttttttgttgaaatccaaattaaattctgcttcattcctatttaggcttttcatccaagttgtccaattacgttttttccgtcgccatttcctcgaacatattttgagcaagcgtacaacgctcaaacagtaaatcattatttattataattttaatgtatatattttataaatcaaaattacacgataatcttgtccaatttttaaatagtgcttaagattaattttaatacaaaaaatattttgcttttttatatttcattttatatttttgttgaacttttagacctttacatagatgttgggatcgaggaatgacaaaataaatttgactcttaaactaataatttaaataaaccaaacatttatgaccagagtgcaaaatttgtgcaaaaattaatatcacaaaacacaatcaattaatttttcactgattccagcgatttttgaatacaatttttcatatcagttaaaaaaattaaaagtcaaaattttcaagaaaaaaaaaaaaggtttagtgcaagaccgaaacgcgaatcgaaaatgcattcttttttaggcatttaatttgttgtatttccgcataatgcgcgattatgaatttttgcgggaaatttaccaatgcataattgggcatgaccaaatgttggcaaaaagcttttgacatggcaaaaaagggctgcggcaagaaatgactaaacatttaaaaagtgtttaaaacagggattttccatgattaattatgtttggtcaatttggcttggttacaaaagatttaaggaaatccgttgtccaaagacattgtttgcacatttttaaaaaatccataatttaaaaacccataattttatgtagccataacattgcaaagatttggacagcttaatctaaagaggtaagttagggatttcgaaacccctgacccgaattcaaacacaaaagttaaatttgaaaattttgaattttcgaatttgttcgaattcgggtccagggttcgaaagaggtcaaaatgaatgccattttggtgcttagcgacacaaaaaacccctagtaaatgttttcacggctctttaaagcaaaacatttaatgtgtataaaataaggtgaaaaaattttcaaaatagtccactttgtaagtagcgccatagtcattgccaaaggtagctgggctcgggcaaaaatttcttaattttcaagaaaaaattttaattcattttgatcattctgcgataatttgcattatggagaagcattgccaaaaaatgcgatcaataagtgtcgtttaagcaataaaatactagtaaataagaataaataattgataaagccaaataaatataaataactgaataaagaatgggtaaaaaattatctatcaaaaaatatagaaaaattatttttttgtttttaagttaaacttagtttttcaaaacaaaaacttaaaacaattgttcaaataattttgttttttaattcttttccgaatgagtcagcattgcgctcaatttgcgcttctctaattcggtcaagaactgcttgaacttgtccgagggtggcacattgataagagtcgggtccatgcctgccacaaggcatttgtccaagcgacagccgcggcattttaccatacctatgaaaataaatattttaattgattttggcaaaaattaattgtcccaacttccaactccatttcgtcttggacaagtgaacaaaatttgttttgtgacgacacgacgaaagaattgcttacaacctgcaatttcaaaaagaatattttacaatatccgacaattccaatttaattaatatttaatctggtaaattaatataataataaaaaaattaattaaaaattttattgcattttctcatttttgaaacaaatctgctcactttcacagcttttgacaccgtagaaaatgtactggacattgtcgtccgcatattttacaatttgccanattggcgttttgatcgcccttgtccatattttattgttcctgtgctctgagctttcgtcaatatctccgtataatgangtctggtctgctgcccattttccattgaatccgatgactcctgctttaaa

SEQ ID NO: 24983 - DNA, 1642 bp, Heterodera glycines
cgcctctaagtcagaatcccgcctaggcaagatagcaatattcttgctccccggtgtcgggaggcactacttatgcgccgcttgcggtgcagcacaaatgccccagcatctggcccgatgtgcgtgcttaattgctcgcacattgccaaagccgtagcactcgtgtgccatggtggaacgtcggggcgcaaaatcacttgtatacgacttgactactggtcagggggttgttagcagtagagcagcttttacactgcgatctgttgagacttagcccttgatcggatgatttgtcttctttttccccctttactttttgtgccaacaacattttaggtacaagtacatgagaaagaaaggctctcttaagggagatacaatatacaaaatcagtacaccatgaaattaggtagacataagtttcttgactttgcttttttttccatttatttcaatcggctagtgctttagggttttgtgttttgactttgcttttttttccatttatttcaatcggctagtgctttaaagttttgtctttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgcttttttttccatttatttcaatcggctagtgctttaaggttttgtctttgactttgcttcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttataaagaaagtagaaatttgattaaatgcatatacaaaatattacttttttaaatttgtataaagttcctagccgtatgtgctttgcgttggttaattgcagagggtgagtgtggtggatgggccgtttttgcgatatggtggttggaaaaaagaagcgatttcgttgtg

SEQ ID NO: 24984 - DNA, 1396 bp, Heterodera glycines
  misc_feature (11)..(12): n is a, c, g, or t
  misc_feature (26)..(26): n is a, c, g, or t
  misc_feature (92)..(92): n is a, c, g, or t
  misc_feature (1333)..(1333): n is a, c, g, or t
tgaaattgtcnnaacagcgaatgaanacgtggcgaaatcagtgccaatttgaggccgggttcaaggccaaaagaggggaaaatgtccatccnaacatcgctagaatactaaaaataggatttgtttttgttaaagtaaagtcgatagagcgataaaagtttaaaaaaacgaaaaaaaaacaaatagtttgtgactctctttgtgagtaaattgtacaaagtttttacatttataggtttaaaatcaaaatcataagaaattcattcaagaaaaaaattgatttaaaatttcagaaattttttactttagttttttgccttaaaaaatttctggaagaaaaatatttttgaaatttttgcgacgagattttgtccggcaagatttctggcggtgagatttcggcggcgagattttgcctggttaccaaattgttaacaaattttgtcaaatgaccaaaattagcgctttttggaaaattttaagaaaaatagtagttttttttgagtgcgggcggcggtgacggtagtgccgcccggaaaattttttgtaccttttaagcaatataagaattcagtacataattgagttttcagatagataccctccaattcaggacaaatctgaaaaatcaggagaaccttggattagcaataaattgtccttcagcgtgctctttcttgaacttttaaaattttgaggcctagatccaaaaccgataaataccaattatgcacacaatccatcaaaaaaacttgccaaattcagaaaaaatatccgttttgccaccatcaatgcatcgaaagggcaaaagcagtgtcaatttgaggccgagttgagcaaggccaaaaaagggtaaaatgtccaccaaacagcgttgtgcatgtgctgaaaaaaatcacaaaaattttataaaattgcaaaaaaaatttaaaaatgatttaccaaaacccaaataccgggcactttttattaaaaaaacgcggaatttgggaaaaatatttttgtcagctattcattgacttttacagaaaaaaacccaaaaattttatcgaatttggaatttcattttagagctatttttgaaaatttgggcctttatggttttggggctataaccaaaagaaaacttgccaaatttaaaaaaagcaatgtttgtccaccaattcgaaacgtggcgaaagaagtgccaatttgaggccgagtgaaaagccggtcaaaaagggaaaatgtccatcaaacaaacgattgttaagcagttgctgaaaatgttaagaaataaaattgcaaaaaaaaagcaaaactcctaaaaacgggcactaaacaacaacaaaanccggatttggtttttaggcaaaaacacgagaaattggaggcccattttccaaaaatccttaaa

SEQ ID NO: 24985 - DNA, 1333 bp, Heterodera glycines
aatgaatttcaaaacaaatatttccaatttttcagtcattgaacaattcaaaaaaaaatcgaaaaatatttattaaaatgttaaattacaattaaacaaaaaagtccgagttcaccgttccgtctctgttgtccatcaattagcaatattcgggccgtgtcggccctgaacattgtgccgacaaatgtccagcggtggcctttcgcgcgtcaattattgttctattaaatgaaattttaaaatttaattgattactttcttctcaatttcacctaatgtcctcattaatcacgccaaatttgagcggtttcgcgtcgacagagattaactcagcaggcaattggtgggaatgaacttgaacctaaaataatgaaaaatgtttaaaataattagttaatttaaaatcaaaatgtgtgaatcaccgtgctcggtgaacccggcacatttttggagtcaatttggacaatcaattgataagtgccgcccatcaatggcgtgtaaatgccctaaattcattaattacccagtttcggtgatctttttgttctgctacaccttgtagacttgattcctcagggcggacactttgacgggaatctttaaaaaaacaattaataataattaattatttggaaataattatccacaattaattaattaattgattattaattttgttcaaattacgtccgctctttcgcccaacaatgccgcattgattttgccgacttgttcatgcatttcggatgcgtcaatgataaattcggccgactctttgacgcgtgccgtcgtcagtccttcaccacgcaaaaccacctgaacaaaaaaggcaaataatattttgtattaattatttcaatatttttattcgtttttcttctgtattccccactttgcttagttcgtctctctcctccgccgccgtttggccaattttttcagcaattgccaacaaagggtaagcacttggcacgaccaattctaagagaatttaaacatgattaataaataattaaaaaaacctatttcccacctgaacagtacaagtacagcttgtacttgccggccctgggcggtgtgaacagcagctgatgtttgctgttgcccaacgagttcagctcaatgattggtgccgcccccctctcggcacctcccaacagttcgccgtccccgtcgcgcacctcggcacgcaatttaactaaaaaagtgaatgattaataaattgaaaaaatgagtaattctaagttagaattgtaagttcagcttttaacgaaaaaaccaaaaaggaaataatagagccctggaattttgaaatggccagggacgacctgca

SEQ ID NO: 24986 - DNA, 2005 bp, Heterodera glycines
  misc_feature (25)..(25): n is a, c, g, or t
ctacacccgaagcttttctaaattntggcggaagtgcaaccatgcttctcagggcaaccaccattttgtccataatccatctctcacatcggtctccattgcttgaatctcatggcgagattcggatctttcatgctgtattcaagaaattaaaatataatttaattattaattatatttttaaattaatttaaatatactatgaaaaattttattttaaattcaaaaaataaatatttttatatttaagaaaatttttatgataataatacaattattctttaagactacacccgaagcttttctaaatttggcggaagtgcaaccatgcttctctgggcaaccaccattctgtcccataatccatctctcacatcggtctccattgcttgaaactcatggcgagattcggatctttcactctgtattcaagaaattaaaatataatttaattattaattatatttttaaattaatttaaatatactataaaaattttaattttaattcaaaaaatacatatttttatatttaagaaaattttaaaatttttatgataataatacaattattctttaaggctgcacccgaagccgttccaattcggcaggagtgccaccatggttctcagggcaacgaccattcagtcccatagcccatcgctgacattgttctccattgcttcaagctcatggcgagactcaaatcttgcattctgtataaaagaaaataaaaatatgatttaattataattatatttttatgaataatttaaatattgaataaaaaatttaaataagcaaattttatttttagttttatttaaaaaaatttctcgacattttgcgtaaaattttatttataaatattatttacttcgggaaatatttaaatatttttgttatttgtttttcacataccgcatctctgccatgtgcaatgcgttgctgataacatgaacgattgtggcccaatgaagatataatcagtaaatttatcaatgaatctttaaagtcaaaaaagaaaagaatataaatagttttttcgtaaaattaatatgagaaaaacaaccaatgaaagggaggaacaatgtttggcatcacaacaaaacaacaattatttacttatgaactaagtaattttgaacatataaacgaagatgaaattttttgattcattctttttattgaaaataattaacttttcgcattaagcttattttggttatttttattcaaaatttaaaaatttaaacaaaagattaaaaaagacgaaaaaggtgtagaactttaaaaaaataaactaatccaagtatgttagacaatcggcgatttttggagttagtgaatttaattatattattaatattttattaaaaataaaaattttaaattattttaatcttaaagtgtgaaaaagaaaaaatcaaacccaaaagacacaaaataatctgagcgcgaagtatgtatgtatatttatgccaaaacaaaaggttttgcttattttgattcaaataaaaatcagtcatttggcagacattttcttttgcttaaatgggagtcgaatcaaaaaaatcaccttggctacactttcctactaaaggttgaagcaatgcaaagaattttaaggatcttttcctaaagtgccaatttttccaagaaaaactctcttaacttagcttaaaaatagtgaaatgaaataatcttgaaatattcgacaggttggattttgcggataaccttataacttcaaaaattttctctattttttaaatttgctattttaatttttggtcaatctttttaataaatgcaacaattgtcggtaaaacttgatcaaatagatcagcttgagtatataagtgtgaattttcgcgcatatttattaatttcaaattttggtgtgtgtgaccccaaaacaggaaacaaccaaaaaatgcgaaataaaataaaacaatatttatattgatgatactttatatttaaaattaaaaaaaattaattaa

SEQ ID NO: 24987 - DNA, 2121 bp, Heterodera glycines
acttaatcattcatttttcgaaatgcatttttatttcttaaaatttattcctttaattatatattcctttttgttcatcttttcaaatgccaacttttcaacggtaattgttaaaaaaaaattaaaaatttataagtaataattatctttatttaattaggttgatgatgacgcatttgtcgcatttgtgcaagggcctgccaattttgagcattttttagcgggaaaagcagtgaattgagcaaaataagaaaatgttggcacaaatttatgactcttaccttggcattctgtatgccatgagaaaggattggtactgcaataatttaaaaatgaagtttgatggatcatttaccaaggatgtgtgtgtacagtatcgcaaatatttggacatactgtacgaatatttataccatgttcatgccggacattccgtaacgaggccaacattcattgaaaatgctgcattaagcagatataatagagatctgattgagtttctgatatcattgtcaaccatttccaaattttatctttttgattcggaatttgctttatcttctgtgacggatcgtgaggaaatcaaaattttttgcaaatttgaattggaaaatgagaattgcttagaatatcatcatggcctcgcatacaatgaaaaagaatttaataagaaaaaaaggcaaaaaattgactcggaaattcgagcaaaatttgaattattgatggaaaaacatttcaataaattatgggaaaatgccaaattgaaaaacggaaacaaaaacagtgatagaatgtccatatcattggcaaaaacaatgccatcggattatgctgtacatatttatgacacctttttgggcatgccaatatatgactttgatacattagtaagtgaggaatgtgccaaaaatatgggattaattttttatattgaaaatcagatggaagacgaagcattgattaattttgtaaaaactggaggttcaaaaatgactaatattgaaattgctgaagatattgaggatttttatgaagcagttgaaatgcatcttggccttctgttattgatgagaaacaattggcactgtgccaatgccaaagtcgcaaatgcagaaaatgaatgccaaaaactccgatatttcgtggaaattttctaccaatatttgttcagagaatggtgtggaattgcagctgtgaagccaatgttacaaacgaataacgattttgaaatcaagtaaaaactggtttagagtaatttaaaaaattaaagttttttaacaattaaaaaaatccaaaaaagctcagtttactgaaaaatgcttggactggggggctggattaataagacaattgatttccacatttatggcaaaattacgaatttttagcttggattaaaacattgaaattttattgaaatccttccgagcgattaatttaatcatcaagacgaccttcgttttattattattactttaatttcaggccggttatcctaagtgtggaagatattctgagctcctttaatcaaatttcaatgtatttttttggcgcaaattcgagtgctgacaaaaataaatttgcacatttgttgggagagttagctacttataaattattaaatgagcacgaattggattataatggaactccaggtaattgatgggtaggagataattaaaacataattaattcattaaaaaatatgtgacatttcaaaatcaatttgttacaaacatttcaaatagtgagtgcttcggcttcatcatcgactgctggaaatgcttctaatttctcaaggtaatttgttggcgcgtaattttaaaaaattcagggacctgtttcgaattgcacccggacttcatttcaagagaataaatcttttttttcaacattacttatccgggagaatttttcaaaaaaattaactgattagaaccaagattctctacgaaaatccctgcagttcctgagcaaattcgtgtcatcaattaattaattaattatttaattactattttttgtagaattcttaattcgtaaatttgacgaagaattggatgccctgcttgaaaaatggagaagaattcctgtttctggattggaaaattcaccattttt

SEQ ID NO: 24988 - DNA, 1276 bp, Heterodera glycines
tttttaaattaaaatgccaaaaattcaaaacaaagaaatcttctctgaagatttttaatttcgcttcacgattctttaagtccaaccgtgaggccggacagttccaaaatttcgtaccacatttcagtggaaagtccaagtaccttaattggacaaattcttgtcaacgagaacagtcgcgtttggcgagttgtggaacagaaaaaggggaatatcagatggggtgcgttattttaaaaatttctcttttcgtctaccccccccttctttatgcactatttcttaccaaaattgtatcaattgtttgtttttgaaattgaaatgaaaatatacacgaaaattattctcgatttaaattttgcttaacaatgcttttaagtcccaccgttataaaattggttccggattttcttagcttttttaaattaaattgccaaaaattcaaaacaaagaaatcttctctgaagatttttaatttcgcttcacgattcttttaagtccaaccgtgaggccggacagttccaaaattttgtaccacatttctgtggaaagtccaagtaccttaattggacaaattcttgtcaacgagaacagtcgcgtttggcgagttgtggaacagaaaaaggggaatatcagatggggtgcgttattttaaaaatttctcttttcgtctaccccccccttctttatgcactatttcttaccaaaattgtatcaattgtttgtttttgaaattgaaatgaaaatatacacgaaaattattctcgatttaaattttgcttaacaatgcttttaagtcccaccgttataaaattggttccggattttcttagcttttttaaattaaattgccaaaaattcaaaacaaagaaatcttctctgaagatttttaatttcgcttcacgattcttttaagtccaaccgtgaggccggacagttccaaaattttgtaccacatttctgtggaaagtccaagtaccttaattggacaaattcttgtcaacgagaacagtcgcgtttggcgagttgtggaacagaaaaaggggaatatcagatggggtgcgttattttaaaaatttctcttttcgtctaccccccccttctttatgcactatttcttaccaaaattgtatcaattgtttgtttttgaaattgaaatgaaaatatacacgaaaattattctcgattttaattttgcttaacaatgctttttagcccaccgttataaaattggttccggattttcttagcttttttaaattaaattggccaaaaa

SEQ ID NO: 24989 - DNA, 1278 bp, Heterodera glycines
ctgaccacgttcgaaattgatgaaaagataaaatcacttaagaatgttctgtgaaagtttggtccgttgtgccaggtcgcgcggtgttcaaatggagttgccaaagcgggggattgaccattttgatgatacatcactgtgagttaagggttaattcacggtcactgtttagggggcaaattccgttaatgattcacacggtaaattaacggttcacgggctcaattccgatcgactcacgtggcatttcaccgtcatttttcgcgcgatcatttcacgctcaatattcatgggggcaattcacgtcacatttcacaggatcattattgacgctcatattttttgggtgtcaatttttctgtcacggatttgctcagttgtttaaaaatgggcttttttaattgaatatgtttttaataattttttaaactcaaattaatatcatcttttttccagtgaatttgtccgtgagcaattcaaattgttttcaaaacatcttgtccgttttgtgattttctttgcgcccgcgaaggatgcgtcccatgccggtgatgtacaccatacgttcaaattgcaaggaattaaacagggcaagtccaactttttcctccttattgtagtgatgttcaagactcaaaatttccgaaaatttaactcaaagaatataggaagaaatttttcaattttacggaatataaattaaaattcctactccattcatttgactcccgccaaatggccgcattaatcaaaaaaataatggccaaactggggcttaatgatcaggcggagaagctaaaaaagcaagggaaaaagctcgttgaaaatgcgaaagaaatacaggaagcacaagaaaggcccaatacgcctttcaaggataatgaattatacttagaggaattaaaaaacccaaagtttactgctggagaggttacacttgaagtaagcctaaaaatgtttgacggtgtcgggtccactgatttgcttcctttttcagacttttaaacaaattcatatgctcattttaaaaaaagacaacgaagggatgattcctggaaaatttcgacaaaagaatgtgtgtgtaaaaaaaggaggaaaaattgtgtatgtggcgcctgactacaaaggcttggatgaaattgccaaagtttttttgaaaaaattaaacgaagttttggtaaattaaattgatagtgccttattttcacataaattttaaaattataataaaaaatagggacctaattttttttcaattttctgatctttttcattaag

SEQ ID NO: 24990 - DNA, 2102 bp, Heterodera glycines
  misc_feature (2050)..(2050): n is a, c, g, or t
aattcatacaaataatagtttattgtttttgtacgttattcgaattttcaattaaaatttacaattatataaatatattttcatcaaatttaatttatttaatgccaaataattattccatattattatttttatttttacataggtttaaatggttttatgaattttgataaagatgataaactttaatgtttggaattatttttaaaattttaaattataattatgtcatggttcatcgcctttaattattttaattcataaaatattttcaaatttgtatttgtatttatggaagtgcttttataaatttaatttgtttaaataattttaatttctctcttaacatttttttctattttagtctcatgtttgcttgagtagtaagttcggaagtatttgtcgtcggtttaccaacttgaattaaaatgttttatttatttatttattttcctttttaatttatttccatttattttaacgactgaacttcacaatgctcatttaatattaatgctatttattatttaatttgcagattaaaaattatagaaaaataaaaaaatagttatattattactatatatgttatattgactaggggtttcgttgccaaaaacaaaatctcccggccgaaggccgggagcgccctgaaagtagtggaagggtcttacaactttttgaggtgcatccgggaaaactataggttttttgatccgacggccaactgagtcccagggagcgatttgtcacttttgcttgcagtttaggacccgtaactttttttctaaaaccctaatcaaaaagtacccgctttgagggcacccccccaaagggtcctctacatgcttgtattttttatttttttattagagccaccccttggtctgcagttgtgagcaactgaagcgtgctcaaaaagtacacttcagtaccaggtgaataacacgccgggcttttatctgagggaaatgtgcccagcagacttattgtagagcttggaaagctcgattttttgaaatttcaaaatttcgaaaattttcaaaatttttcgagttaggcctaaaagtaggttttggggttttttaattttaggattttttaacgatttttcccgggaaaacggaggactcttccaacacatagtttttcgagctctatcgaatggtatttttttcggaaaaatttcagttttttcccggaaatagaaaaattttttggcctgagcgggacatttgagtcccgggcccataactcgttaggggttgatttaatcgaaaaaatgccttagagctaaattgtagagcttttaaaatgctatcgaatggtgtgatatatggtcggaaattttcaaaaatttccgagctaggccccctagaaattttcggaatttttttgttgtgttgaaaattggggtgaaaaatatttttcaggggttaattaaggtgctgagcacgaatatgacctttgttttccgtttcaaaatttttggaattttttaaaaattcgaaaatattttccaattttttggccaaggaaatttgggctaatatttgaaaattcataacatatgattgagttggtcaatttaaatgaaataaagctttaaaaatagagaaaaataaggagaattttatgggatttatttgggttttctacatgaattagaaaaaaattattccagaaaaactggaaattttcgaattttcagaaaaaaattcagctctcggttctgaaaggtcactctggaaaagtaaaatactacaaaaatccgcaatttttagccctattttataaattttatttcacatttttatcacattttaaaaaaaagatacaaaaataaaactgattttgggattcgggaccaaagggggtggacaggatttttgagtgaagaaattttttcgccaaaaatcttccgaaaacatgtctttaggggtaatttggaccgctgatcacgaatacgtgatctgattttacttttgacatcgttaagacctctgaatccccgtgtgattggggattctggggcatcattttggagggntggggcaagttcgaatccgggacgaaacacattatttttctatgaaattttt

SEQ ID NO: 24991 - DNA, 1484 bp, Heterodera glycines
  misc_feature (1401)..(1401): n is a, c, g, or t
  misc_feature (1428)..(1428): n is a, c, g, or t
gctaattttaagttgttctaataataaaacatataacggcttaaatgcgcgggcggatttcttaatgcaaaaggatatggcaatacaatggttcaatattgctttgatggatattcattttgctatgcggcaacctgcgccaaagttacgttttcttttcattgtttcgatagcaaattattaaaaaaaaaaacaaattttttttgcgaaatttttaatttttatttgagccgaaacgggttcggattcaaaattctggcacattgattttttaaaattaaaattttaagctctacgaaataaatgtttaaatttctatgtctgatatgttaagaaatgaatttataatactgttactgattgtattttaataataactttaggtgaggagcatgtccgaattgagtggggatgtgctaagaaaatggaatgttctgcaatcagtgccggtgtacaaaaggataccaaaatggcggggattaattgccagtgtaaatttggcgtgatgaatgacgatttcggaaacagaaaattgcatgttacaccaaaaggacggaccaccaccactgttagcacgacggagaagagaaccaaacgcactcgcaccacgaccgaatcaacttcaacaacgaaagtgccaaaatcaaaatgaccaatagggaaaattcaaatttaaaaaaaaaattttgttggcaaaaaaatgatataaaattgggatttgttaataacatgaaaaacaaagttttagttccaacaagcccattaattggactcataaaatgcaatagaacagaagtatttctttttttcaaataattttattaaaattttcagccttctccttcacttgctaatgtcaaaattggaaataaaatgcagtgcatggccaagaacatttgcgatatgtttgttgctttaatatttgcttttaaacaaattgccccaaaatttgtttttgtttttttccagtaatgaaatgtggaagggggcaaagcttacgaaacgctttgaaattcgcaaaaagtgcgaggaaatggtcaaaaattgggaacagatgacgaaagaaattagcactgaatacgaaaatgcggacaacaaaaacagtgcgctcaacaaaaatggccaagtgttcttggcggatttcattagcgcgcgcattcattaagcccgagaaatgaatgccttttcgtcaaacttaagcgatgttttactaattttgggatttaaaaaaatatatatattatttaaaacatattcattttgtaaaatattttcctaaataaagtttttcccgaaggatcggttaccaccgccgaattactttataaaattatttaatctgaaaaaattaaattaaatttttttaatttctatttaatttatatattgagacgaaattanaataaataagaagaattttgggactanatttaagagtaattaaagaatgaatttagagaaaaataaacgaaccaaatttcttt

SEQ ID NO: 24992 - DNA, 946 bp, Heterodera glycines
  misc_feature (12)..(13): n is a, c, g, or t
  misc_feature (87)..(87): n is a, c, g, or t
taaaaatatgtnnttaagaatatatacgaattatatatttttcttacgtttttcttcttttttgattaacagttattaaataatctnttgtcttatgtgtgtagatatcttaaaaagataaatttgtaaattaaatttaaaagatctttgtcagctgaaataattttaaaatggtcatattaataaaggttaaaattttttataatcaacataattcattttaatctttttaaaccataaatattctttttattaatttaataatcttggggggttttttttataaatattacatatgaaggaatgtgaattcattaattggaggtaatgatgaataatcaccattgctaaactatttggtaacgtgaacccaccaaaatcatttcacaaatcacattctcaaaaactaaagaactctgtccaaaaactaacagtttgtttaaaataaggaaattatttttattttaataagaaaaatattttttaaggctaaaatgcttgggaaacgccaatttgtcctcattaatcatgtcattattattcattttacactcatcaaaatgctcgatacaatattgactaagccgtacatcaaagttcctgtttcgcctcagaatccgagtgtgcaagaagatatattgagtggggttggccttggtatgtcatttggcgcattcggcggcggatcctttggccttgtcctcctgggaattgctggaggccattatggagctttgatgaatgagcaatatacgaattgtcaaacactagttcgggcctgcatttgcaataaagccacctgtgttttaaacgcagatgaacgatgtttgctttcgtttttgttttatttttttaatgaaaaaatctatttaaaataaattaagggaattcggaagctgacacatgatgtggcgaaatccatgaatggacatgcttttgcgagtgg

SEQ ID NO: 24993 - DNA, 1754 bp, Heterodera glycines
tttgaactatcaaattgttgtcttttcctctccacttttcctctgattggtagcatatttttaagaaaattaaggaattttagggtcaggcgcctaaagagtgccgtcagacataaatcgaaaaattctgagcgagtattcttgaatatttttctcaacaaaacctcgcgggatcccgtcccgcaaagaattttggattccaatcccgcagcgggatccgcaaatttgaaatttccggtctctagtgatcatacgcttcactgcaccgcctcgctttatgattgaagcaacaattttattagaaacttttattttgaaatttttatttctaagaaatatataagaatgaacattatctcgaatgattaatgatcattggtcggaaaagcaagactcgaccattcgtttatgtagcgaaaaattgaattgattattttggttcgatggcaccttattttttagaactttattttctcattgataaatttgtagttatttggtttttaaaatttaatgtctatggttttggaacggcaaattttggaaaatttttgagcaaataaaaagtttttagttttttttgtttgttaatgttaatagtgaggtgtgcctggtaaaaaattaaactttgttagcctaagggtagtaggtgaaacacgaaaaatgtttctgaattttgatcagattgtatataaagataactttttttttaccaattttgggtcttttcgggaataaataaatatttcacaatttttgcatttttagtcaatattttgttcccaatttttgaaattttcataagaaaaattcaaaaaatcgaaaatacacccctaaagaaacgacttttttagaaacttttaaaaaaatacacatccgaaaattttcactgacaacaaatgaaattattagaaaaattttgagatttatttgattaaattgtgaagctagaattaaaatttggcattttaagctttaaattttttggtaattaagtttattttttaagtttgtttaagcaaatattgaatttcttggaatttttgagagattaaaaattaatttttgtcagttttcagtccatatttggcaatttttaagctttttcgtccatatttgaccttttttagtccatataatttcgagccctaatacatatcagcttaacgtcattaatttcaagtttgggagtattgaaaatttattgaaaaaagattcttggctattttttttctgcttttcgtcatatatttaaagaagagtctttcaacgagaattatggattttatcttactgatgagctcaatatgagagacatttttaaaaaatttagataagtaaaatgaaaattatttaaatatttggttttattcttataattagggcttccaattatatggaaatccatattttttttcctggactgtgggaggtctgaaacgcacgaaaaacatgtttttaacttggtttaaagcttctaggatgggtttccatatccatttttcccatatttttccatatttcgcgatttatgtccatatttccatatttttccttattttggcatttttatccatattttatgtccatattctgggatttttccaaaaaacctctattagaaagacccccatcagctaaattgggattttgaccccaaatcggaaaatttttgcgaaaaagacattttttatcaaaattttgtcgaaaattttgattaatgtatcgtgtttttttcttcaaagaatggtttt

SEQ ID NO: 24994 - DNA, 1138 bp, Heterodera glycines
caaatgctccaaaagcgagccaagggccggagagcaatgaccatttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaaatggctatctctttttctgagtaattttgtgttcaacaaatgctccaaaaagcgagccaagggccggagagcaatgaccattttaattcacagagaattttcaaatggctattctacgccagaaaaatggctacctctttttctgagtaattttgtgttcaacaaatgctccaaaaagcgagccaagggccggagagcaatgaccattttaattcacagagaattttcaaatggctattctacgccagaaaatggctatctctttttctgagtaattttgtgttcaacaaatgctccaaaaagcgagtcaagggccggagagcaatgaccattttaattcacagagaatttttcaatggctattctacgccagaaaaatggctatctctttttctgagtaattttgtgtttcacaaatgc

SEQ ID NO: 24995 - DNA, 1452 bp, Heterodera glycines
  misc_feature (1417)..(1417): n is a, c, g, or t
aagttccccagtcgattttcccacgttgaataatttcgaaacacttcgaaaggttgcctccgaccattcgcaattacaatctttgtcttcattaattccgcgcaattacgaattgtctgcaataattagtatatgatctactttacctttggtggtgctgcgcattttatgtacaatcacatgcattttagatcagttttttgttctatttttgccactttattctcgcggaagtcctctcatttggtcagtttcgctgtatcggcaacttcccactgattctgcagcaaattccgacactttttcaatgtccatcacaattttttcaaatgacaaatttcgctggtgactcggaaatagcagtgggtagttcagtaagaagccaggcgttccgcacatttttgattggctatggtactgtttgatgccggccaattcttctgctgttaaaataccgtacggtcctgtaaaaaaataaatgacataattgtaattgttagtgatccttaaaaatgtttagtttttaaaaagataattttttaaaaaagtgtcaaaagtctttcaaaatgtcaggttaagatttttttaaaatctagcgatgcttattagtttttttttgcagaaaaatagtatttacatttttttatatattaattcccgatttttaccaattttttccgaaaattcattttgtgagaaaagcggaaagcgaattttgaaaagtgccgagccaagcatttgacggcgattctctgctgaacaatcaatgccattttcacggcacttttcgtcggcccaacggattgccaaaaaataaattagaattaaataggaatattttaataataaaatagtaatttttataaattttaaaaaaattactgcttcccatacagaaatctcttcattcattcgcaattggtcacgctgcaaaatttcgcataataatttttgatcaatttgcaaaaattcctccgatttgagcaaagcgtccgcatttttgttgatgtaatccaaacaatcgttgcaatattccttcaattaacaaataataaataaatgatcaattataggttattttatttaaaaataataatttaatagatgagactcatccaaaaaattaattgcattctttcgtaaattcgaaataagaattgatatttctttcccacctccaattcaaaaaggcgggcctgggcaaaagcgtagaaaacatttggcaattcggagaagggaatttgcaaagatgcgtcggccaaatcagtgatattgtattttttggctaattaggaaatcaacaattattaaattttattccaaaaaacaaatccaccggcgtaaagcactgccattgcattgccgccgtttaatccgcttatatcgtccgtgtaaatgaagctcaacatcactttanaggcttctgcttcatcgtcagggatttccacaaca

SEQ ID NO: 24996 - DNA, 1382 bp, Heterodera glycines
caattaatcatttcttctgcggctgatcaccgtttttgatgttttgtccgtcactcattgtcagaacacgaacaaaaatgtcccaaatcggctggtgaatccataaatgtaaatcagtgcctgtttggtcgaaaatttggtgatttgaacgaagaaaatccaagtcgaaatggaaatgatcagcgaagtaaattatgttggccaatggactgtcagccaatggaatggcaccgaatttgcagcgccgataatgacaaaaaattgtggtaccgttgttgtgaaactgaccttgcgacgaatttcgattggtctccaaattgtcaattagcttttccaccaacgcattgaaacgtggcgaaagcaatgccaatttgaggccgagttgttcacgtttttggtctaaaaatggtttaaattattgttttaattaagcctgatggatgactttcagttcgtatttaaacattaacaaatatgtaaaaaccgaaaaatttgaatttccattgaaaaaaagttgagttaatcaataacgcacaccatctcaaacatgagaatgcgaacatacagatggtgtataaaaaaacaaattgtggtcaaaaaatttatcgaaggataaaaaattatttaaatattagaaggggttcaaaagtgataaaatggtacaaaagtgattagaaaggtacatatacaacagaggtacaacatttgttagaagaggtacaactgtgatgagaagagatacaatagtgattggaagaggtacaaaagtgattgggagaggtacaaaagtgattagaagaggtacaacagtgattagaagaggtacaactgtgatgagaagagatacaatagtgattagaagaggtacaactgtgattaaaagagaagaaactttgaaatacaatgattgaatatttattaaattgaaaagaattttttgaaattctaattgaaaaagcaaatgaattatttaatttaaaaagaaataaataatcaattttaaatgtcaaatttaaattttgtggtcaagatatggggcgcttcgcgcccgttttttaaattttttttggttcagatgggcgcttttgcacccgttttttaaattttgttgaactcataaaaaattttattgttaaataaattaaagttttttaaattaataaaaaccttgaaaataaccctaaaatgcacagaaaaataatgttacaccgtccggattcgaacctgcccccccccctcaaaatgatgtctcagaatccccaatcacacaggggattctgaggtcttgactatgtcaaaagtaaaatctgatcacgtattcgtgatcagcgtcctaaatacccctaaagacatatttttggaagatattgtgaaaaaaattt

SEQ ID NO: 24997 - DNA, 882 bp, Heterodera glycines
gaatttcgactttttgattcaagtcttagaaaagcgctaaatttttgaaaattatcagtttttaaattaaattttttttcattattccccctcaaaaaaaaaatccgaaaattcagtggtcatggccggcattgtggccatctacgggctggtggtggcggtgatcatttccggccggctggaggcggccgggcccggctacaccatcgaccgcgggttcagccagttcgctgcaggcctcgtgtgcggtctgtgcgggttgggcgccggctatgccattggcgtggtgggcgacgcgggcgtgcgcggcctgtcgcagcagccgcgcctgtaaaaagcggtgttgaaagcaaaaaaggtcattgatttacattaatttacatggccggagaccccttcgcaaaattggaaaattggccgctgatcccttgttttgcaataatctgaattctgagctctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaatttccaaaaatttttacgttggaaaattaccggtttttaccggtaccggtaccggtggaaaaagttggtaccggtaccggtttttttacaattaccgattaccgctcaactctagtcgaattgattatttatttggggtaaagtaaaactccccgaaatctcatcatttgcaaaatattctcctatttggtggtcctcttatgtgcgttccctttttcttccgatccgtcgtcattttatgtcaaaatgttccgcggccttcgtttttttactaaatttctt

SEQ ID NO: 24998 - DNA, 1010 bp, Heterodera glycines
  misc_feature (896)..(896): n is a, c, g, or t
cccctcagaatcccagcgtatcacccctaatgcttcacgcaaaaaattttcaaaaatttcgaattccgccgtcacgcataacccaatttaaacttgagctagaaacatgcttaatagctcattagaagcgcctaagtcttctgatgtgccctttctccaagcacaagacgctatctttaacacccttcgcgctagaggccgacaacagcgacccgttcaaaaaatttccgaaaattttcaaaaattttctgaagaaacttttttttaggtgaaaatttcaaaaaacgctttccaccattcgatagagaatccttaaaaaatagttgtgctcttttgttcggagccgatccgaccaacttgaagagagttattcaaaaagcgcggttccacatcaagtatcttggtgagtataggacatgtaatgcccaaatgtatatatggcgtatttcactatattttaaatatttccagtataaaaaattctttaaaattccaaaaaaattttcacccccagaattattaaattttttattagtgcaagagtagtgcaagagtagtgcaggagttgttcatcagtggttcattagttgttcgtgagttgttcaaaagttgattattttacataccaagatgcacatgcagtatcttggtgataactgaagttaaatcagaaatttaaacgtcaaacatctttttacactgttttaagactttctgatgtattacttttattacttaacctaattttcaaaattgaattttttcggattctggacacaatttcccatgaagtatcttggtcagtattggacatgtaatgcccaaatgcacgtagggcgtctttacacattattttaagtatttccagtgtaaaaaattcatcataattacccatncacccctctgaatccctgcgtatcccccctacaaaaaaagtaggcaaaaaaattgtcatcagatccctttttagggtatttccgaaacccgaccaaacctgccttaaaccatct

SEQ ID NO: 24999 - DNA, 1510 bp, Heterodera glycines
caaatgatgacatttatgttccggttgtttgatcaatttgtattgttcttcatagctgcttttgtcaacacaacctccattcggcaaaatctcttttcgtcgttttcactggaaaagcgggaaatgttttaattgaatttttcggtaaacagtttcgaatcaatttgttattgtcaaatttaattttagcatttggattaaaaactaattaaaaagtttaaagccgtaaaattggattttttgattgataaatgaggtcacattttcacaacagtgggaggcgtatataaaaaggaatgatattaatgggcaatttggttaaattggtgtttatgcaaaaaatttgcaaaaattttggaaccaaaggtatagaaaatttatttttatttccatagtctattttctcgaattaataagtaaatgttgaaacgaaaaaaatctatgctcaaaaatgagacccaaatcgaccataaaaaccaatattttgattaaattacggtattatgtaagtaaatttttaaattatactattttctaatgattctggcatattttttgtgtcttttgcaataaaaattgccattattcggtgcaaatctgttaataatttgaataaaaagttccaatttttaaaatcctattctttctttaaaaattggcccaaaatcgcaatatccattttagcttaacagatggattagcttagtcatacatcccctaaaaatactaccatcatggcaaaaaatgaaatagcactgatttgcttcttccgtgcatttgtttccaccactaacagtataatcaaatatggttttgcgtccgcgcttgcacgtgaatttgcgtgtcgctttctaaagttgtggttgtggtcggaaacatcgcctcaaccttttgaataggaaatttattaaaagaaaggattattcaaaactggataaaaaaagtgctgaattttttttgtttaaattaaaaatttaatcaatattcaagatcccgcaatccctgcgcaaatgcgggatttgcgggttaatcatattcggcctagcaaaaattttgagtttcaattgcgcaacggatacgaaaactttaaatttataaaaaaattaaatgaaaaagaaataatagaaatcaaacaaagaaatgttaaattgttgaattttattaaaaaaattttttctttaaaaaattctaaatactcatttaaaatttttttcgaaaaagtttttcataaacttgaaaaaattaaacttagttatcggaatttctttaaatatttttcaaaccataagaaatttttcttaattttttgtagtgagggggggggggggggtgatcgtcttttaagaaacgtgtccgtgccgcacaaataacaataataaattagacaaaaaaaattgttaaataatcaaaaaattgacaaatgattttttttaaagtgcgaaatttgcaattaaaaatgacctccttccaatcgttgacacatgtgtactgaaaatgatccatgcatcat

SEQ ID NO: 25000 - DNA, 863 bp, Heterodera glycines
agggaatttatgtgaccagcgtggaagcaaagtggcgtgccaattccctcttaataattttaatatttcgattttaagttcacccgcggaagaagctggactgaaagtgcatgacaaaattctgcaagtgaacggcgtcgattacgtaaaataaacaaaataaaatttacaaaaaaaacagataaaaatggtataatgagtttttttctatgaaattctgatgccacttaaatttttttgaaaattgtaataattttttttctgtttcattttttgcagacgatgatcactcacgaaagagcagtcaaatatttgaagaaggagtccgtgttggatttgctggtgaccagggccacacccaaacacagcacggaaatgcaaatgtgaacagattgtccgactgctgatctagcacaacatttcatccaaataaacacacattccaatctttgatccatgtattggtccaatcgaaaaaataaaactttttcttgatttaaaaaatcacaacttcggcgatgtacagattaattctgtataattgaagcagtgcgtgaccagcaagtccggttagaaatcctggtcccacccagtatcggcggcttttttggtcccagcatttttggtcccattttagattgcctgtctcactttttgttttgattctcacgttttagagaataagcgagcgaaaatctcacaaattttaagaatggtcatttttgactgaaaatagtaaacaaaccgagaataattttcaaaattttcacggcggcgcctatcggcagcgccgaacgcttccttccataaggttttcgaaaaagcaaaccgaaaaagtggtttaaaaataaaaaattatatat

SEQ ID NO: 25001 - DNA, 1313 bp, Heterodera glycines
taacttttttagtgaaaattcgatcactcatatttttcgttaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaaggggtttgaaaagtttattttgaaaaaaagactttacaaaataatacccctgggagaagggagtgggaaacatgatttcaaaattttca

SEQ ID NO: 25002 - DNA, 1618 bp, Heterodera glycines
tggagctgtacctgaaggcctacgagcggaagaaaccaagcctggcccaggaaatgacggttgttcaaattgtgcaggagcaccaaaatcgccccctgtgtttcgccaccttgtccttttgtgagcaactgccggcactgtttggggagacgacgcatttgatcatcgatgaggctggacaggcgccatacgtccaaagcctcaacttggtaagccaactccccttggaaataataaattgctcactgttatcgtgcatagcgcagtcgttcacgctccttcgcttacttaaatacatgaaagttcgagtccgctcgaacgcacggcattttttattttattttccaaatcttttcatttttatttttcccaataatacctataataatatttaaaaattattgaaattcataaattaaaaagaaaacatatttttagtggatttagaggatgctgaaattgaccactaccctcgagcgatgtattaataatgacgaataaatataaatttctgaagacctcgttttgacgaaaattcctattacttgcgaaaggaagaaatgaaaatgaatctgaatcggattttaacgaagaccctgatgaatgccaaaataaagacataaatatggatgctaattatatgcacgtgcatgttttcttcctgaactatgggaggcctgaaacgtacgaaaaacatgtttttagctttgtttgaagcttctaggtcgtactcccatatgcatattttgcatatttgtgcatatttcgcgatttatgtgcatattttgacattttgtgcatattttatgtgcctatttgggcatgtgcccctctcttaaagcggcccttttgacctctaaggactgaaaatttcaaaaaatttcgttttttcgtaaatattaataaaaaatgtaactttttttttgtaatcgttcgcttagatttcattactgtagaaaaaataaaacaaatggaagttgtttttaatttattttatcaattcaattaggaaaaaactttcaattcaatttttcatgattttattctgtattaaaaacaattaattaaattccgttcttaagaaaatttcatgaaaacaaaattcaaaaacagattcaggataatcaaatattttcggttttcgtctcttagtctataacgaagggtttttatagcttctttcgataatgagtcacagactcgggactgaactggccaaaagaaaatttttttgacataaaacacattttttaccgtttaacaactttttttcattaaatttactctattttttaaagatttcctcctcaaaaatgacaatttagcggggtttaggctgaaatttaaggaattttacgaaaaagagagcagcaccaccggaaatttttttttgaattttcttgagtcgtctaattctatccaaaaaaaatactaatcaatatatttcaacaaagaaaatcagctttgacccattaaaagcagcaaagtgtttttattttatgactactctaattttcttgagtttttagtgttgttcattacttgaaaattttaatttggttttagttttttttataaaaaatttaagagagcttacttatcgttcaatttttagtct

SEQ ID NO: 25003 - DNA, 1172 bp, Heterodera glycines
attttagcgctcataatgggatgtataaaggcgattgtagaaggaatggaagcgctaaaatgttttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttgaccatttttttctaggcttagatcacatgcgattttcggcactctgataattttagcgttcataatgggatgtataaaggcgattgtagaaggaattggatgcgctaaaattgtttgagaagctttttgagcgtaattacgaatgtcacttatcttattttctctaggcatagctcacacaggatcttcgtcagttcgataactattgtagcgctcatgatactgggatatgtacattagatagtagaccaatattaaatacataaaattgggtggggggggtctacccccctgacttcgttcgtatgaggggccgaaagagggttggttgggacaaaaaggtggggaaaggtcggagacgaagggaaaagaggaaaatttttgaaaaattggctattttcttaacaaaattcattaaaaattcttaaaatttttccccgtcggcgagtatcggcaccgccggccccccaaaaatcctactttttccttaaaaaattgaccaaaaatctcaaaattttgtaattttttagacaaaatctgcttataaatagcattaaaattacaaaaaaaaatttccggcggcgcctatcggcgccgccggacccccccccc

SEQ ID NO: 25004 - DNA, 2197 bp, Heterodera glycines
aaacgcaaaaaagtcataaaatcccaaagagttgaaaaaagtcaaaaaaagtcacaaaaaatgtatattagaggcttcaaacaaagtgtagaacacttttgaagtcattttaaggtcatttagagtcagcaaaaaaaaattcattagacttaaattcccatccctagtgaaaacgaaaaggtaatagttaggtggttccccctcttttggcagaaattttttgtttaaaaagtcgtgaaaacatgtttggtttttggggttgcttgctgatcacgaatatggcatccattttggcctatttcgaatccctggcccgaactaaacaaaagtcgaaaattcgaatttttcagaaattacttatattatgtacgaatcttttgagactttttgttcgagttcgggtctggggttcgagataggacacgtgatcagcacataaatcgtcctagaaaaaattatgaaaaaaatttcaaaggggtgacaaaacctacaaataccaaaaattcgtcgctcggctttttaagaaaattcttatggggtcaaaatctttttgagtattttgtctattttaaaacaaatagctggctctgccaaaaacccacaaaagcaaaaaaaaaagtctttttgaacgctgaaagcctgttaacttttctcattaagggattatggaaaaatttgtaatttttaaagcaaattacgcaatttttatacaaccatgaagtcgaaaagatttacttcaggcttccgaattccgtcacttttgcgcttggaatttcgaattccgagattttctgggggcacgaaattcgtccctaggtaataccgaagcgcccgatagggaaaaaatgtcgaggtcgggatcgtcaggtgggacaggtcgggtactgtgtttggaagcaggccagaaaaggtcgagaatcgtggatcaactcaattaaacgcgaattctattcaccctaccgtaccatcagttgtccaaaactctttcgttctgtcttccgtggttggataagcaccgttttgtgccatcgtagaagcagatgacttatccgaacagcttgggcaatgcggagaagaaacagttgtcgcggatggatcagcttcagcaatggcaaactgctgatcattttgtcgttgtgccaaatttgaattgctttcgtcagttgcgcacgtagcaaatgatgacaaaacaaaaataaagcaaaatgtacacatttttctattcggtttctcaattgtcacgcaattaatgagaatattttccaattcatcaattattatgtcttttgccaaaataggacggtgaaaaaatgtttaagaggccaaatcgatctgtgaaattgttttttccaaaaaacgaattctaagattgggaagttaaagcataacaattgaaaatgccgggaacttacagcagatcaatatagtatccatattttttaatttgcttaatatttgtaatttggacaagatttaaaacagcttaataaaacattctatggagtcagattttagcctttcttaaattaaagaggtgtcatcgtaaaatgtacagtatcattatgtgaatcattttctttctttctttcttttttgttttgttgtcaaaaaacagaagaagccaagtttcatcagctcttaacatgtactttaagctccgctgatttgtctcattttcatgcttacaaattaatgtgacatattccattttcgtcagtcatctttggtcggaaagttaaataccacacttttaaaccagaagagtgtccatcggaaaaattccgaattgaaagccgaagaaacaaaggacgtccttggaacaaaggacggatggcaatcttgactttgtacttagtccatatgtcaatgtttttctgtaaaatttcaagtcgttttcaagaaattaacggagttacaaaatcatcaacatttttccctaataaaaaagcctttctactaattatgcggactctgtcagttgggcctccacgtttgggccccagaatgtttttcctctatatctttttttttgtttgtcaacaaaatccaacattgttgtaacattcgatagctttttaagagctctattagccctacaaaacgcggaaagattttcttgcctgtaaaaaatttattaagaaaaaatttcaaaatttccgatttttttttttttgcaattttcatgtataactctttt

SEQ ID NO: 25005 - DNA, 1050 bp, Heterodera glycines
ccccgaattttccaggatgattctgcactgttgtcttcttagctttttgctcaattgtgtccggtgacaaattgcctttgttgcgcgactcgccgcccgagtcgcatgttgagccggtggcgcaactgttgcgatctccacgtgaccccatggacaacatcaccaacccagcggacaacaactttgaggacaacaccaatggctttgctttggcgccttacaccgaacagcgacgtaattttgccaaaaaactgatattccttacatacatgaaatagtaggggttgacttcatacgaacgaagtccaggggggggggtcggagatcaaaatttacgaagtcctcttcaggcccgtaaaaatttcgcgcgaagagctttttttttttttgctcttcttgccaaaatgtttttggtttttcaaatccgttttttttgcggagcgctttttccaaaaaacttttggagaaccggggggggggcggcgtcctttcatatatccattcaataaattagttagttagatcgatcgatagggcattctaatttctaagtgatcatctgctgatcactcctccgcccatggatcggctatctctcagggcgagcactcactcaccctagtcaccacgacttcggtccccgcccgattcgtcgctcggcacgtgtaaaatacgtcatccgatgccttcactttcgaaattcgcacatttccatcttcaaaaatggaatttcgtggatcgttcttccaattttaagtgatttaccaccaaaagtgccatattttgatgagtatgtgtccaatgatttgttctgccacaaacattcgatgttcggctttgggtctccgccgaccaaacagaaaatgtctgccatttgattttcaatgaatgtgtattgtttttcttgaccttccattgctaagggtggaactgccaattaaggccaagtaaacaatttgtcagaatctcccccctgtcccctttcagtcgaaactgaacccgactcgaccacacattaacatgtgttctgccagaagattgccccctttt

SEQ ID NO: 25006 - DNA, 2018 bp, Heterodera glycines
acaaataattagaataaaccaatcccttaattgggaccaatctccagttatttgtttgcccatttcatctctaacttctttccagtcagagggagaggactcccttcactttggagtcatcaaattcaatcaggtaagtaagtttactaacctggaaaatatttgctgcgaaagaatgagaaataatgtcagacaaattggtaagtgctaagtgatgaaatgcatgagttttgattttaggaatttcaaacaatgaattggattctagtggaagattgttaactttgagaggggtgacggacccagtaatttggtccacttggactagggagccgttgataagaatgggaatgttgcggaactcagagcagggagcagttcgggcctctggagtgacaatcattgaaatggggtttaaaaatgctgattttgggccagaattagtggaaaattggattgggaggagatcaaaacaagtttgaagctcagttgccttaaattggtagctagagctgtttattggtacgcagggccatattttaattgagtcaattgttaattgtttggcaaaaatgtagggatttgagaaaatactttgtgctagagcagttggatttgagaggagggcagaagaggtccaatgtttattttcatcaataaagttacatagctgggtgagggaatgggaaaattgaaaaatgagagaagtcttaacttcatggtcaagaaaagtgagttgagaagctaattgagatgtggtgacaagactgtcagcacttctctttgaacgaggttgatccgtgggaagaaattgaacggcaaaattttgatatgagagagagagagtttgattacagtcctcgatcaaagttttggtttggggaaaggaaagagcaagatcattttcttctgcaacccaaatgtttgacagaaaagttcctaaaaattttccgaggttaatgaattgacagagtttcttaggagagggaagccacataaggatggatttgtcgtcgaggcggcaattctctgctgtatatttacaatttgggtgtcctagagatgttcggatatgatcttcggaatgatgcacaaaaatctcagtttgaaaagcgaaacaatttgtggaattgtgtgctttccaggaccagccaaggaagggataccgtttttcatagctgattggattattggagaaaaggagctccccactttggattagaatcccttcggaacatgacttttcctgaaccatttgcttacattcatctaataatactgggagattttcggacgggagttgcttaatgattacatcattccatggattggtgtactcaatcagggatttctttaccttcctgcacacccatgccttggatttttgttcgaatgggttcggtcggaaaaggcgaataggttgtttgataggggtgtcagaaggagtatgctttaattttggacatggtagccaaatgggtagagaccaaattgtgccctcaacgtgtgtctgacaaaccatagggaggatttttaaggatgattgactgtgagaggatgagaccaaagaagcacttagagaaagagtaatgatacaaaggataaaattgaaacgagttagaaagggagctattgaaaaatttgagctgcgcgggtgtgattcccaatttgtgacaataggagtggggggaacaggctttggttcggattttaaagcatccgtgagatttggttgcttatcagcagagccagagcacacgagctgttctttgatttgagatggtgaggcagtaacgggttgttggatttggtcagataatgtaagagtgttaaatgaagggtggggaccattatcagacattgaaagattttggattgagtctggggggaagggaatcatagggtgttaagggaataaatttgtcgtcctcggccataagttggttgggaatttgggaacgattccaattccgattgtatggagggaagggttgcctggtttttccttgcaccccttt

SEQ ID NO: 25007 - DNA, 1105 bp, Heterodera glycines
  misc_feature (1080)..(1080): n is a, c, g, or t
tcctcacattcctctatgaattgctgctgatcttcctttgttgtgccaatttcgtccgggaagccgctggcatgcgttttcatggccatgaattcggcaacgtagcctcgaaaaacgcggtcgctccactgcgtatcgtcccactcgacggagcgataataggccgtacaccggtacccgttgcgaagcgcctcctccaactcgattgacgtcacagtggacacccacccccgctcatcatcctcgcgatgcgtgcactcgtagtcttcattgacggatccatgcggatgttgcagagcgcacgtacggcacagcgggaaaagaagccgctgatcaaatttcacgggcagaacaggcacatcaacgtgatggggcggcacaacgaacactttgagaatgcctcggatcggcacctggtcggcgcgtcgccagtcaaccgcctgctctgcctcaccaatgatgttcactcgtgttgggtggcccacaggatatgctgtcacagcattcgtgtgggggtagagcgaacgaacgtcgtaatatttcatccgccacccctccggcacctcgtagtgtagtcgttgtggacccacacgtcctccatggtagcagtccttcaaacgaattgggccgctgtccttgtactgagcaaaggcgcgcttcatttcgtcgttgttgcgcttctccgcgttgatttcgcactcccaaaatacgagcacttgttgcacctgagatgtgatgaagaccatccgtctcgcatcgtcctcccgtatccgctgcgccgttttcccgttcgccatcactgtttggggctgaaagcggtgacgcgggtggtcgtgcgcgtgccagtggcagccgttgacctcaatcacggtgtcggtcgacgcaatgtatccgtccacagtgtattgtccaatttttttctctccgtcgggcgagtgtgccgtctggatgctcaccccgttctttttggcgtaccaatccaagaatttgagcgctataaggctttgcgtgtttgtagtgtcgtagccgcactcgggcacaatggcgagctgatcccgcatgaggtgattgagtcgaaangtgtctccattgaggccactggcga

SEQ ID NO: 25008 - DNA, 1661 bp, Heterodera glycines
tttttaatgcagccttccgccaattccataccaaaaccttttagaatacctgcaactgccaacacttgagaataggcgaaagctgtttgatctgttcatggcgcataaaattgcttatggccgaacagatctgaaactattttctatttttaatccatcagcacgctttaacatccccttttacagatttaacacaaaatacaaactgggcaaaaaattcattccctttgctgggagggcaacaaaattatagaatcaactcgataaagaactaataaaaacaaattctttaaatcaatttaaaataaaacttaaaagttcactagggtaatctgtaagaccgggaaagttagaatgtaacaaatttctaagtgatttggtatttcgacctcatttgactttgacctcaatttatttattatttattttcacatattttgtctttttttaattcatgtgatcatccatatattttgtcacttactctacgacatttatctgatagtcgtcagagtaagtggttctcgcccttctgatgacttttttattttttatgaataaacaaataaaaatgtattctattattatattttcataaatttcagtacattcgggatcactaaatcagatttttaacattttttgcggcacatttccaaaaaacttggtgaatgtgcgaggggagaggtccggtggtgccgattggcgccgcaagcggaaaatttttaagactatatgaattttgttagaaattagccaaatttcttagaaatttcccttttttagatgaaaataaggtactaccccaaaaccaaaacatttcttagaataacaacatagaaaaaccctgtattatttggaaaaaaaaataaaatcacaagaaaacgtcaaccgatgtcgaactaataacaaaaagtttgttaatgttgaagcactaaccactaaaccacaaatattttaaaaaacataagcaaatttaatttatttcataaaaatttgtaaaagatggttaaaaaaattcaaaattgtataaatttttgcctttaatttcacgaatatgccattgaatcagcaaatgaaaaattacaacagtaatcatttgacgaaatatttggagaaaaatgggaagaaaaagaagaaaaacaaaatgaagagaaaatcaagcaaaaaggaagaaaatattcatgaaaagaatggcaacaaaattatgccgaaatttgcaaaaaaattggggacaaatcgaacgaaaatttataaatggattaaagaatttggtctttaaaaacaaataaagaaaagctacaaatcaaaaacttatgaagaaaaacgtcaaattattcaaaaattcattgaaatgacaaatgaattcatgcatattttgccatttttcgtcaaatattttccgattttttgcatattttgccatttttcgtcaaatattttccgattttttgcatattttgccatttttcgtcaaatattttccgattttttgcatattttgccatttttcgtcaaatattttccgattttttgcatattttgccatttttcgtcaaatattttccgattcgaatatctcttaggaaaaaaaatttgattatgcctaaaattaaatccaaatttgaatgggtgagcgagtgggtcaacagtgagcttca

SEQ ID NO: 25009 - DNA, 1096 bp, Heterodera glycines
aaaaagggggttttaaaaatttttggggaaaaaaaagcttttcaaaattattcccctgggggaaggggagggggaaccagatttcaaaatttttaatttttttattttatttatcaaaacgggtcagaattcaataaaaatacattcccggtgggaaaaatggggtttgccaaattttatgggggaaaaaagactttacaaaattattcccccgggagaaagggagggggaaacatgatttcaaaatttcaattttttttattctaatttactcaaaacggttcagaattcaataaaaataacattcacggggcgaaaaatggggtttgaaaagtttattgggaaaaaaagactttacaaaataatacccctgagagaagggagtgggaaacatgatttcaaaattttcaattttttctagtctaatctactcaaaacggttcagaattcaataaaaataacattcgcggtgcgaaaaatggggtatgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaa

SEQ ID NO: 25010 - DNA, 1909 bp, Heterodera glycines
atttttccagactcatgcaaaggccatgaggacatgcgccaaaacgggggctatttgaatccgaatgattgcacaaaatgccattgtccggacggatacggtggccaatactgtgacgcactggaagagagtgagtaaaaaaataaatcaaaattaaaaaaatcaacatttgaatgttacgaaaaatgactttgatcaaagcatattcgatcaaatgggaaataaagtgtccagataaatgttctcccaatttattagatcagaactgcaaaattttggctgatgagtcgagggaattgaaatctgatcagaccgctaaagtgttgaaaccggtgatcggatgcacttctgccggcaaagaatgccgttgccattggcgaattacggcaatttttattttgttataaaaagataattatagtgttaataattaacaatataaaatgagtgaaaaagattttagcccatgtctggcaaaaaagtgcaaattcaattcaaaagcttgaacaattcgctcatctgctcacacccatgcacaccaccgtacgtcgagatcaaataccgtaccgacaaaagggcacaaggcaaaaaaattaatgaactaattaattattacttagcaaaatgatggctcattaaggtgccaaactttgctgtccccgtgcacttactgatctgaacggtaatgaatacaaaaattggattgaggcggaaaagccggacatggacattgtcatttccgcgcacctttcaccaaattggaccgtaccatctaccgtattcgaactgacatttgaatcaggcaaggaaaaattgtaaaataaattttatttgttttttaaattaaaaaaaattttaaatttgtattttaaaatgctttacatatctaatggaaaattgttctaaaaatctgttaaggcaacgtcaaactcataaattcgagcaaatgcgtgaaaatcgaaaatttgtatgccgagaaaaggaaccccggcaccggcactttgcgttgttataacccgacaaagaatcaatattataactgctcctgtaacggtgataagaaatgcctcgctgaagaaaaatgggcacacgaccgctttctttgtccaataatacaggtaattaattaattaattaatttgttattaatgccaaaagacactgccacagaaacatttcatataatattggcaatttaattttttggctgtaaaaattaccatttttgtatcaaaaagcggaaataaggacaaatgagaacataaatgaaaaaaatgccatctatttaataatttgtaaattcaaggtcaatggaattcaaatccaaatagattatcggtacaattggactcgtcttgatgttgattgttatgtgagttgggttttcctaatttctcaaaccctttttaattgactaattttacagaaggccgaaggaggtaccgtaagcttttggggctacagtaagcccgagaccaaagaaatcattcgtgtggacgaaatccactgtttgacttttgaagctgctggagtaacaccaccgtcacagaaacggttcaagagtttgcaagtcgaggaacatctgtcgatgaaattgaatccaagtacattattgggcaatgcttcatcacttatccatgtgttcgtgccatttgttggccatccatgagagaaaagggggagatcagtgatcagtggatgtgatctgtctgctgctgctgctgatcatttggccaatttccaatcagcaaatttattttttttaattttaagggtgtcactgttttatgtaagtccctatcatatttgtatttttaacgcctcatacaccagcatggactatataattttttggctaaaaatacaaaaatatctctcccctaaatagacaaaagtgatgcaagaagga

SEQ ID NO: 25011 - DNA, 1771 bp, Heterodera glycines
  misc_feature (7)..(8): n is a, c, g, or t
  misc_feature (17)..(18): n is a, c, g, or t
  misc_feature (32)..(33): n is a, c, g, or t
  misc_feature (52)..(53): n is a, c, g, or t
gcatgcnnctgcaggtnncccgtacgacgagnnacattcgcattggcacacnnttttctccacttttgatcaaaaataaatgatgctatctgctgtactgctttccaattttttttctgctgtactattttaaattttttatttactttattgaatgatcgacgctcgagtaaaattaaacagtatcaggtccgtatagaaggggtgaggcacgtacttccctcccatggttttcccacgacagtgaaaatttaaaccatattattacactggacaaattttttttgtttggtttggttactccactagaggtccgacaaaaatcattcggggcctcttttttgcctgcactttttgtcaagaaattggttgaaaatcctgaattttccagtataaaaatgttatcatcggtggcccatccctgtctaatcatctcctatggtttttcatcgggccaccactgaagcacctaaacaatgcaagtgcctttggatttctcctaaaaattttttaaccggtaactcatggttaaaccactcatctccaaatttataaaaaaggctgccctttctaaaaaaacgtaattcttgcgtaccttaaactgcatgaattcgtcgacttccattgttgagttttcgcttttctttcatcgttggttgtttgcatgtagtcaacgcacaattggctaacggacgccagcggatggtctcattttttgtaacagagggtccggcagtgccgttaggcgccgccggtagaaaaattgtgaactttgtcatatttttagcagattttcatcaaaaaattgtgaattttcggaaaattttaaaaaggcccagcacgactgaactgaccggtttgataaaatgacagttgaatttttaaaaatttaaactcattaacctgtcatacggtaggatttgaaaagagaatgtcactactcttcccattattgaatcaccaaaagaccgaaacacaacacaattgtcttcgcctcacattttgtctctttttagtccagatttttcacttctaaaatgggattcgtcaattatcaagtcaaaacgggtggatgaactgaatcatttttttcggttcctaaaaggcgtcaatttttagctgcgaatatttttttgagggttttcgttcataattctaatttttggattaaaacgccgagattccgcctaaagattttcaacttttcatatctgaaatagatgtcctgcaaataaaagaaaattcatggattcattttcagaattggtgtcgtctctgcttctaattaatacatcaattaacattttgtaccgatttttgactaaacaaaactaaaaacaacgtttaattcactaacaatcagtgcccaccgccgccatgccctatgaaaatgttagttttatcatttttctgaagcatgtattgtgttcgcagaaacctaaagataacaaacaatccggtaatagtagggatggttgcccccatttttcggagaatttttttttgttttcaaaagtcatgaaaacatgtttccaatggttttcggggtcgctgatcacgaatccggcatccatttcggccaattccgaaccccgaacacaaattcaaacatttggccgaaattttaaaattaaatttttttgtttttttttctcttttctcttttatcatattgttatatgttttatctctttataattattgttacttaattaggctgcgctagaagaactccgtggttttactttaaaaaaactgaatgagaagttga

SEQ ID NO: 25012 - DNA, 1764 bp, Heterodera glycines
agaagaacaaatgacaatttcataccaattttctgttctattattaaaaattaaatatatttatttggagcaataaaatataattgaaaaaatttaacaatatgaaaaatatagtaataaaaaggcattctagaagcatcaaaccaatataataataatatttacctattttgaggccgaataagtatgccaaaaaaaaacataatcaattaaatccgggcccagtaataatacatcatattaaagatgcagaatatggctttggactcaatctaatttgtagcgcacctttttgggggagtttggaaaaattgtattagtaataaaaaaggacttataatgcctatttttgcctatttcggggttttgtgtataatgtgtctcttttgagaattttcgaaaaaatcctgaagaaaaatgcaaaaaacacgaaaaatacactcctaaaaaggcctgaaaaattttagaaaataaatacccctaaaagttaaaaattttctcaaaaattgattctaaaatataataatttcttcataaaaattttagatttaaaaatttgtccttcttttgaaaaaaacttatttaataattttatttacacttgaatgctatttttgagcccctttcttcatagcatatgcgcagaaaaaatatgcaaaatcatacaacttataaccctaataatatcaaacgaagacggaggagacaatgcttaaaaaaaataattttaaatttgggtgaaaatcactatattaatatgtgaatttcagtatttattaccagttgtttgagatgtttacgtcgaattaattttttgtccatttaaaatttgaaaataaagtgaataatatgaaaaagacaggattaaaatcattttaacctttaaattagaaaattattaagctgataaacttaaaaaatatatcaaacaaagattttattttccaaatgtatggagattattacccaaaggagaattggctggagatgggatttggaaaaaccgagaccagcagcaggagttgggactaaacagaaagagaaagggagggaggggtccgtggtgtagacactcgcccaaggggagaattttgactaagacatgcaaagagatttgtacaacttaacgccacatgggcgtttaataaatccgtaaaaaatctaaaattgatgaaaaaactaaacagttattttaaatttattagctactcaaaagaactcaatcaatgtgccctagtcaaatttaaaaaaagtacagtaagaaactgttaaaccgtaaattcacgaccggacctgcccggaaccgggaccggccgccaaattactctctcaaaagaaattacaacaattaattcaaaaaatgattaatataaagaaaaaaatgttggttaattttaaataaataacgaaatgaacatgaaagaatcattaaccattcgtgaatgaaaatgggcatacaaggcaaaaaaaaaagtgaaaaggcacggcaaaatcaaaaaacggaaactgtgcagaaagggattaaaaataaagaactttaattggacaacgacactttattcgataatcattacacattttttaagcaaattgtagaaacaaaaaatttaaatttctttccattttgttggttcatctttcaaatttttatttcttttttatttttatttttcgcgcagcaaaacttctaatgattttttttatttaaatttattaaaaaaaaaggaatttaatcgctggaaaatttccattttaaagaaacta

SEQ ID NO: 25013 - DNA, 1288 bp, Heterodera glycines
agagaaaagaaaagcgaactcactgatgaagggcattgagaggaaagaattggagacagaaaagaagcaaaaggacggaaattagaagggaattggtggggaaattgaaggggcaaatccgaagagatggcattctgagagggaaaaaggataaacgacgagagaaaccaaaccaaaggacgaccaacggatggactcgtcactgaaagccaatcggcggattgttttgagttattacaaaggattttacggggcggaaatcggtggaatgataggaaaaactccgcacggtacgaagagtaatcggcagggatggtggccaatgtaatggaaatgttatcagcaaacaattttgggttggtcggaaaatgggggagggaattgggggggggggggggggaaaattaccgggtgagaggggaccatttggggggggggcttatcaaagcgtcaacaaagcgctgacatcgcaaaaacaaaacagcccaggcaaagcattgataaaagagtaaaagcaaatggcggtgagagtcggtgccgcgggaaagaattgtcgacggattggcatttgccaaattgagaatgccaaaatcacttcacaaatttgcgaaagcttttttagtcagctcctaattttgaaatttttaaagaaaatcaaatcgaaaagcaaagcgaaattaattttattttcttagaaaaatcatgaaagtttaaaagaagtataaagtgatactcttaaaattttgttgaggtacttatgtatttgtttgaatcctaacgatcaaatatttatgagtagggcttccttttttaggaacaaaaaatcgcgaaaaagccacctaaaaaggcataaaaaaatcgcaaaataggcacaaaaatcctcaaataggcactaaaataggcaaataaaattttttattaacgctttttaggtaacaaaacacgttaaaactttaaatatttcaattgtaaatgaaattattaaatgttttaaagttttttttcgaatatgaacaaatttttaaaccaaaaaatttttgttaagaaaaatatattaaattttgggataatttttttgaaaaattttacaattcttaggggtgtatttttggttaatattgcatttttgttaaggattttttcaaaaaccctaaaataggcactttaggcataaaaaccccgaaataggcaaaaataggcattataaaagtcatcgtagacaccccaaaccaagcggaaaatgcgtttttcatgcttatttacacgtattaagtgcgcaaaaatttta

SEQ ID NO: 25014 - DNA, 1443 bp, Heterodera glycines
  misc_feature (1376)..(1376): n is a, c, g, or t
  misc_feature (1426)..(1427): n is a, c, g, or t
ccagtatcgccctgtgccttgccacctcttctgtgtattgggagcggtagaccatctgcgtttgctgggcttcttccgcgatgcgcagtcgttctgccacttgtgagttgacattgtcccatcggacagtgatctgcgagacacggtcctcaatttggtccacatccggatggctaaacatttagatgattgggttgaacaatgccaaagatttgctaccgtgacactatcgctactacagtatcacctttataaaactcattattgtacaattcgctaccgtacaacactaacttatatgtaattaaatcaccagaagcaggcaatgcatattgtgtgtgttaactcactactgtaaattggtactgtatcgcatcactctactatacagttcggttttacaccaccaatttgtacgatatcccttacgagcattcacaaagtttactgtacaaacacactttgcagcgccgaaacgcgtgcgcgcaacatgttggcgcagcgttgcagtgtcccggttcagcttcttgacgatgttttcctgctgttgcagtaccatattcagctccagcagctgggcgtgcacgccgcgcaggcgctccagcgcggccggcatgtcgtcaaaggaggccagcgtgatctcatggcgtcgcacaatgtccgtcacttcgtccaacccgttcaacaccgattcaagccccttcagccgctccacgtacatgcgcgacagctcccaaatgtcttgccagcgctgcaccatgttgtcgtgtgctgctcgctgggtgggcgttggatggggcagctggcggtacagttccttcacattggacacgtccacgtcaagcgtctgtagagaaaataagaaattaattggattttaaattttgatttatttaattttggaaaatgtaatcattttcaaaagaattattaagaatttctttgccgaaaaattaaattaaaatccatgaagaaatattaaaaatttgtaaaatttcaaaatattatataaataatttttgaaaaaaacgaaatgcgtttattattattaaatgtaaggagaaaatcaatttattcgtcgattctaattattgtaaaataaaattttataaatttaatataaaaatatgatatttgaattagagaccggaattttcaaatttgcgggtcctgttgcaggattggaattcaaaattttttacaggacaggatccggcaggattaatcctgcaaatcctgcaatactgcaaatcctgcatttaaaatctgcaggatcctgcgcaggattgcggattttaggaaatttcaaaaaattctgtattaataaaaaagtcttacaaagtataaaaaagtattcaaatatatttttaaaccanaaaatgatgaagatgaaaaattaataacgtttttttgcttacactccaanngcatcgctgaatcttc

SEQ ID NO: 25015 - DNA, 595 bp, Heterodera glycines
ggacctggccctggatttgctggacaaaaatccaggaaaatccaggtccaggaaaaatccaggctcctcgagacctctggatccaggcctggacctggattttttgaaatttattttaaaaatcaaaagaatgtttgaaaaaattaattatttgcttagaagcatctaaaaatatctaataaataataataatgtgtttttaaatttatttaatctgtttttgaaaacgtgaaaaaacatcggtcacttgaaataataaattctaaaattttgtccaggaaaatccaggtttttcgtgttttgcctggacctggacctggattttctggacaaaaatccaggaaatcccctggacctggatccaggaaaaatccaggcctggatccaggtccaggtcgaactctactaaaaacatttgtgaaataccttttacttggttaagaattaaaaaatttagcctattaaaatatttagaaatttttttattatattgtatattttttgaaaaattcccgatttcttgcaccgcaaaaaagtggttttgaagaaaaaaaaatagtcaaatttatgaacgttaataatttgatttccgatc

SEQ ID NO: 25016 - DNA, 1983 bp, Heterodera glycines
  misc_feature (1895)..(1895): n is a, c, g, or t
  misc_feature (1916)..(1916): n is a, c, g, or t
ctgcttccccctttcctccagtcgctcttatcacaaaaatcaatctgctgcgcaactgcaattttttcagcgctcgttccttcaaaaaaatttttcagctccgcaacacacacacacacaaacagacgatcaatttgaacgaaggacaaattattttctcggcttttaattttaatttttaatatttaatcaaatgtccaattaatggtcaattttctctgtttttaactttcattttttaaatttaataactaaccattaaacattttaatttaagttcatttttaagaaagcatattgatttataaaaatctaaaaaacgtatttctaacattcgttttttagtgttcacacgaacacgaagatcagacaccagacgaccatgccggaaattctgaaaaaaattacgaaatttcttgggcttcgctttatgacataaaagcatgtcagaaatgtcgcaccgaacggaaatggtacataataaagtttaaaaaatctgggaaggttttgacgacatctcgaggcgcagattgttatctacttgacgaagacgtctggcaacatgtaattcttttttattcggcctggattttctaaatgacatgaaaaaatttatttttatatatcttgtatttttcgaaaaaaagatcaacaataaaaaatagaaaaagtacacatttaatatgatgttaaaaaattttttcggtactatatatctttgaaaaccattaaaaaagaaaattcgggctatagtatataatacagtaagatgcacatatttattcagtccgggtttacacttggacatttgctaagtgtagtttacacgagagcattcaaagacggacacgtggacatatgtcgagcacgaaaaatgtaaataaataattaaaaattatttgtttgttaaaatttatagaaaaatatttatggacaattcgaaaaagggctattatattgacgatgaggatgcttcggcatttcaaccgttttccggttcatcttcaaatttgataaacacccaacacctgccttcttcttctcttctgccaaattcttcatcttcaattcctcctcctttaaatttcattcccactcccttccttacacaattggcatcccttccgccaaattcttcatcttcaattccttcccattcaaatgccattcccacttcctcccttacacaattggcatcccttccgccaaattcttcatcttcaattccttcccattcaaatgccattcccacttcctcccttacacaattggcctccattccgccaaattcgtcaccttcaattcctccacagttaaatcccaatcccggtccctccattacacaattttcttccattccgccaaattcgtcaccttcaattcctccacagttaaatcccaatcccggtccctccattacacaattttcttccattccgccaaattcgtcaccttcaattcctccacatttaaatcctattcccagttcatctcctacacaactgtcttccgttctgccaaattcatccactcaagccgcattacttccgtccgattttatcgagcctacgagtatctttatcattgactatcaactttataaaaaatatcgctcctttgagcggaaaacccactattttctgacatatcggatgcttccgcttacttacaaatcgacgagcgcgatgatgggaatgaacaatctgcatctgcacaagttttacgttcaatcttagacgtatgtttgttctattacactatcaaaaacaattttttctgaagacgaaaaattccaacttaatttgattctcacattaaacatttgagaatcatgaagtttcatgaaaataaaaaaatatgggaattttatgcatattttagtttttatttaactntaattcattttcattgctaangtaattatttctgcaatatcttcataaaacaataatttagctccgtccacatcatccacggcgtcat

SEQ ID NO: 25017 - DNA, 1513 bp, Heterodera glycines
  misc_feature (1411)..(1411): n is a, c, g, or t
atttaaaattatataaatgaagtatttttttatacgtcttccatttagagtttgtttgtatttaatttttaaattaagagattttaataatttgatgcgttttttgtagttaatttatgttttttcttattattatcatcaattttttgcaatttttttttgaattttggggcatttcgtctttggaatccagagtttcgattgacgtttcagcatacttaatgtggcagtaaggaggtattccaagagaggacgaaaaagcgagtgaaaagcaacacagcaaatgcttaaagtatgataaagcattgttaatagggcaggtaaagcaaagttcgtaaataacattcattaaatatttattaaaagtcgacctcttgcttccaagttcttaacagtagcttggtttcattttaaaaatatataacaggttttgagtaataattagtatattcgttggactttatttatttaaatttaacaaaagttacttaatgcagcttgtttgaagtagaatataaaattattgatttaaagacgaaaaattgttctttttattcttttcgatataattatttaaattaaaaaagaaatcgtattattttttcatgttcataattaaagtttattttcaattggtaagcatcaccgttgtgtaccaaggagttgatgaattgcaggccattttgcgaagacattgtcaaatgcgtcaagaaatttaatttttgctttcgaagatttttcaatttatttttagttcttcttttaaatttatttagtattaaatttattacctacatatattcaaataaatttagtaaaaattattttcttgattgagttttgtaaatgaatattgttaatcgtaattaatttacttttaaatagctaatttactttgttattttcatgattaatttttgcaaaaattttttggaattaattttgtttgtaacgtttttggttggatcggtttgtatattgtaaggaattgtaaattcttttttttcagtggtaatataaataatatgaaattacatttcatactaatagttaattttattataaataaattgtgtataaagtttaacaaatttaagcggaattagcaagtaaataaaagagtggaaaacatacaatttttaaagacaaaaataattgaatttttacaggaaaaatcctaataaaaaatgctataaatttatagcaaaattttttttaaatgattgatcatttcagaaataattcgcttcgttcgccaatttaaatggctaaatttgcgttaacgcagacaatttaaaaattcaataaaagaggtggtggtggctcggagaaatgcctaatgaaaatataataaaaaattgcgaaaaaggatgatccatcaaagggctggctatgaattatgacgggctanatggtgacctccttgaaatttatttatttatgcaaaaacgaaaaagtcaacgaaagggagtgagtgatccaatcactatgtggacatgtctttgattaatcg

SEQ ID NO: 25018 - DNA, 1024 bp, Heterodera glycines
acgggacggaaactgatgaaaagcaattgaaatggcacattttgacgaaatatttggcacttttttcggttttgaatggaagtgaaaatgaaaaaagcaacaacaaacagaaaatgggaggaaaagcattggaaaaaatatttaatgcattcaatttgaagagcaaaaatcatttcgaaattaagcatttcaaaacaaggacaattggatggaagaaaatgctcgaccaaattgaaattggtctgtcagcttaatctcgatttacaagaatccgtccttggatgccaaggatgcccttggaaatggcccttgtcacttcgaaaatcctttttccaagaatgcccttggaaatttgcatttgcttatgggtgtaaaaatcacatcaaaatttaaaaaaatggtcacaaatagcttgatttttctctcaattttttttgaatatttctattatttttataaattttttctaatttaaaatttcgaaagattaaattaaaaatcattcaatgttaccaatttgcgagaaatgtagttttaaatataaatttgaggtcaattaaaaataatttcaattagataataatttattttttatcaattaagataaagaaatgcatgaccaattttctgaagcaaatggaagcggaaaatttttggcgccaatttttccaaaaatttcgcaatcaattgaattttccatcccaaatttggatgagcaaatttatgacgacgtaatttttttgtttttgttcaatcattgcttaaactgggctctgagctgagatgttttaaatttttttttaaattctataaaaaatcataaaatggtcatttaaaaacataggtcaagaaagactcgtcacccaaaacaggccgggaaaaaatttttatttttttaaaccgatttttctttcttttttttacaatttttaagtactttattttaaatggtacaaatacatacttttatttaggagggaacataggtaaaattacagaacatctgttacagtatgacaccatt

SEQ ID NO: 25019 - DNA, 1048 bp, Heterodera glycines
tttttgtagtctaatctactcacaccggttcagaatacaatataaataacatactcggtgcgagaaatggggtataaaaagtgtattgtggaaaaaaagactctacacaataatacccctgtgagaggagagtgtgagacacgttttcgagatattctattttttgtattctaatatactcacaccgcttcagaatacaatataaatatcactctcggtgcgaaaaatgtggtataaaaagtttataggggaaaaaaagactctttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattgggggaaaaaagactttttacaaaataatacccctgggagaagggagtgggaaacatgatttcaaaattttcaattttttgtagtctaatcaactcaaaccggttcagaattcaataaaaataacattcacggtgcgaaaaatggggtatgaaaagtttattggggaaaaaaagactttttacaaaataatacccctgggagaagggagtgggaaacatgatttcgaaattttcaattttttgtactctaatctactcaaaccggttcagaattcaataaaaataacattcacggtgcgaaaaatggggtatgaaaagtttattggggaaaaaaagactttacaaaataatacccctgggagaagggagtgggaaacatgatttcgaaattttcaattttttgtagtctaatctactcaaaccggttcagaattcaataaaaataacattcacggtgcgaaaaatggggtatgaaaagtttattggggaaaaaaagactttttacaaaataatacccctgagagaagggagtgggaaacatgatttcgaaatttaaattttttgtagtctaatctactcaaaccggttcaaaattcaataaaaaaaacattcccggtgcgaaaaatggggtatgaaaag

SEQ ID NO: 25020 - DNA, 1397 bp, Heterodera glycines
ttcggcaatcgtaaagaatgggggtcccaaatataaaattattttttttatttgagctcaaaatgagtatttgggggttttcgagggcgctgatcacgaaactgaattcggatttgctcaattccgaaccccggacccgaattcgaacaaaaaagtttgatttttttccaaaggtacatttttctgggtaaaagcttcgaattcatttttaggagaatctttaaacgttttaaaaaaagaaaaaatatttaaaagatttaatcctaagtttttagtaattatagaggaagaggaagagaaaacaatagtgattccattagtagtggcgagcgaaaagggagcattttatattttttttataataattttttacaaattttaattcattataattttctctaatctgaaaaaagttattcaggttctccttagactgtctttttcgatgaacgtttttaacaactatttattttgatgcaaaataatgattcaactattaattgtataaaaaatatgcaatttacgccaaaattagatcgattttaacgcgtattttgaaaaaaaaaacaaattttttgttcgaattcaggtccggggttcggaattgagcaaaaccgagtctggattcgtaattagaaccctcgaaaacccccggaagctaattttaagcctaaaataaaaaaattaaattagggacccccattctttacgattgccccagttttctacaatataaaagctggtgatgatgaagaacgaggaaaacaatagaataaggagtgaggtcctcccgtaaacggggcatggcaaaataagtgacaattaagtgaacggagtcaaaaatattttccaatggtcacatttcctgaagggaagggaggagagatgtcacataacaaaaataagtaatctattcacaaaaattttgtttaattcctctgatcatttcttcggccaatttggtcaactgagggaacacttcgcgcatttgatcaatggtcaacgtgtcccgcctcgaatgaaggaatgcttgaacaatcgcagcacaattgcgagggctggaggaattgtcgaagaaacggaaaaaatcggccacgattttcttggctattggaatggttgttgttgacggtgaaggcggcgcatgagggggaacatcggacggactaaaagaaacagaaacatcctttaattgcttttaaactttttaattaaagaatgctttaatattttaaatataaacgttatgttgaaatacaacaaaagctgacgagaattgagccgaaccatgttgtgcgtttgactgttggtggaatacgttaggcatttgcggattgtgagacggttcaatgaccacagaacgaatgatgggttgtggcgattgatggaattgctga

SEQ ID NO: 25021 - DNA, 2254 bp, Heterodera glycines
  misc_feature (883)..(883): n is a, c, g, or t
aaaaaaaaaaaaaaaataaaaaaaaaaaaaaaaaaaaaaaaaaagaaaaagagaaaaaaaaaaaaaaaaaaaaagggggagggggggtgtgttgttttttttttttttttctttcctcttttatattaataaaaaaaaaaagaaaaaaaaaaaaaaaaaaaaaataaaaatatttttgtgttttgtttattttttttaataaataaaaaagaaaaaaattatattttttttcttccctctaaaaaaaagaaaagaaaaaaaaaacaccccgcgcccagcagaaaagcggcccacaaaaaaaatattttttaaaaaaaactctcctccctataaaaaaaaaatccccccccccaaaaaaaaaaaaaaaaaaaaaattttttttttttgtggggtatttttcccccccatattttttttaaaaaaaaatttttcaaattttttgtggggttttttgggggggtttgtggggaaaaaaaattttaaaaaaaaaatttttggttttttcccctttcaaaagaattatattttgggaattttttgccccaaaaaaaaccccttttaaatttcctataaaaacttttttttttttggaaaaaattaaaaagggaattaaaaaaaatttttttttaaaaatttaaaaaataaaaaaaaaaaagttgaataaattattggaataatttaaaaagtttagttaaccaattatttaccatttttcagggaaagttatttcccgaaatttcagtttttaaatttacgaaattttcagaattttaattaatattttcaaaccaacaaggaaatttaatccaaaaaatgggtaaatttttatttccacgcccaaaatcgccaatttctttactttatttttaaatttcctgttttnggtgattgaaaaaaattgtttttttattataaattactagcggggtcagcgccttcggcgcatccccccgctaggcagttcgattgtgttatagaattatgaatgataaaatcgactggctcggccgcttcgcgccctcgcatcattttcttggcttttctccaatctctgggactcaacccaccagcaattcaatctctgggactcaattctccggcattccaaacattgggacttaacctaccaactttcaattacattccaatcgctgggactcgacccaccaactttcaatgacattccaatcgctgggactcaacccaccaactttcaatgacattccaatctctgggactcaaatctgcggcattctaaacattgggactcaacccaccaactttcaatgacattccaatcgctgggactcaacccaccagcatttcaatctctgggactcaaatctccggcattacaaacactgggactcaacccaccaactttcaatgacattccaatcgctgagactcaacccaccaactttcaatgacattccaatcgctgggacttaacccaccagcatttcaatctctgggactcaaatctccggcattccaaacacggactcaacccactaactttcaatgacattccaatctctaggattcaacccatcagcatttcaatcactgggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcactgaaactcaacccaccagcatttcaatctctgggactcaaatctccggcaatacaaacactgggactcaacccaccaactttcaatgacattccaatcgctgggactcaacccaccagcatttcaatctctaggactcaattctcctgcatttcaatcactgggactcaattctcctgcatttcaatcactggcactcaacccaccaacattccaatcactgggactcaaatctccggcattacaaacactgggactcaacccaccaactttcaatgacattccaatcgctgggactcaacccaccagcatttcaatctctgggactcaattctcctgcatttcaatcactgggactcaacccaccaactttcaatgacattccaatcgctgggactcaatccaccagcatttcaatctctgggactcaattctcctgcatttcaatcactgggactcaaccgcagcaaatttctttagcatttttaactttttgtgtgccttgagatgttgaacagttgggga

SEQ ID NO: 25022 - DNA, 362 bp, Heterodera glycines
tttcggttccacttccactttctcttccactttcggttccactttcggttcctcttgctctattttttccactttctctttctcttccactttctcttccactttctgttcttctaccactttctgttcctcttccactttcggttcctcttgctttcttttccacattctctttctcttccactttctgttctcttcctctttctcttccatttctcttccactttctgttctcttcctctttctcttccactttctcttccactttctgttcccccttagaagatcttcccctttctgttcctcttcctctttcgccccaaaggacaaaaattcttgatctttcttttccactttctctt

SEQ ID NO: 25023 - DNA, 1561 bp, Heterodera glycines
taaaggagaatttttcaaagaccaagtcacatcaaaattccaggatgaattttcgagcggttttttgtttttcggtgagtattttttgcgtaaattattgtaattcaatatatcttcttggaggaggaggtgccgaaggcgccaccagagaaattgacgattttaagaagattttcagaggtttttggtccaaaaaattttgaaaaatagaaaataaacgggaaataaaaaaagagtcataggcaaaatgtcaaaatattaaaaattttcataatctaaacattttacatgcaggaaaatgccaatatcttttattacctcatcattattttcggcatttgagctgctgctcggatgactcaaacattcattgataaaagccaaaagtgtcggctcaaaccttgaaaatttccaattaattgagcgaattcaataaaatgtaaaaatatcgagaaaaaactcacaaagtttgtctgaatccgacaaaaattcggttcgcttcgcccatgtaagccatcagctcatctttgctgtaatcaccgctcattgaaacagcgaatttttgcaatttttgctggcgtaagtttttcccggtctccaaagtttttggccataattcgtggccatggccgtcgctgatcaacacgaaaaccttggcatttcaatatgttaaataataataataataaaggcttttttgcatttattattattttttctggcacttatagcacagaatacaaagagtactctcatgcaattgcagcgaaagggaaaatcatttttaaaatctaaagtctgaaaaaagccttaccggaggtgcatttattcttttttttaatggattgtccatttttggagaaaaattaccggcactgccggacccaaatctccagtattctattataaaaatagaattaaaatgaaaattttgaaaatatcccaaacataaatcgctcaacattgtgttatcaaattctattttttcgaaaattctatggcacttttatttattatttgaattattatctttttgtaaacaattaaatatcacctctcactcgatgctacgtctaataaatgcttctcacctttaatgcgccgcttcgaccgaatttctcaaattccttttgccctctgtcaattgcgtcacaaatttgtgtaacgcttcaaatgaataaaaaataagtttttattaaaactttcaatgctttaccctccgctgaattgcacttggcccactcggctgagcatttcggtgccattcaatgtgtcgttaagcgaaaatgccacggaaggtttttctgcaaaactgatcagactgacacggagcgattggtcgccgatcgaattttgcaatttggacaaaaggctcttcaccaaagccacttcattgccaaaggtgtgaaaaatggaaccactggtgtccaacaaaagcacaaggtcaacctaaacacagaaaaataggaaaaccaattcacacatttaaatgcaattgtaacgaagcaaaaaattcaaaaacctttaaaagttgaataatggaaaaacaaacaattttaat

SEQ ID NO: 25024 - DNA, 1428 bp, Heterodera glycines
caaaaaaattagttaaataaagattgaaaatttatagacgaaagatttttttcttattcatagcgcttgctttttgccattcagaacaattctgttgatttatattgaattgacaaattaaatgtctcacaatcaaccaaagaaagcaaaatatgagcaagcccaagagaaggaggataaagcaccacttacggacgacgcagagaaaaaggaggctaaagcggataaagcatcacttacggacgacgcagaggaaaaaaaacagaaaatgacggaaaaggaaattactgtactgagtgagtttttatgagtgatggtctaatttttccctatagtttaatcagatgatcaaccaaaatttaggattttctgacaaattgaaccgtttttgtatgaaaagaaagaaatgatagaattttttggtccttttgtgatttaagagcattaattccaggactccatatgtatttttttaaaaaggtacgcacgaagctctacactgttattatgcgcaccaatcaactgttgcaacaccaacagaaatgtttatgtcgcaagatggcaccggttttgtaagtttttagcttttgtaccatttataaatcatgggaaatagaattttgcgcctttctttaatggaatttgtcattttaaaagaaggttccattaccatttgatgcgggatgaagaagaaaacatcttcgacattgaggtggcactagccgccatcattggagaagaaaaaatttttggacaccattttgatgggtcagaaagcgatatcgaacaagcgacgagagtaagcaattaattaaaaatcagtttttgtgctgcttagtttatgttgattttttcatgtcttttttattttaatttttggttgttgacctgggacgagaaacgaaactgaacattgaattttttaagaaaatttgaatgtacatgatttttttaaatttgatttgaaaattggtcgcttggattttatgcattcataaagttttcccttttgcttcagaatctgaaagcaatgatcgaagaagagggatcgaacaattttggatgtatgcgggacttcagcgtaaatttttctcattaaaacaacaccaaaaaacggaaaaaaaactattttggtgttttggcacataaaacatatcacacatatttagggtttggcacatattttggcagttttgagaaaaatctgtaagaaaatacaaaaaaaaaattcaatttgcattttaaaattcactgctgaaatttatcatatttcgggatttttagcacataaaaatgcggtctttactaatcgtactcacttttaaaggttctcacgcccagaccagaaaatcaaaataaatatgacgaattattccgtcaaaaaatggacgaatgtgaaggacgtgtgacgaaaatgtggaaggcaaa

SEQ ID NO: 25025 - DNA, 1865 bp, Heterodera glycines
caggtttgatgatagttttggtaagccaaaaaaaatcctcacctttattaatctataaaaaatttaaaaatgagaattcatgctagattttctggaaataagcttaatatggcatagttaagctgtaaaaaaatttggggcgatttgaatgagaatagaaagagccaggttcgatgaagttttggtaagccaaaaaaaatccaaacatttaaaaatctataaaaaatttaaaaatgagaattcatgcgagattttctggaaataagcttaatatggcatagttaagctgtaaaaaaatttggggcgatttgaatgagaatagaaagagccaggttcgatgaagttttggtaagccaaaaaaatatccaaatatttaaaaatctataaaaatttaaaaatgagaattcatgcgagattttctggaaataagcttaatagggcctagttaagctgtaaaaaaaatttagagcgatttgaatgagaatagaaagagccaggttcgatgaagttttggtaagccaaaaaaatatccaaatatttaaaaatctataaaaaactccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgaatttttcaaaagtccgtttggggtactcaaacttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatgcaaacatttaaaaatctataaaaaatttaaaaatgagaattcatgcgagataatgtggaaataagcttaatatcgcctagttaagctgtaa

SEQ ID NO: 25026 - DNA, 1628 bp, Heterodera glycines
agttaagctgtaaaaaaaatttggggcgatttgaatgagaatagaaagagccaggttcgatgaagttttggtaagccaaaaaaaaaatccagacatttaaaaatctataaaaaattaaaaatgagaattcattcgagattttctggaaataagcttaatagggcctagttaagctgtaaaaaaaatttggggcgatttgaatgagaatagaaagagccaggtttgatgaagttttggtaagccaaaaaaaatccaaacatttaaaaatctataaaaaatttaaaaatgagaattcatgcgagattttctggaaataagcttaatatggcatagttaagctgtaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggtttgatgaagttttggtaagccaaaaaaaatccaaacatttaaaaatctataaaaaatttaaaaatgagaattcatgcgagattttctggaaataagcttaatatggcatagttaagctgtaaaaaaaatttggggcgatttgaattagaatagaaagagccagattcgatgaagttttggtaagccaaaaaaaaatccaaacatttaaaaatgaaagagctagagccgaagaaaatttttttaatttaagcctaaactttttggcatgtttaaaaagcaaattacaaattttattcatctccctttttgatagtaaaagcatcagagagccttatttaacttgtacataaaatttgatgcgtttcagagcattttctgaaaaaatatttatgaattaattttgcaaaaaataataaacagttaaaaactcagaatttctaaaaaatttaaaaccaattacaattgtcattttttcaggttaagttagtcctgtaccggggagtatgcctataaaatttggtacgattttattgcttattgaaagagctagaaccgaagaaaatttttttaatttaagcctaaactttttggcatgtttaaaaagcaattaaaaattttattcatcttcctttttgatactaaagcatccgagtgctaaaattaacttgtaaataaaatttggtgcgctttagagcactttctaaaaaaatatttatgaaataaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccg

SEQ ID NO: 25027 - DNA, 1207 bp, Heterodera glycines
  misc_feature (1176)..(1176): n is a, c, g, or t
aggctgtgcaggaatttgctgtggcacaaaaggagttgcggctgactgcgcaaagatcgggtgggcgaaaccggcaaccaccgggggcaagagcttgccacgtaaattgcggattcattgcgttagttataaaagctttaaattcataaagaaaaattgcactaaatcaaaattattattggggtgagaataactttcgtcatagatgagaattctgtaattttttgctaatttttaaaatataatatctcgggaaattctttgtttttttacgattttaaactctacactcgaaataattttaaaaaagaatcctgaaatataagtaaaccatttatatttgttagggctacatatttgtttttatctcatggcacattcagatttgatcaaaaaaaaagttccgcggaaggcggatttggtatttcctatcagttgtcttccatgctccaacttttcaatttaaaaaaaacgcaagtgaacattatgccaaatcgaaattggagatcacatctttcgcttaatcactttaaagccgttctctttgaattttcactttcctgctcattttttgataatgggtcgacacaggcgttatccgatgaaaaaaacagcaaagaatacaaaccaagcccaaaaaatagaacgattgtcctttgacactgatcagacgcctcttcaaacaccaaaggacagcaggaaaaacaagttttctattctcgaacatagagaccttgaaaagtcaccttataggaatatgaacaaaaagccatccaattcgatgttggaggaacagccaacaacatggaaagagcaaatgttgaagaaactgacagacgaagttgcacaacaaaaaaataaaatacagaaaaggaacaaaaagccaaagaatcgacttttgggtaagagacaaaaataaaaaatttgcggaatttttgattgttaattcagaagaaacgcagaaattgggttatcatcacatgccctgggaaagtgcaaaaacactgatttaccgaattcagcaagaccaaaacaaggctataaatgaagaacttttaaaggtcggaaattggattttttgcttttatccttctttttaaggctcgatttgcaaaagcaggaagagatgttaaggaaatagcggaggaatacaaaataatggacgaaaaaaacaanaatgaaaaggagcggagaaaagcattgcacg

SEQ ID NO: 25028 - DNA, 1193 bp, Heterodera glycines
taatcaatattagttgtgctgaatagaaataatttcccgttattggaattgggtagagcgttgaggaatgagatttttgatttcttttgagagtctactttggatggttgatgagaatttttgaatttgttttgcgttagtttcggaatgattaattatattcgccacaaaatgtcggcgaatataaaggaaaattcaccagatgcccaaatggggtcaagaacacattaattgttgtgatcaaaatttgactataaataaggaaattgtacgagcgagattcattcattcattaatacataaaatatttattattattatttctgttttcttaaatatttcactaatgtctcaacaatgtaatttaatttaatattttttaattaatcaactaaaaatccgcccgtttagctatggactcagcggaccgtcgctcacctacccccgacatggagctttgcgaattgtcatcctggtacgacattttgcaggatgacgatgacaacgtaaaaaatgttttttcatttttcattttcaaaaattattattccagattttaaattggttcacaccggtgacggctcgcgacgtttgccaggaggtgttagcatttgcacaagagcgccgcatgccgtttgaaaagattgttaaatggaagcaaattttggacaaaatttgtgctcagatcgcccaaaataagtgatcgttttgtgatcgaattcatttttaaattgatgcgctttttttggcactgttaaaataaaagttcattttaaatttatgtgagaattatatcgaattgttggggcggtgggggggggggggatctctttatttttgaaaaaaccggtacttgtaccggtacgaaaaaacggtaattaccttgccggtaccggtaccagtaccgctccactctagattggaattaaccaaaccgaaaccgaaactgagtgaaagcgtcaggtgacagctaagacattaattaacgcttagacagtgctgagcagctgaaattaagtttacttttaagatcgttgcaaaatattaattataaagaacgaaaaatttagcgaaacaagtgccaatttgtcacggtttctatgacaaacaattgggtcccaaatttttcatttcaacttcagaaaatcaaatgaaagaaaatcttttttagcacagtcataatattggtgcta

SEQ ID NO: 25029 - DNA, 1999 bp, Heterodera glycines
agttacagtaaactgacaaggaagtcctctgatgactcttatcacactttctcgttttccttcatcttccatcaaaaaatcttcaaaattttcgatgtccaacgtgagccggcctcttgaaccgccagtgttttgcataactctcggatgaattgagaattttgcatttgtatagcccgaattcgaatacgaaacgaacacgctcaacgcgtcgtcagcgtccaacacgccagtgggaactacaaaaattattaaacaaataattaataagtcatttgccctcgtcattttttggactcatgtcacacaaaaaaaacgaaatctaattaataatttgttacaaatatagtccgaaaagtccctttctgcgataattggaaaacggattttgtaaagtgcgtctcccatcattctgcggagatccaatgcgaagcattttgttcatcctctttttcttggcactgattttgcgcccaacgaattgcctaacaataaaataaagatgcaattagtttcaattgtcatatgattaccgccttccaaacgtcaacggagacagttctgcgcaaaatgttcgaactaaataaaaacaattattagctgggtcgtttcggggccatcccaagtttttgggctattattatttttaatttcaatgaatcaacaatcttttggcatcattctaactcatagcatgtttagaaggtttgatttcgttgaaactaaaaaaaattatagcacaaaaatttgggctggcgccgaaacgctcctttcccctaattagcgagttaattcaaaatacaattaatcctttcttaatgtaaaatgagttttataaatatttgcttatatatagcaacgcacattaggtcctttcagcttgagacattcggaatacacagcaaaaatgttgggaatttcggagaagtcaaattgcagacattcggcgacaagttcgctcatgaagtattggtcagctaaacaaaaaaaaataacaaaataaaaaaggcatttgatgaccggctatgaaaacttcgaacaaaatttcgcctttcacttctgccatatcaccgcagtacaaatagaaaagaatggcattgaacacgtcaaatttaatgtttttgattgccacgggttttgttggaggtttgtctaaaaagctattcgtctttataagattcacatttttggcacgacctttgttcgcatcatctgaaattagacgatcgaacgcaccagaaatgccccacaaaatttgcctgtgggctcggacatgcttaaaggtaaaaatgttatgcttcgaaattctgaattctatctgaagtttatgccttggtttcgccaccctcgtcaaatacaaacaccaaatcagcaacggacccagtcaataataaatttttaaaacgagttgacacggaagacatttcaaaattaattgtattttaaaatatgtttgctcctattagaaaattgcaaaagaaattagaaggaacaggcaattgcaaaataatgaataaatagagagaaataacaaatagaacagagaatgaatgactgaccccaatgaaagggtcaaaaattgaaaaagggcagagtgaaaaataaagtggggaggggcggggggattgaacggacgtgggaaaggcaatttgcaatcgatgagaagtttattaatcattcgtattttttaatctatgcatgcatatgctttatgtgcctgcgtcattttttttattcaaggagtatgtgcatcaacggaacgaaaagggtcttttcacatgaatttaccgtattggtaggatggcattctaatgcccaaagattgggcagagcttacctaaatattgccactttattttaaaataaatcagtcgaagaaatattgttttctaggagaaaagcccattgcttaatgtatgaaagaaagttgtttaatgagaattgttctgtgaaatctgaatgttttactgaccacagaaacgagtcaaactttcaaaag

SEQ ID NO: 25030 - DNA, 1752 bp, Heterodera glycines
agtacaaatgccgcgcgaatggcgactgtccaattgacaaaggtgagagagagaaagccaagagtatgaatggcaagtggttattttgataacacttgtttcatctttggattaggtcgatcattttcaatacttatacttttgtgctgttttctttctgtactcagatggcatgcgcaattgttgtcgtgcctgccgccttcggcgctgttttgaggccggcatgcgactcgatttggccccaaatgcccacggcaacgattggccttacgctgagcttaagtccgccgtctcctcggccaattttctcgagaggccacggccaacaaagcgtgccattagcgatgccattatcagtgccattccgacgacttctttcctcagcagtccctctgcctttgatgctggcttattgttatcgcctctgccggtcactaatcgaattggccatttgctgagggaattttcggacagacaaaaggccatttgtgcccaacactttggcattggcactgtgcttggcaataaggttggatcgattgtcattgacaattgatcaattatgctgatcagttgaggccgatcactcacgaagagtacagctgcatcgaacggggcagagttgtgctgctgctcaattttgtgcgggcaattttcccccaaattgactcgataccgacacaggaaaaggtactaattgggcaattagtcttcttacttccctaatttccatgataaataattctgtattttttttgaaattcgcaattgaatatttgctataaaatttgaggtccgtatactcaaaagcttcacatttctcttcaatgttctccatggcagtgatttaacggtgagaaaactaaaaaaacaattaaaatttaatttaaaagttaattaattaaaaggtccaatattttcccctgctggaagggtcggactgtcaacagtttgtcattttgcccggctgtctgttccaagtggaccattttgctacaacactaactggcccgggaaaacagcagcaaattgtgtcggtgccttaggatgaataagaagcagaactaataattgaactgctcgagagtctcggcctcaataaaagaaaatctcgcgcattctttggggtcttccgggttcattttcagtattggtaaatgcgatttctcaagtagtgcaaccaatacggtaccgtaccattagaaaagcaaattcagtttcgctagtcaatttgtgagccgcttttgtcatttcctctcgcacacattcaaaccgttgggcataacgccgttggaatttgccgcgctccaaggcattcagttgtggaaatgcggtaattccatcggcacttttgccaaaagaaaaaccaaaatttggggaacagttggcgaattcgcggacagcacgacctcgcaattcggaaccacttctgtcgaacgtccaattgacgcgctgttttccgagctccattcgctgatcgtcgcctcagaaggcggtgccgccaattcgaagggcgtcgccgtccgtttcgggcgcgattctgtcgatgctaacggatgtttcggttggcacgaattttaatgattgaaaatattgctcaatgcttctctcccctaaaaaaggaattgggtcgcgatttgagtgaactgttcactctgtgcaaagtgtttttggaccctggagagttgcgtgaatagcaacgtcggttgggacgaaatgttcgcggagaaaagacggagccagaaaccaaga

SEQ ID NO: 25031 - DNA, 707 bp, Heterodera glycines
attcacttttacgttcatatctgcacagaataatattttttgatgtttcaatggtttttgactggatttagcttgttttggtcaattttggaacaaaagtgagaattttgaaattttttaattttcgactttttgttcggattcgggtccgggattcggaattagtcaaaatgaatgccagattcgtgatcagcgacccagaaaaccccaaggaaatgtgttttacacggcttttttaaaaacttttatttttttcgaaaaatgggggggggggggtaaacttcagtattaccaaaataagtctaagcatacaagcctaacctaagtctatgttcatcgccttttgtatgaattgtcatgactagagatgggatttttaggtttttacctatttttttgcggcttagttatgatgatagaagcccaaaaatagcattttcttcgaacaattgcgactttttagcatctaaaattactaaaactggattttcggtcatagcacctattttggcatttttcgagttttaacacctattttggccttttttcagaaatgattttatctatgatttttcatcaagtacttggttttttccaaaattttaaaaaattaaacgagcgtaaaaactcatggaccgatggtggagagaattgcatattattatccaggttaacaatttgacattgtgtgtcataattaaataaat

SEQ ID NO: 25032 - DNA, 992 bp, Heterodera glycines
ataacaaaaaagacggtgtaaactctgccgaaaagtgcctgttatgcatacatacttgattatccaattatgttttaaatacatatattaaccagggccctgcgggccctgtgaaagcgccgggggcgctttcaacgctggctctagtgggagatataatttggggcgtgcaaaaagcatctattggccactaagcgatcctcatagtttaggaatatgagaatttggaaatgaacaaaaattaatttaaaaacgatattgttttaaatttaatttaaatgcgatatttttatttaaattgattttaatttattttttttaaattgaaatagcttcgctatttaacagtctctagagggcgctacgcgccaaaaaacttttatatgtaagaaggcaactgatttttttaatggccgggaattcaattaacgttttcctaaaactcaaatttttaatatgatcacttaaaatctcttacttttcctctttctcatcccctttcaccctcctttctaccttcccatttcacttcatcactctcgctttctcttgctctcttctctttttgttccttcctctttccctttgttgctttttctcttcctcttccactttcaccttctcttcctctttctgttcctctttatctttctcttccatttcccatttcctttctcttcctctttgcctttgttgctctttctgtttctctgttttcttcctcttccacttcctcttcccctttctattcctcttccactttctgttcctcttccactttctgttccactttctgttcctctttcagttcctcttcctcttcctctttctgttcctcttccactttctcttccactttctgttcctcttccactttctcttcctctttctgttcctcttctgtccctcttcctgttcccctttctgttcctcttccactttctcttcctcttccaatttctgtttctctttctgatcctcttccactttct

SEQ ID NO: 25033 - DNA, 1918 bp, Heterodera glycines
  misc_feature (1816)..(1816): n is a, c, g, or t
ccaagaaacatcttttcgcgactttttctaacaaaaagggcccccaccatctatagcagggttaccattgaaaatttcccgaaataagaacatcgctggtcaaaaataagattttagggtcaaaaataaggacatttttaaaacacgcttccaaaatttaaatcgcatttttattcaacaaaatcaagcattagcaacatatttctcgccgccaactatttttctgagcaattccggcttagaaatgagaaatttatacatccccgaaaatggattttaataattttgtggaaaagataagcaacttgtaaattattttaagttcattcgggatcaaaaaatcagtttttaacaatttttttgcggcgtgctttttccaaaaaattttgaggaatgggcgatgggatggggtccggcggtgccgataggcgccgccggaaaaaaatttgtaatttctttctgatttgttaacatattttcatcaaaaaatcatcaatttttgcggttttaacattcaaaaggctttttttgcggcatttttttaaaaactttcttttttatgcggggggaagtccggcggagccattatgagacgattggaaggattcctccaatcaacgttacttacattcaaattttgctcctaaggatcgctttatccatggcatatctaatgtcatctcttaagatgtattagtaattacgtgtaaatatatctacagatagttgtcccctatcaaaattgtgacacagttatttccgcagggacttcagctatgctatgcttcgtttgctaggatgtttatttctctaatcctgtgtttaatctcactgataataagggttgcacaaattacagatgtgccgctaaaagtaggcttagtaacagcataagcatgttattggaacatccctcctaccattatttcatatttctctcatatggcagaaagctacatattctagcgatcagacttttcagttgatctggtgttttacgaaagaattttgtgataatgtagtggtgctaatgtatttctataattttgtatattgtatatttcatcatgaacaaaattgaaaatattttcgaaacaaaaacatggtacagaaaggaagcttaactttctgcacacgtagatgggctgaattttggcatcgaatgcgtctacaatgcatcagtatttctatttgttacgatgacatactagaaaatgtagaaatcaactattttcagaagattgcgaggcttcctccgatctagtttggcaacattgagttcatgcttctaggtattgcaatacccacagcatatagaatttgcctagaaaggctgtattagtgtaaacggataaaaatatctacaaaggttgtcaccaatccaaattgcaaaacagcgatttccacaggggcttcagctatgctatgcttcgtttgctaggttggcatttctctaatcctgtgtttaatctcactgataataagggttgcacaaattacggatgtgccgctaaaagtaggcttagtaacagcataagcatgttattggaacatccctcctaccattatttcatatttctctcatatggcagaaagctacatattctagcgatcagacttttcagttgatcgggtgttttacgaaagaattttgtgataatgtagtggtgctaatgtatttctataattttgtatattgtatatttcatcatgaacaaaattgaaaatattttcgaaacaaaaacatggtacagaaaggaagcttaactttctgcacacgtagatgggctgaattttggcatcgaatgcgtctacnatgcatcagtatttctattttgtacgatgacatactagaaaatgtagaaaatcactattttcagaagattgcgaggcttcctccgatctagtttgcaacatt

SEQ ID NO: 25034 - DNA, 2576 bp, Heterodera glycines
  misc_feature (24)..(24): n is a, c, g, or t
atttcaagaaaataaacgattttntggaggattcttctaacaaaaaaagaaaagcaaaaaacataattaattacccctttcaaatcattcaaaaatgcgcgccattctcttccttgcaatggtttgcttggtgatggctgttattcttgagacaggtggccaaaattaattaaaaaattaaaaatattttattattttagccaactcaaaggcagtgaaaaataagaaaggtataaataaattgataataaataataattggaatatgcttttaaaggaacaattacaacgccagcaaaaggaaaagcggcgccgaaaggagcagcgaaaggaggtaaagcagaaaagagagagggactaattaatacaaattaattgattaactaattaattaattaaggaattaaaaaagacgcaaaatcaaagggaaaaggaaaaaaggacgccaaaggcaaaaagggtaagaattttaagtttatttttaatgttattaattttcacaaaatctataaaaaaaaaattccgttgtgttggcaattcaccgaaattaataaataaggattttgatattttttaaagttttaaacaattgttaccattccgaatcagtcatcaagctaaatgtagttgtcttatttttaattaaaatcaactaataggctttgaaaaatgctataaatattttagaccaaccaacttattttgtgattaataggagggcttcctttttaggctcaaaaaatagcaaaatagacgttaataggcactaaaataggcaaataaattttttattaacgctttttaggtagcaaatggtaaatatttctaattgtatgtggaattaataaatattttaaagttttttcgaataagcacaaactttaaaccataattttttataaagaaaaataattaaattgtagaggatcaatttttctaaaaaaaatttgggtcgtttcttagaggtgtatttaagagttttccgaaaatcctgaaaataggcgccaaaaatggataaataggcacaaaattaggcattataaaagacatcgttgactccccaaaaccagtttttcgtgcttatctgagcgtatcaagcgcgcagaaattcttattcagttccaattaatttttctacaaaatgtaaaaaaagaaatgaattaaaattgtttgtattgtacgatggattaacaaaaattaagtgctacgcatgcggcaggattcgaacctgcgaaggaaatatccctttgcgatgtaaacgcaacgccttaaccactcggccacacatgcggtaatgtcattcaatactccaatgcgttaaaaacattcaatcaggcaacgctccgggtttagcgctaaacccgagttgacttgtgttgatccggattaacctttttatatcgcggtgtgtctctaggttaaatgtttcttaacccgtgtttaataaataatctcgggttaacagcgtcagtgtcctcgtctttggattcttaaccgggttatccgttaactcgggttttgttaactcggatttaccaacttttaacccgggtttatctccgtgaacccgggtttaaaataaatttgtgtgctcgtttaaccttgtttattttcttaaggatttttaaccctgagtttaggcattgttaacacattttaaacaaataaataatttaaatataaagaactcggtttaacggcttaacttgatttatttagataaggataatcgaactgactaaaatcacatttttgcaggttttaatgcttttgtgatctcataattatttttatatatcgataaattgtcaaattaacgaattgaacatagacaaatcaatgaaaaaaaaggttggcattggcataatttccgggcaaaaaattttggaaaaacatttccaatttcaatgaaaataaaagattttggaggaatataaaagctaaaagaaagccaagcgaaaaacatattcgaatattttaatttaattaatttgcttttattatccttcaaaatgcgcgccgttctcttccttgcaatggtttgcttggtgatggctgttattcttgagacaggtggccaaaattaattaaaaaattaaaaatattttattattttagccaattcaaaggcagtgaaaaataagaaaggtataaataaattgataataaatattaattggaatatgcttttaaaggagcagttgcaacgccagcaaaaggaaaagcggcgccgaaaggagcagcgaaaggaggtaaagcagaaaagagagagggactaattaatacaaattaattggttaactaattaattaattaaggaattaaaaaagacgcaaaatcaaagggaaaaggaaaaaaggacgccaaaggcaaaaagggtaaggattttaatataaagcgaaatttaaacagttaatttttgaattttagacaaaaaagctaagccagccaaagggaaaggagtgcctaaaaatggtaattattattaattttaaatgctaattaaaattgaatgaatttagacaataaatccccagcggcaaaagccaatgacaaaaagagcccaagtaaataat

SEQ ID NO: 25035 - DNA, 1615 bp, Heterodera glycines
aaaaaacgtgtgcgaagcgcccgtcctcttgccgcgaagcgcccgaatgttcccaacaaaattaaaaaagggctcgaagcgcccgtcctgaggccgcgaagcggccgaatgttctcaacaaaattaaaaaacgggcgcgacgcgcccgtcctgtggccgcgaagcgcccgtccggaggccgcgaagcggccaaatgttccccacaaaattaaacaacgggcgcgaagcgcccgtcctgaggccgcgaagcggccgaatgtcccccaaaaattttaaaaaacgtgcgcgaagcgcccgtcctgaggccgcgaagcgcccgaatgttcccaacaaaattaaaaaagggcgcgaagcgcccgtcctgaggccgcgaagcggccgaatgtcccccaaaaaattaaaaaacgggcgcgacgccccgtcctgaggtcgcgaagcggccgaatgccccacaaaaaattaaaaaacgtgcgcaaagcgcccgtcctgaggccgcgaagcggccgaatgtcccccgcaaaattaaaaaacgggcgcaagcgcccgtcctgaggccgcgaagcggccgaatgtcccccgcaaaattaaaaaacgggcgcaaggcccgtctgaggccgcaaagcggtcgaatgcacttgctcatcacttatcaaacgcgcatgcactagcaacgaagtcctttgcgcgaagcgctcatgtcagcgcccgcccatatataccaaaagtatactgtctacaccgagcaattactgtgcaaagcatactgtctacaccgagcaaccactgcgccacacgctagtttaatacactaataatcaaatcgtgtttcgtttccaaaaactaaatctcgggaaccgctggagggaggggctcgggatttcgaccttgcggacaactttttgaggcgcatctgggaaaactatagattttttgatccggtggccaggtgagcgccagcggcgctgaaatggcttttttaaaattttttttgccgttttttggatcaaaaattttttaaaaggcctaaatgaaaattccgttcccataggaaattaagttggactgttttgcataattttttgttcttcaccgaccccatagggcttaccgatttttccgaaaaactgagcaaaaattgcatacttttttaggccatttcagcgccggcgaataactcgccggggtttgattggaggaggtcggtgtaagcggcttttttgtacagtttgacgagctctatccaaccatgtttttggatttctgaaattttcagaaattttcgagctaggccccctcaaaaattttccgtttttgaattttatgattttttacagatttttccggggaaaacggagaccactttcaagcaaccgtttttcatgctctatcgattggtgtcattttcagaaaaaattttcaaaatttttttggaaatagaaaattttccggaattgagggcttatttcagtattgggtccataactcgtcaggagttgattttatcaaaaaatcgtctaagagcttttttgcagagaattttaagcccaatctaatgtgctttatctcatgtttttatcttgaatttaaaaaaagttataaaattaattgtgatttt

SEQ ID NO: 25036 - DNA, 1658 bp, Heterodera glycines
aggaaatgttttgtgtaaaatagacaaattttcgattggactgatcaattcgagcaataaagtgctgatctcgatgctgctgctgctgcgtttttttgtcgccaatttgggcacgaattgtaagccgaaaaatggtggaattctttgtaatttttgatgggtccggcacagatagggcaccttaaatggcactgcaaaatggcaacaaatgcactgttctggaatataccgtccttttccaggacaaatgccccgaggcaattgcctgcagcaatttcaaaagttatcctcccatcttggcgttggtgttggccactgttagtagcagcggcaaaatggtgcaccacattgccattgggatagagagtttgttccaaatttgccataaaaattgtgacattgggtgcactgaaattgtacggacggagtaggacaaaacgtcgccggacaaaacatcaccgaacggacgagtttttgggctataactttttgctttctcaaccagattattaagtatttctggccataactttagcagaataatagaaaacagataaagctattactaagaatgcttaattaggttaacaaggcaaaaaattatgatccaaaaaatcgtttggccatatttcgaccggcgatgttttgaggtgggcaccggaaaatttacgaatcacggacaattcagtatagcgaataaaaaactttcatttttaaataaaatatatttttcttttttattttggaccacacctaagaaagtgaatggcatttcttttcgttgcattggacgaccattggtcagtgtcgtcgatttggacattgacgcgaatggcacatcgggttactgtagtcccaccataatcctccattttactgacctccatcaacaagacaagggaatgctttaaaagcaagaaacaaaaattcaaatttaaatcaaattttgcatgcaccaaatttcgatccaatgttttctgaatgtaaatattgccgtcaaattcgtcgactcgaaaatttggcgttgcatttgcattgacaaacgaaaatttatgtgttgcactatcggtgacattgtccaaaatgttgacacgaccaatcaaagtgcctaaaaatttgtaaaatttaattttagtccaaaaacatgccacggcacacaattttcaaattatttgccatacataccaataggaactgattcactaatattccactgctgataggatatggcacaacgaagctgtcgatgattgacattttgtctccaatttgtccagtcaatattgatcaattggacagctttttcataaacaaattgatcagacaaagaccgggccatgacacggaatccaaatttgttgtcggcacaatttatgtgctgaaatttgcccatgtaaaatgaaccctgcagttcatccaacacgaaaattccttgctgaagtgcctgaattttcaagaaagaatgagttagaccaatcgagaaatttgaaataatgaaacatacaaaaacttttttaatttcataatagttttttgctagaaaacgaaatttcaattttttagctaatttttcatgttttgtgtgattttttaaattttacacatcaattgtgcgaactgaactgcatattgtacgaagtattgttaaaattcttgat

SEQ ID NO: 25037 - DNA, 988 bp, Heterodera glycines
caattttagttatacccaaaaaaccatcattaccgtccctactacgaattcctgtttccttgcgatatgcgcctgatcttttgaccatgtaccaactgtctgaaacagaacaatcacttttttgtttttattttttacgtacatttgtcgcttcggtgatgtcttcatcgctagcgatggtcctcttgagaacgatttcaactcccaatttggcagccaaacaaaactcaacatcttccaattgctggtgctttccacccaatttttcgcagtgttttcgtcttcttgtctataacacaaattaactagggcttttttcagtgatcaaggttttttaataaaaattttttgaaatttgtacacaatttcagcaaaaaaaaactttttttaaaactcacttctcctttcccattacgtgcgtaagccatttcaacggggtcgctccacacggactcatgcgcaacaacagcgcgtgacgcttcctttacggctaaaaatggaaaaattgataaaaggcgggtataaaaaagtttttgataatttttaaaattgaaatgaatgaaatgcaacccacttaatattattttttcatcgtctgtaatttccattccttctgttccatcatccgtttgtgtgtctacgtcaactttttccatagggacagtttgttcctcttcggtaacttcaattagtgggggtttttttaggaaaagataaaggcattggccagaaaattggcccaaaaacaactaccgaatggggaaggatgaaattgagcgattcttcagccaatacgaagcggaccaattggcacacggtgaagaagcggaagaagaggcaatgcaataaaagaaacgccaatggacgatcatatgcatttaatgcataacaatttaaccatttgttttttattattaaaaatgccccccatttcacaatgaaaaagctttattttgtattcatcagaaaaaaatagttttctctaaaa

SEQ ID NO: 25038 - DNA, 991 bp, Heterodera glycines
  misc_feature (5)..(6): n is a, c, g, or t
accanngtcattggaaacttaaattcattcgaattttcattcccaaaatttccatttttaccacgaattcattggcgcattttcccgcactttttttaatgattcaatttaaaattaccattaaattaaaaggaattcgtttcattcacctacctatttaaaaaaaatgtcgcacaacccgaaagaagctgagagagaaatggaaaaagcgatgtaatattctaaatttggatgcccatggcttatcattttgcttttccgttttcagcttcatctctgccgattgttggctcggtgttttcgatttgcttgagcctttacaacttggcctcggaattgcactgatcagccaccgttttgactattacgtgaacgtaaattcaccgatttcaatttttcgtcgacgaagcgctggggaaaaaacgcatgaaaatgtaagttgaataaccaatttaaatgaaatataagatacgtaatactggagaatctggattccacccaaaattttttttgttatgaagactaacccggggtttttggggcttctgatcacaaaatgatatcagatttgcaaaaacaatgatttacaaaaagggtacaacattcgatcatattaataattttttttttaaatctgattttcaaaatcaatgataaaatgatttttgtttaattttgtcggcgagtttatgccccggcaaagtttccgccggcaaagttaaaatattagaaactttttcgggtattagagcccggaaattttgaaatgtcatgacctgaaagtcaacttgggcgcgactcccaaaatgagagatgtattttctcttactctctttatttcgggacctgaaaatcgaccaaggcgggactcccggttgtctcgggattttgtcaaaataaaagcccggcaccagactaatcggcgaacaatcccgtcggcgagaaattttaaattttatttcagggtggaagggaatacgatctcctcccc

SEQ ID NO: 25039 - DNA, 1393 bp, Heterodera glycines
gttcaacccaatacatttacagttaattttttgtggccataaaattgttaattaaatcaaagaaaaacgatgcaaaaattggaaatggtggcacaaacgctgcattcactaatgacttatgagaataaaaaattggccaaaaagtaggcgttggcgagaaaagaagcccagcggcagaaggggacggcggacacacaaaacggtggggaaagaaaagaaaggccttcgggggaggggagacgggggacggattgccgtggcaacgattgacggacggaatggacgggggcagcacagtcagctgcggaacaaacttatgcaacggaatttataggcgcggagggaacggctaatgaattaaaacatttcaattggaaataaaatttaaataaataaaaacaaaaaaattgaaatgtgacgattagtggccggttgttttgaagaaatcttttgaaaaagagaaaagggaaagtgaattcagcaaattttaaagttatatttgtttggttctaacttataaaataatgatgaaaaattccaaaacaattgcataaagccaaattagtgccgtaatgacgaaagtcagaaataagatttttgcttaaaatcgctacctaacaaaccaaaagtggagcgcggacaaaaaaatatctcgcggttacgaatcgcgcgtcgtggattcaaattgccgcgatatcaaacacgacgcaaaaaaaaatcatcgccgcgaatttcgttttgcggtcgcgctccaccccagctagtcataacatattctatttatatgctctgtaagaaaattatacgttcatgattttaataccacaacaaaaatcggaaagtgtaaattttatgaattttttgagccctttattcataaaaatttattttattatatcacaacattataacggattgttttacacttttgtatcttcttctatttctattttgaatatagcgcatatcctttcaaaatagggtaattaaggcaaataaatgcgatgtgaatcagtgattttgttgcgacagattgcgcagcttttcccaattttatttgcacagttttgacacgcaaacgcatggccacagggcaagaagatgacttcgatctaaaaagttcaagtaagaattaaaaaaaaagacaattaatttattaaatgctatgggattttattaaaagttttgagccgtttcttaaaacgaccaaattgccaccgattcgtgggttaaaaagtacggttttgtttttatttttctatcatttggcaaatttcagaaattcatcgcatcgttttaaaactgccaaattaataattgcacattttttgcattttttaagctttatttttacaacaaaatcaaaaaactttttctttgaagcacacacaca

SEQ ID NO: 25040 - DNA, 1569 bp, Heterodera glycines
acatatgagtagggcccggatttttagtgataaaaacttcctaaataattaactaaatagtgacaaaaaaatgccaaaatagtggcaaaaatagtggcgaaaaagttccaaatttagggggtgtaattttttaaatagctgttttttaatttgaaaataatttaaaattgaggtaaacaattttattcactgattgcagttacaaaatattttcttagcaaatattgaacaagaaaaaaaaatttgggggaagaatttttgtgaaaattttccaattcttaggggtgtattttttgaattttttaggtcgattcttggggtgtatttttcgtttttattgcattttttgggaaattttccaaaaaatgccaaaatagtggcaaaaataatgacgaaacgccaaaatagtggcaaaaaattattttagtggccaacttccaaaatagttttttttagtggcgaagctccaaaatagtgattcctagtgatgaatagtggcgttaaaacgaataatttccgaactaaaaatgtgtttttcgtgcatttctaatcaaaataaagccgcagaaaaaatagttaaaaaactaagaatccgggccctacatatgagtatacgaaaagaaaattaaatataattcaatttctgtagagggattgaacctggggaaagaagtagaaaatcaagaagattagccactaagccatttgcacaatttttagtgttacttttagactatatcaatttttttttaaattttgcctttaactccaattttcagcattaaattttcactcagacccccttcataccagtgcttgtttttctcggttgccctaccgggaccgggaaataaatttttaaaattcgggacctcggaggaccgggaattcccggtcccgctctattctagtctattggatcattttgacatacatttgatttttgtaatcaaacaatgaaaccaacattttaaacaattcataaacattgtttaacaaacaaactaaaacaaaaataatgtataattttggaattaaatttcggagcacaaacacatcgacttgaggatgggagaataaaaaggccaagtccatgtttgtctaatccatggcatccgttcgtcacagaaatcccatggctgtactggttgttgttctttcatcgtcgctgttttcccccgcttttgcgcttgctccacttcggcagtgcgccgcgtcgttggaatgtgccacgggcggtcgcctcgcgacgctgcacaatggcggtgaaccggcgcttgttgcgtgccaacagttccgtgtccgccatcagctcctccaccattgtgcgcttccgttgccgtcttggaacccgcgcggcgtagaagtcgaccttggattcgtcgatgtggccaatttgggggagaaaacaataatttatggaaaaaatagattttttttctctattgcacagtttaatcgatcataaaaaaataaattttatcggttcataactttttctagaaacgttcaaattaaagattttcttgtcatatttgataggtagaaggattctgtattatctgcgaa

SEQ ID NO: 25041 - DNA, 1506 bp, Heterodera glycines
tttcatttttgaatggcaaataaaactaaagatttatcttccggtcagaagtatattgaccatttaccgaattggtaacctgttgtgtcggccttgagagccatgtatttaatttaatactaaatattttttaatgttaaataagatacgaccagctgtgtctcctattacttctgactatgctactaatcctagtgattgagacaaagagaaataatgggctaggcttatttgtcgcctgctatttgttgctactgaccttatactcaaatttttgccttaacgaacaacactcactggaacctattcactttatcgaagtccggcatgcctcctgccgatacttactgatcaaagatagttcgattctttgatcagctcattacatatctcgcgcgtcttgtccctctactcctcgccgctttgatttttcattccctttttttgacattttaataccaaaagcacttaattaatctgccaattttcacatgcccaactaattaaatgaatatggaagaatttttttctttttaagggaaattaaactgatttcaataaacaaccaaagtaattgtttgtaataattataaaataattgttaaatccagaatccatatttcatttttcacagttttgttagataaaattttcattctctttttttgacatttaataccaaaagcatttaattaatcggccaattttacttgcccaactaattaaatgaatatttttgtctttaaaatgaattgctttgtaagggaagtattaagtacgactcaacccttaagcaaattctctggaattaactcatgatgaagatatcagaatttcgcccctcaaaagtctggaaattcccggaatcaagttttcaaattttaatcaagtttcatttttttttattgacagatctcaaattagaaaagttctggttaatttaaataaaaaagaaataaacacattgaaatcgattacattcttttcaacattaacattaaattcattacaaatctcaaattaaaaatttggttaattttaataaaaaaaaattaaataaattaaatatattttaattcaacattttacattaacatccaacaattatttaatcaaaagtcaattgaatccatcatagttggtaacattaaaattttttaaatgctcaacagttgacattttttatgtcaaacgataaaaaaatggttaaaatgtcggttaattgtgtcctgcaatgactaattacacaatttgcgcctccgcttttcacacataaagcaattgacattttaaaacacaaatagcaaatttatttaattcgttgcccattaatgactaatcggtaattgcctggcttaagggcttcaaaggcagcttggtaaccaaagattcgacaaataaatgaatatttaagctcaaatttttacaaagaaaggcacattcattcattctttattatatttaattaattaaattttataaattcaaaattaaaattaatttttc

SEQ ID NO: 25042 - DNA, 1397 bp, Heterodera glycines
attaacggatttttgactaatttcggtttgaatgaaataggaatgcggggaccgtataattaaaattatattttattattaaattaattattaaaagattaattaatattttaaattgtaaaactaataatgatattttataaaatctctaaaattatttattttttcttaacaaaatgttatttttgatacataatttataccgtccctttttagcttttcatttattaaaagcagcgtctatccactgtctgcccctcccacccgccgctgcctcgcgtggacaaacaggcagacagtgaactatttctttccttcattccctctaaccactacagcatgggaggagaaatcttttccttttctaactatttcttttgctttcttctttttcttagctatttcttttgcattcatctatttcataactatttcattttcttctctttttctttgtaatctctccccacagcaaatcaactcaacgccaaacgccacattcaaaccagggcggatacacacgccaaactttattatataggatcgtcgtatttcaaaatttggttttaattattatttttcaatttacatttttgccctttttatgattatattatatgatttcttagtgatttatgttttgttcttgttattttagcattttcttgtttgaaaatatacttttaaatatttttaaatattacttaatttgttttttaatatgtattactttttgtggtatttttaatcttttcctcatttagtgacgccttgtttacgattcagaaagcatttgacttggtcagtgcattttcgtttaactcgttcatgttcggtagtgtttgttttctttattttctatttgtttattgcatgtatattatagttgtataatttttttctttttatttacaaatgtgttcatttatattgccttctattcatcatttcaaaggaatttaattaaatatttaattttagtattgttttcaataccgtaattattatcgactccaaagtggttaaccgtatgaatgatttttctaaaatttcatttgtaaagattctttaaatttttgatatttttttcaaatatttatttaatttattattttcaatttaaaacaaatagaattttttagtattttttaattctttcaatttataaaaatggtagttcttaaaattacccatagaattaaaaaaaattcaatttatttaagtgtttgaaaaactatttagatattaaaacaaatatttataaataaactaataaaattaataatagctacattattaaaaatgccaccatgtttacgaaaatatcgacaaagtaatgaccaaaaattggataaataaaaatattctattgctaaatgtatcaattgattttttca

SEQ ID NO: 25043 - DNA, 1080 bp, Heterodera glycines
  misc_feature (13)..(13): n is a, c, g, or t
  misc_feature (30)..(30): n is a, c, g, or t
  misc_feature (52)..(53): n is a, c, g, or t
  misc_feature (92)..(92): n is a, c, g, or t
agtaattattatntattttaaatgtttttntaattatatgaatttttactgnnaagagattaaactgattctttttttctcgtcgtcttatntagtagataccttttcttcccaatgtaatgcttgctgataaataaaaacgttattttataaacttatatttcttcatgctcttctcaataataacaaagttaaaaattattaaaattatatatataaaaatattttaattttttgattgcttttttttacaaaattttttttgttatttttttatctatcaattggggagcgcccttaatcaggtcatcaatgactttctttggggtttaaaagaattattattttatttttaaacaatgatttatatatatttcaattgccatttgggtgtatgctatgcgcaattagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggaggtagagaaaacaatttcaataaagagcgcaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgattggggctgaatataacaccctctcacttttgcgttatctctctccccatcttattttccgccaaaagtcatttttgaaaaattgctttaaattttaataaattatcccaattttaaaaatagcgttgatattacgttgatggcataatgttatgttgatattaaataaatatcaacgtcaatgttgatatttattaaaacaattttcgctaagagaaaatgttgatttgcctttctcta

SEQ ID NO: 25044 - DNA, 1707 bp, Heterodera glycines
gagtctgttcttctctctcctccttgctaccgccaattcttatcggacggattatcatttaagtttcttgtttcaatcaaaggaaattgtgaagtagtgcaaaggttttgatagcccgtctgcatcagttgggtttttaaatcacaatggaccttttaggcacccaaccgatttttcaacaatactcacccattttcaatcagatttcggcatcgggcatgggttatttaatatcttctgtccatattttcaaattaaaagtttggttaaaaatcgttttaaatagacggaagcaaactgaaagcatcagtccttcaataagagaaaagccgcttttaaccaaaaatgctaaatcgaaaatttggacttagactttttattcaaattctggtccggggttcggatgaaatgaatgccggactcgtaatcagtgacctcgaaaactcaaagagcatcggcgattgtttagcgggcaatttgagttgcagcagcgacttcttcggcggattcactgcaaattaatagattatcaccgtaaaggtttttgccatccccaaggggtgtacaaaatcgaaaaccaatgctgacggagaacagaagcaagcagaaatggcgaagaattgaagccgaatgcaattcgtttgaagcgaaaatcactaaattttcagggattaaggattgggaagggtctctatctaaataaatttggccacttcccggtcttccgcccgaagaccgacggccaagaaagccttcttaatgtctgcaatgtacaggaaaggtagaggactggaaacgtagctaaattcccgctaattccggaccaaatttgggtcagggaggagtaaatcgttcagtgaagccttccatttttcctgcgcggagttatcatagacaactcgcaatttttgggggttcgaacctcatgatgttgtataaaatgctcccttgcccctgaacaaaccgccggctttataattcccggtcaattgttccaaaattgtcgcttgatattattctcgaattcggtgttgacccttaattttaggggcattccatcagacgggaacaggcgagtgaaaaattattagacaaatggtctctgcctccggcctccacggtcaaccaacgtcataccttccatacagtgtcgattcggaaaaggcctgggtgaatttcccaggacaaatctccaaaattctcttattcccaaaagaatttggggttctaaccgttatccacattttgctcgcctcgggcggcttccaactcacgaagtctcagggagcatgtacggcttccttaagccgtacaaattttgcaagcctctccctccactgtttagaggaccacggcttttctacaactaccacctttttagaaaaggcccttattgaggtaggttgcccgtgggtttgactaagtgaaacagctatttcggagggtgatgcgacttttgcggcgccgacacttgcggcgcagacatttgcggcgcccacccaaagtgacacttgcggcgccgacatgcggcgccgacacttgcggcccgacatttgcggctattttttttgcggcgccgacacttgcggcgcccagccaaagtgacacttgcggcgccgacttttgcggtgcccacccaaagtgacaacatttttatcaacaacaattcttttattttcatcgttgtaattctaatcccacgtttca

SEQ ID NO: 25045 - DNA, 1389 bp, Heterodera glycines
agggagagcacaaagggcccggggccgatcaagacgggactccggtcggattggcccgcaaaaaggaagcacagaaaattaccaccaaattttatctcaactttgggtaattaaaccgaaatgggtgagcaatgggggaggacaattagggggggtaaaaatcggccaaatgggccacaaagtgaaaaatgtgaacaatttggccctattagcccatcacaaaaaattgcattgaaattggtcaaaatgggggaaattgggagagcaaagagttggagcagtacaacaacggaaatgtgtgagggggcgcaataaatgcatggaaatggcttgggggcgccgtgatggtgattgattggggagcggggcgcttgtgggacaattgtgggggacgagaggaagagagagagagagagaattgaagcagcactttggtgtgctgcagatgattggtgtgttgatgaagcgctggtgttgagcacttatttatattggccaaaaagtggggagagaatgggcgagttgaagctgataaggcgggaggaacggaaaattgctggggggagtgacagccggtgataaggattggggaaggaatgtcactcaatcgaacattggccccaaatttgaaaattgttttaatttggtttttggggccaattcaattttgcacaatttgtgcacaattgcaaaatcaaattatttgattttcgcgaagggcaatcgcgacactcccgaggcggcaaggaaaggctcgtccgttcttccttccttcttttctcttccttcttggttcttttgggcccttcagtcgtccgccaatttcatcggtcgcaagcgtccgaagggcgtgtcttccgttgcgctgtgtgctcttgctctcgttcggaatgaggccgttgctgtcgtcgtgtccagtcgtattggtggagtcgattgctctggcaattgacgtcgtttccgccggattgttgtgcttggatttgaggcgttggttgtttctttggtcgaaatccaatcatggtcatgagtgtgatgcgaatggggttcaggaagtaagcgattaggcaggttaggatgacgtcacggcaaagtatggcagtttgtgccaatcgttggacgtttccattttttgagtcgattcgcacccacaagttgggtttttgttgcacttgcagatgatggtagcgaaattgagagcaacttgcgatttttgagatgagtgagaggatgcgcatctccgggtcgaggaatgcgtcttgtgttgtgtttggcagatggattgtgaccgggataaacttgtagcagtccttcgttgtccggtagctgatgttggatagggagattggaacgcagggaaacacttcgattgttgtttcgctgatccat

SEQ ID NO: 25046 - DNA, 1075 bp, Heterodera glycines
tggggcatttgcaggcggagtgcgctgagatgctcggagtagctgcgtgagctcggtctgaggcccagcctttcggggtctggtacccggatcgggggagtgctgtttactctgggtgaattgtgcaatggtttcgggtccgtgtgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttggg

SEQ ID NO: 25047 - DNA, 1692 bp, Heterodera glycines
aaaaaaagggggaaaaaaatggccaataaataagtttgtttttaaaataaattatttcaagaaaatttttttttatttccaggaaaaattttaaagatttttgttggatttttcaggcttggggctcggttaaaaattaggattcggccgggcttctgtacccggcaatccctgacccgtatttgcccaaatccccaggcccgttcccctaattaatatccgattttgagtttttttaaattaacaaataaggctacagaaaaaaattgaaaaactctcgcctctcgtcctctcgcctctcgccaactctcgtgttttgggggactctcgcctctcgccaaactctcgctctcgtctttttggggactctcgcctctcgccaaactctcgctctcgtcttttctgagacaagtcacacccctgatatgcacatatttttatacatattctggactttttcgcattttttttttctacatatttcgcaatttttgaggattttttaacgaaaattcccccccccccccccccccccgccgcctcgaagtttttttttttgagtcagcgattttttgggagattaaaaaaagttggtataaaaaacttattgtttgttataagaaaattcaaaaagaagatattaaataaattcttgcgattttttagacaaattttcaaaaaacaaaagtttcgagattcatcaaaaatttttaaaaaatcgcgggaaaaatcaatataaacattttctagaaagtcttataaaaagcaaaaaatccaactccatcccccctcctggtgaaggtgttcatccacccgttcatggacgggaatgggcgcacctcgcgtctgctgatgaattgggtgctgctccgtgccggcttcccgcccgtctccatccccgtggagcagcgccaccgctactaccacgtgctgcgcgaggccaacgacggcgacctgcgcccgttcatccgcttcattgccgagctcaccgaccgcacgttggaggtgggtgggtcatgagacatgaatgactttttaaatcgcccaaaaaatttttcaaaatttttttcataaaaaaaatcggggcggttgggatttgaaaattagggtttcataaaaaaaaggtcctccattttttcaaaaagtagctaataaaaaacaatgcttggtccaatgtctgctgatataccaatcgaaaaaagccctctgacatatgggaatttttgtttttttggaaattttgatttgaaaattttatgggaatttagcgcagcccggcaccgcctgggaaaaattttgaatttttaatgaatttgttgaaaaaaaatttgtgtaaaactattgtacccgctgttgtgttgcggctatgtcaatgaaatttgttgacattttagcccaaaaaggacaccagaaatatttttcagaaattttaatttctgttttttacacgaaaattttgttcatttttctaaattccttccatttttcacatttcggtaatttcaaaatgaccctccattttttacagtcgctgatcgccggctcagtgtcctcggtgtgcgaaattggtgacgactgttcagcatcatcatcatcgtcatcatcatcatccgccggtggtggcgacgcaattgatgccaccactaatgggccgaaggagggcgaggaagaagcattggatgccaatcgtag

SEQ ID NO: 25048 - DNA, 1348 bp, Heterodera glycines
caaaatcgatttttgcagaattcatgttgcaaccttttaaaagtcgttcaatcgcttagaaatagcttatcactgcttttaaatatgtagagcttccgaatgatgccaaatttataaaatttggccaactgtgaaaacagttatgatgttttaaacatgcctgggacggaactggcggtacagaaaccgaccttcactttgttgagaaatgcctgtgcaatgccaatgttcatttgccgttcccgacacccttaatgttcagtgggttaaaatctgtgtcagtctcaaaattctttctgatttatgaaaaaaaaaaatttcgaaaaattggagagggggactggctactaccgtctattaccaaagacttgcggtaaataggtagtatgtgaggtctcccattcgtccttaaatggcaagggtcctcgaaattaggccctctaactttgaaatttgaaactgcccttgaatttaatgtccttgaaaaagagaattcgagaaaaaacatttaacatattacagtatttgaaattttatacaatgttttaatcatatggcattgtttgtgcaaaatatgtttacaaattaccactgaaattttcaaaaaaatttacgggtggtcggcacagccggacccaatgttctcaaaaaattttttgaaaatagaacgtgcgatgaaatgaggaaaatgatcagcaaaaaaaaaatattgaaaaaattcattccagcgaaaactacaaaccatttgaataaaaatttcattgaatatgatttttgtgtcattgaatttaatgaaattttcccgttatgttcttgaaaatgaatatcccgtccttggaaagcattcttatcatacctgaacaaggggtgcgccagggcgaggcccatacgacgaacgattggcgcaggggggggtgcgcaaggaccaatttttcgtacgaaggcccccaatttttcccaacgacgacctttttttttttgctattcaaaaaacagtttttttcggcgtggtttttccaaaaaattttcgggaacaggggggccggcggtgccgctaggcgccgccagaaagtttttttgaattttgtattgatttcgctaaggaaatgtgcaaattttaggtttttccccctacgttacgaccccccccccctctcctttacagccgccccctttacgacgaacaaggggggggggggcaccaaatggaaaacagcaaaaaaaggatgagctacaacaatgatgaaggcatggcaaatggtggaaaaggcaattatcaacaatatgtaaaacttgaaaaaacagtgaatcagtgccgtgttaagacatttgcggtccggacatttgc

SEQ ID NO: 25049 - DNA, 2463 bp, Heterodera glycines
attatcggcaaaatttaatgaatatttatcattcgagaaattttcttcaataaattttgaaaaattttaaatttaaatgaatttgtttgattgaattttcaatttctaatttagattatttattatttttttttaattaatttattattttagaaggcagaactatctgaacattacaaattcaatttaactcgattaacggacattgacgtcattgcgaagaaagactacccatttagtgtttcttttaataggttaaacacatcaaattttaagaaagcaagtgtgccaagttgggccgtcaattttattcgggtaaatgccaaaaaaaaatcgcataaaaaataaaccaaatttttttacagttaaagggtgagcacatcaaattgctagaccggccatctgtactgaacgaagaaaagaaggtaattttggaaattttttggcaccaaaaattccgattgaataaattgaaatttttaattttaaaagattttttgggtcaatttttaaatttttttagcaaattttatgggggtatgctaaacaattgagcatgactatagttgttgttgttgtttttgtcgtatattcatcatttatcatcactcctttcataaagaaaaataataatttaaaccttaccgcatcattggatacggtgcttaactacggtgacgaagttttcctgtgataaaaatgcccaagggtcgttccgataaatttctacttaaaaaatgattttctattttattttcaaaaataaaaaagcacgggtttcaaattatttgccattttttgcccaaatttaggttcatattttgggatggatttttcgcctttgaaaatcacaccacttttttcgtatttatccttttttagcaaattttttggcaatttttgtcatgttgtttaaatttattttggcagttaagccaataaattgcgcttttttttgtcctttgaatttttggcgccttgccaattttgcattttctcataattaacatatatgcgcatccatccatccgttcattgtcaaaagaatttttcggtcaatttctaaatttttaagcaattttattgggaattctaaacatatcgttgactgtagttgttgttgttttttgtcgtatcttcatcatttatcgttgtcccatttcattcagaaaaaaaataacttgaaccttaccacatccttggatacggtacttaactacggtgacgaaatttggatggaaatgatcacttataatacaacgaaaagtttcaccattcgattgatgcacgaatcgatgagattcagcacggaaagtcagttcaattcagggctgatttctgaagccaaaaaatgccgaaatgtgcagtttcggcgcaaaaaagtgccgaaatcacagaagcggaatgtaccggaattcacaattttaaaataatttttcaatttttgtattatccaaaaacaattatttttgacagatttggtaacaaaaattggcatttttcaattttaagcattttttttgaataaatataataaactcagaattttgccggaatttttcacttaaaaaaatgccgaaatgcgcaattccggctctaaaacgcattttagacccatgatcaattgtggggcaattcgtatttatttaacaatatttttgatttattcaatttaattttacaaaaaatgttttctaaaacaattttttaaataaaactcgataaaaaaggcatagaaatttaataataatttaaaaaacaaaataattaatttatttttttaatttaaattctcattttcagttggtgacactttgttattgttggaatttgatctttcgaagccaaatattagttgcaaaaattatctgcacgaggtgggaaaataaaaaaaattttaatttaatttatttttgggattacagtattaaaggaatttgaatgcgaaaactttggacatacagtatcacaaataaaccaccattaaagcaaaacaaacaaaattaaatgcaaatatcatcggggcttattaatttgataaagtaaaaaggtacaaaactgtctgcttattaactgaatactgtaaccaaaccataccaaaaaagtggaaaaaaatcatgaatacagtaaccagatcgtatcaaatgacggcttattgataaatgaatagagagaaacaaaaccgtatcagaaatatagagctacaattaaatgccgaatactgtatcaccacgtattacagaaccacgacttttcaattggtcctgaaagcacgcacaagctgaacaaatatggccaacatttccatttgctgatcaatgcgacggccaaacattttgcgatcagaattgatcaagtcggctttcaactggattgcaaatatggaatttcgaaaaaattctcatatgataaatactacatatacccaccatgggcagtggataaaattcaagtaaaattgga

SEQ ID NO: 25050 - DNA, 2109 bp, Heterodera glycines
  misc_feature (2062)..(2062): n is a, c, g, or t
tttagaataaaatattaaatgaagaataaatatgcggttgacatgaagaaagaggaggaatggcggattcaattcaaagaaatgattggaatttgggaaaacgctgcttctaagaagaaatgatgagtgatgtgagggaggggggagaaaatacagcaaaaagtgacgaattgggatttcttggacaaatccctaaaaaatgactaatggaaataaaaggccattcccaaggagaatattttgtggaatcatttcactattcagagacaccagcagacggtggaaatcaaagacaaattttagaaaaaacagtcgaaaagttaaaactttaattttacaatgattatgaagagaatgaaaaattttgacctacctattcattgtgtttgaattaaattaataaaatgctttaaaattgtgccaattccgggccacactttcacgatggctagccaaaagaatggctgagaattgaaaatgcgtatcagagaagcaaagtgaatttgagaaaaactggagagagggggcggagagtgttttttttgtatttcgcatattttttcatcttttgccacataaatttattctgcgattgtgcacctatcgttaaaacaggggaatatttaaaaatgttatcgtcgccgagggaatggaaaagaaagaaaaaaaatggaaaaggcgacaaaaatgcggtgattcattcattggtcggccgcccgacccctttttgtaaatggcatcatcaccacgccacctgcggccggagaataattcattttccgtaaacaaaataaacactcattcttaacaacacaaacaaaaaaagagggattttgaaatttatacggaaaataaatgtgaaatgatcaacccattttgtcgggtttttacagttgaacgttcggacaaattggcttcaactgctaatgtcgcaccgtctgaccaatgttttgatcaaaggttttaaagcaaaagtcagttttcactgaattcgtcgtcctttttctgctgcgtttgttttcttttctttttgattgaaatttttgatcagtcaaacgccgtgtggcgatcgcaaatgggtggacagtgaaatgagtaatgagtgatcgatgcactcgaacccaaatcagtcacttcatcatcaaattatcaccgatcaccagcggacaaaccttcgcccaccccaaggcgtctccgacgccctaattttcccgaaattcacaattaaataaaactaattacatgaatgaatggatttgatatataaacacattcgcaaaacaatattacagagtgattggacccgattatttttcagaattattaatttttaaaaatatttaaaaacacttttaaattggaaggattgttttttttttaaattttgtagatgagttgcccgtggatgagttgccaccatctgataaaagctgaccaaaataaattgtacttttttgaattttttttaattgatcagaccaaaaattaattaaaaaagattttattttcaatttaggagtttacctcttattgaaaatgaacaagagcacttccatttacatactgtaacggcgatgaactcacaataatactatggtagtcagtcataagttacttatatattacgatttatttataaaaaattttattttattttatattataatatttttatttttatattttaaataaatctatttcattatttcacgtgtaattgtatgaaacacctttcaataatggacttacataatacaattgtaacgtatttttaacattcacttccatcccaacctctaaatgactaaaattttattcggactaattctatttttcttagccttgactcgtctatttggtatgtatattatttttataaatatttgcaaaaattaccggtaaaaattcttgtaagttttaaataaatttgtattttttattcgaaataccattgtcccttaccgaaggaaaaagcactatatctaggcgtccaagtccatttagttcaaacagaggccaagatatcccatgaatttcattcagaaactccatgggcacttgnggcggtccggtaccactgggcaccaccgactggacgctgactaactg

SEQ ID NO: 25051 - DNA, 1156 bp, Heterodera glycines
cagagacggtcggggggtcattttgtcaaaagaggactagaaatttgcaaatacaataatttttgaataaaaaatgatgaatggcttcttgtccgatgaaaacgggaaaatgaaatattatgatgattattggcacaaagtgtgtaatataattttgaaatatatataaatttgtgtataaatttaaatgtgcaagcaaaaattaatgaattaacgaacgtctttcacactttttttgttgaaaaaatgtatgcatatgtaaatgtatatagaatatatgaaacaatcctctttctttgttgggggagtgatacataattttttttgtgtaaaaagagagaactaaaaaaggcattgtgagattttcaataaaaccaatcaattcggcaattggaaggagagggaagagaggaacaacaaacgaacggaacagagaacacaacaacaacaaacaaaacacatcataatacaccgcgtattttgtacataatttgtatgtttggaggtgggaagagatttcaaaaagtaaaataaaaaatggatgaaattttgtggagacatatagggagagagatgatgatgatgatgagaggatgaatgattgattgattgacgatggcagacacatacacacacaaaaagataaagaaagtaaaaaacaaaaattcaaaatctaagaaaatcgaaaattttgacaaaatgagcgccggggggcaaaatggcggcgttctaaacgattcaaatccgtcgaagaaccgcggatgccatgccaccggcgcctgtgccgagcacatcctcggcaccgccgctggtgctgttgctgctcacgccgctgtccacgctgctgggcattgcgtaggagcggaattggccctccgcggtggcgaggccgagcagcacgcgctgcttgtggaaacgcattgcggccggcggtggtggaccggtagtgccagtctgttgttgtcgccgttgtggtgacgtgaagtggggacttcaaaaaggcaggggaagggagagtgagtaaattagcggatatattatgcgggtgcacttcatttcccccccccgttaaaattaaaaaaaaaatttttcaaacctagaaaattttcataaaaaaattcataggaaatttcttagtaagaaaatttcaagaaaa

SEQ ID NO: 25052 - DNA, 966 bp, Heterodera glycines
  misc_feature (12)..(12): n is a, c, g, or t
tatcggaaggcnggagaacaggatgaccctttggccttatttgtaagatttgtccttattttgagggtccaaatcttacaaattttaaatgtccttatttgtaagatttgtccttatttaagctctttgtccttattttcgtcttattttttggatttagggagaaatttagtttttaatgataatttttgaaagaaatgttttttaaagcgaattaatatgcaaaatcttaacaagattcagttaatattcaaatttttctctcggcggtttcttattctctttaaaaaattggctcaaaatcgtaattttgtcattttttgaacaaaatcgttaagaattcgtattaaaaattacaaaaatttttccggcagcgtctattagagctgttgtatctgttattatttctaagaaatgttctgatttggggtagtgccttattttcatttaaagaggaaatttctgaaaaatttggctaattcctaacaaaattcattaaaattcttaaaatttcccccagcggcgcctatcggcaccgccggccccccaaaagtcctatttttttcttaaaattagcccaagatcgcaaattttgtcatttttggacagaacttgttaaaaatcctttcgcttttggtaaggctaatagagcatgttaagagctttcgaatgataccaagattgttggatttggatgccaaagaaaaaagcttaagtggaaaaacgagctggcgccgaaacgccagcgcccaaacggccgcgcccaaacgtgtgggtcccctttaaatgagagaaaatgggatcgacaaaagagataaaaagagaaaagttatttgatttgagtcatttatgcattttctaattgcctttgattgttcagggcaaatcggtgacccaaaaagacaggcacaaactgctgcaggcgaaagaaagagttcggaaaacggcagaaatgagataaaaatg

SEQ ID NO: 25053 - DNA, 1406 bp, Heterodera glycines
tttgaggatttttgaggcttttgggggaaaatcgtcagaatcttttaaattttgataaattttaacataatgtttgacatttatttaatttgaattttggtttttacataatagaatatcaaacggaaatctcacccaaatttagccagaaaattacaattttttcgaaaatccacaaaattatgaattttttaaaatgaaaatctgctaaaaatatggtcaaaattctcaatttttccaacaccggcggtgccggacgctaaaaatcctttttttttaatttgctcaaaattgcaaaatttggccatttttgtggacaaatctgttaacaaatcacattaaaaattacaaaaatgtttccggcggcgcctatcggcaccgccggccccccaattccccaagttttttggaaaaagcgccgcaaaaaatcaacttcgatttttcatgctcagtctcacaaaatgcttatttctaacaaaaaaattgctcaaatagatcatggaaaatcaaaaatatcacatttgaacattttaaacgtgttttgaataaatttgtaaaaatgaggctttttgacccaaaatgaggcgtttttacctgccaaatgagtcttttgaaaattttgatctggaagccctgataaaaagccaactcgtactgacccgactcgtactgctttttgacaaatctttgtcaagtggatcataaagattcttggtacatatcattggataacccttaagctcctctacatatttccttaaaaattcaaaaaattaccaattaattatttttgatgtccttctatagatattaaagttctctcttagccttcaaaatttaattttttttttttgtcaatttacaaaaaaattatggccaaaaaacctaaaattgactttttcatggctttttcagcgccgtttgccataactttttttacgcttgcatgatttatttctatttaacatgaaaatattgagcacacttgggatgtgatttttatcaagaattggtgtcccgacgaaaaaaaatgttaaaaatttgtcgggtattttttctaggcttaaaaaatgcgctgatcacgaatctgagctcaggttttgaaaatttttgatttttatctaggatttttcatcaactacttgattttttttaaaaattttaagaaaattagtcggacataaaactgatacacatatgttgtagagcctaaaaagagctttcgaatgagctataaatgtatgaagaagacaagtttccaatttttttacgattttttgaaatttaattattaatccctaggggtcggatgagacgggggtctggggttcaagtccgcttggatgcggattattttttttatgacacttgatgaaaatcatatacaaaatgaaagatcatgcata

SEQ ID NO: 25054 - DNA, 1077 bp, Heterodera glycines
ccgtactgaaatgaccccatccctctgaaagtctctcactgatatttttgtcacttcgtcctagcacctgtccattcacttttcccttcccaaggcattcatgtccaatcacttgtccaaatggcgtgcgattcgcggcttttggacgccgattcgcggcagagggcgatgcaaacaatcgccacaaatgtcgaagaagcattgcacgtcaaacaccaggcaaaatgctattagatgttagggttgctgagcatgattatgtcattttggactgttatgattttgtcttttttaaattttcccaacaaaaatgtcccccttttgcttccgactttgccctctttcagttgggcggcaatcgcttcagaatgctgaacatgatcatctgcacgaggagcagcggtgcggccgtcacattcctttacatttccgtcaaaatgctttataccgtaatgcggcatttattaattgctcgcccgttaattataaaaagggaattaggcaattaattaattgcttccttaattaggtgaacattgttggccaaatctttctgctgaacacttttctgggcaacagaagtcgttggtacgggctgcaggtgctgaacgatctgatgaatgggcacgagtgggaggagagcggacacttccctcgggtcactctgtgcgatttcgaagtcaaagtgttgggcaatgttcacagacacacggtgcaatgtgtgctgatgataaacatgtcagttattgtaaattggacattttccttattattattttaatggaatgctcttatttattcgttttttgtaaaaaaaaatatatcaaaaataccaatttttagaataaaaatacataaaattgactatttttgcaaatcttagtcaaatcactcaaaatagtttgggcaataaaaaatgtgattcacttcaaaagtataaatttttagctttatataataattttttaaccttcatatttttggtcccaaaatcttattttgatcattgatctctgatttaaatgtttggtttaaatagagaatttgcacagaaaattagcagcaataaacggcaaa

SEQ ID NO: 25055 - DNA, 1068 bp, Heterodera glycines
ccgaaaacaaaaaaatcgattttttcaagtgtccgtttggggtactcaaacaattatgggggagcaaaaatccaaagcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttatgaattaattttgcaaataaataaaaacgaaagactcagattttcgaaaaattttgtttgagccagctagctcggcgctcatttcagtgtaagttaatcctttaccggggagtatccctgataagtttggcacgcttctgctcaattagcaataaatatgagtgatcgaattttcactaaaaaagattaagcctacattttttgggatatttaaaaagcaattaaaaaattttaaaatttaataattttcctgcaccgaaggtactcactcggcctcttcgcggcctcgtggtgggccttcaacaatctttcttcagaaaatttggaaaaacaattatttttacatcacaatttattgctttatgggtttgactatgaatgaaatctgcttctgaaaagtttcggatttttcgaatcatatcgtacgaaaatgtctattttttcgtt

SEQ ID NO: 25056 - DNA, 1649 bp, Heterodera glycines
ttgtccttttccaatgtttggctttgcatttgcttatcttacatttcgaaattcgtccaaaaacaggccaattcttccataatcttttcaaattcgaaaaagcgtctaatttcacgttggaattcctttgtcaattgattgtgcactcgcaatgaccaattgcgtaattcttaatcccgattatactgtaattgcctgaattggctaccgtaatgatgcgccgattcatttggagaaggcgttggaattgcattctgtagcgaactgagtaaatgttcgcgcatttcatttggtttttctttcgtggcgaattccttataatgcgtgcgatacggtatcaatattccggtatttaatttcccactgtaattaccatccattcgtccaatgtttgccgcgtttgctgttccccgttcaattgggtcttccaaattcgaattttcgattttaaaatacccagcttttccaaaactcggaagcggcactgctcaaaaagcatttgtgccatggcattcctctgtttttctgaaagtgcgtcaaaacgacgcctcaaatcgccaagcaaatgcatcggttggagaagcgaatcgaaaggagaaacggagccgatttgatgttccaattcatagagaagggcacgctgatcagaaaaaatacggaagaattgctagaaccaatcaataaaattaattggctaattaatccaagtcagagaatcaattaaatgtaattgaaagagaagcgcacttccaatcgaccaatggccgcttccaatcgccgcaaagtttcgtccactttgccggcattcaacagctgatcaatgccattgtattcactcgatgaaagcaatcgttcaccggaggaaatccaatcagaaagaggggctaattgggccgagtgactgtccggaaaataagtgcacaaatggcacttccaatcaccgatggcacactgtccaagaaggaaaaattaagttcagaattgtaatttaactaattattcggttgattaatgtcccgtccgtgatattacattaatagttaatcaattttcatggcaattttctcacttccaattgttccatttcgtcctcaatttcccgtgccgttttctccctctccgcctcctccgttgcactttttctaattgccaccagcaaatggtcgacaatcgccgcccgccgttcccaaaattcttcgcgcatttgcgtgaaccactgaaaaatttggcaaatgttgtgccttccaatgcccgtacaataaaatgccgaattgtgattcgttgccgtgccaccaatttgagccgttcgtccgtggcgactgaatgcaaccaatggagccattctttgaacacaaaaaactgaaaaaggaattcaaattgaattgcccaatttaaacaaatgtttcactttttcttcttccatttccttcttttgttggcattgtccggcgacaacagaaacatcggcagagacagaagaagaaattggaaccaaagaatgaatgaatcatttggtgggaacgaaggcaaacgaattgagagacgtaagcgatcagagaacgtttgtcccgcacatattcagagacagtcacatctcgcgcctccaacaatgggcttaaattaaacaaacgactaatactgtcataaat

SEQ ID NO: 25057 - DNA, 1723 bp, Heterodera glycines
ccggcagcagaagacatacatacgacagcagtgtgccacactatgccccccccccccccgaataaatggcacaagccctgaggggatggatgcggaggatgtcttaaacacacacacacacacactcatcagtcgataatgagtgagtggcctatgcctacgcttagaatgggcccgccattgggcaccctttcccctctctctctgctgcccaaatctctcccctacggcgcacgcacagttcgttgttcgtttgcgttcgccattccggcccagcggtccccattttgaagggccaccagtgaaagtgagaaaaaaaaatcccagcggcagagactcagaggaaagcgtttccatcactttttctgtgtctgcttctctcttccgtctaaattgggatgcgtcggagaaggattagcaactccaacagcagcagcagcagacacagcggacaaagacaaatcaattctttttgtttgtcgactgaaaatttggtttcgtgccaaaaagaatgggaaaatttttgcgtggctcactcactcatttaatttgtgcatatttaaatgttttaaaaaaatatttcaatgccaatgcctttggcatttaacgtaaaaacaaaatatttaattcatttgacaatttaatcataaaatctgtgacgagtttatgaagcagattgagcaactcacgtaatttacaacaaaatgagatacaaactataataaagcgactaaaattcactgagtttgactaaaaaaccggggacatataaaagaataaagcacacaatctgggatcttggtaattgcacattaaatacaattgcgaaatattcgtccatgtccatgctcaacaacgcctacgaagcaacatgggccatcggtgcaaaaacgaaattgaacataaatttgaaggcgtagtggaaacgggcccacactttgcgccgactgttcttcacgctggtcaaacggaggtgtttattggagccattcatctgaaaaaggatggattcatattcagttcagacaaattgccggcatttttacagggttttcggggtaattttgactaatgtctaacccaaattcgaaaaggaaattgaaaattttttgagttgcgacttttttcatgtttgggctagggattaaaaataggtagttaaattaatgtcatacatcgtgatcagggacctcaaaaaatctctgtaaacaagtccaagactatggacaaaaaatttttttgcaaataaagagggtctctctcccctttggttttcagtattttcggggcaccccaactgtaagcattggggccaaagtatcaaatgtctacaaaaatgggacgacctttttgcagaaaatgcattccaattggagcagtcgaagccggggcgggtaccgaaaaattgggtaggcgtcgaaaaaggccacaaaacggataatgtcgccctcgccgagcagagacaaagtgtcaccaaaagagtgcgcggcagccaacaaaagttgtcccttattcacgctgatttggaacttctctccgtaagggccactgacctaaagcgaaaaatggactataaaaagaattatatgggcatatccccagtgagccaggcccgtaaatagaaaaattttcagaaacaaacacgaggagggatgaaccccaaaatctcgacgagataaaatgtcgccgcccagaatttttttttatttgtctccccccccga

SEQ ID NO: 25058 - DNA, 1182 bp, Heterodera glycines
agagtcggaacagcttgagaaacattgaaaaattctgaatgtgagggggaggtgaatacaaatcgtaaaccaactgaggggaggcgaaaagttggaaaacaattagcacagcagcagaaacggcagatggtgccgatggaaatgccaaacgaaccgatgaataaacacagcgggaaaatgaatggacagagaaagtgaaggtgagggtggcacaaaaagagacagacaaaagcgagggtggaaggtcaaaagtgagaaatgccgaacacgaaaagggacaaaaccattgtgtgagggaaaaggcattttggcatgggaaaaatttgagtgggaggggggggggacaattggaaacagacggaattggagcgacagaaaatgattcataaaaatgattcataattagggaaaggaattttaatgatcagaaacaacaataatgatgaaagaagcaaaatgaatggtttagtcattcatttaccataatcatagaagcaaaaaaaaggattaaaaattaataatttatggacaagggcacaaattgggtgccatcggcggggaatgaaacacaaaaaatggcgaattttaccgaaagttggccctatttgggacacatttgttggtgagggtggcggagagctctagctgtgccaatgtcaatatgaagctcggacttttcaagcgaaaaagtgtgccgacccgcccacgctcaactgactgagtcggtggttcgttcatttgtttttcagaaaggcgccccgggggagggggccgtggtgccataaaatggttcggcgatgcgcgtaatttggcctcacatcatccaaaaaaaagttgtgggcgtacaaacagtgagtgagtgggtgagtgagcaaacggtgctaatggagcgaaaaatggccattaaaaaggaaacgcaatgagaaaaaatcatttattaaggaagagatttaatggaaaattgaaataattaaaaaatggatgaaaatgaatttgggatcaaagaccaaatggccaactttaacagaaaattcacatttgaaaaaacacattaattttgcaggcttttggccgcttttaactttaactaatgactaatgattactaatgataaatgtttatgggccattaggggtgggggtagggaaagtcagtcacacgacagggcggaggacattttat

SEQ ID NO: 25059 - DNA, 1481 bp, Heterodera glycines
  misc_feature (7)..(7): n is a, c, g, or t
  misc_feature (31)..(31): n is a, c, g, or t
  misc_feature (1445)..(1445): n is a, c, g, or t
  misc_feature (1474)..(1474): n is a, c, g, or t
cgaaatnttgatttccaatattgaaatatantgaccactatgtctctaatatttggagaatattctagatttcagatacgaaatttgtagaattgttaaaattctaaaaattgaatcttaacctttttggtccatgatccgaatgatcaaatatttgaggaattccccaaattggatcgggtccgtgcagtatttttagattgcgtaaatttaaaaataaaaatttgtttaaaaaatccaaaatttttcctttttaagggatgtgtgatagtgaaaatgattgtggtgacaattcggacgaaattgatgaggagtgcggtggaacatcacgaccatgttccgagtccgagtttcgctgcaacgacgggcgctgtattccgcactccaaggtgggaagaattttaatcaaatttaaattccatttttaaattaatattttaaaaatagtaaattcccatttcaatgatttcgtatcataaataaatctgtttataatattttaaatgtctttgaataaacaaaaaatcgtcataaattatttaagtttaaattatgccggtacaaaatttttatttaaatttaaaatatcagttaatattttgaaaaaattaacaattgcgagttaaaattcttaaaataatgaaaaattgaaactttattattcaatcaaggaaaaaatatttaaaaaaaaataaattaaaaaatccaaattgtatttttttttaattattattttaattaggtctgcgatgggaccatccaatgctctgacggacttgacgaatcggagtgcaccacgcgcaaatgtgtggacgggtaagtaaaaaaaaaaatatatttttaatttaattttcatttaaatattttatatttttcctatttaaatattaaagcatgcgccaatgtgaggacggcacatgcattccggaccacaaatggtgcgatcgtcgccgcgactgtgccaatgcgtcggacgagcgcaactgctccaaccatccgaaccgtcgccagtgctcccagtacgaatttgagtgcaccaacagtgtgtgcattccgcgcaagttcatgtgggttttaattataatttatttgcttgtttaaaaggattttttattattattattatttattttaatttaattttattttatcgagcaaaccaaaggcacattagtgctcttatatggtgccaaaaacaaacaaataaaaatgatcaaataaaaaataaaaatgaataccgtaataaaaatgaataaaaataaatcaaatgttaaaaattcacaggtgattaaaatatagtgtatatgtggcacagaaaatttcctactcagaactcattgcttttagtaattcaagaaaacataattaaaaggcaaaaaacaacatgaaatttttagagttttcttcgaaaagaaaaattttagcaagacaaaattcatcagaanaatatacaaaaaaattaatttataattanaaaattt

SEQ ID NO: 25060 - DNA, 1903 bp, Heterodera glycines
aattcaaaacaaaaatttaaattatgataagcccagctaatttgtcaagcaaaaaaacagttatatcgccatacaaaaccgaatttggctgtgtcaaagtatttattacgaaccaacataaatgacaaaacctgttgctgatgcggctgctcgactgttggtcccatcgccggtggcggatggaatggtccgatgttgggcggacaaccgaaaagcgccgcggccatggcattgtgatggtgcgccggcggtgccgtctgcggaggcggtgtctgctgccgctgcatgtgcactccgctgctggtggtgggcgcggacaacgacggcgttgggtaggcaaagtgcggctgctgatagtgggggtggtgatgcatcggatgctgctgttgctgatgtcgcacaggcatttggccaatcagttcattcggctgttttcaaattttttttgtttttttcttcaaaacatttattttgaattcgggagaatgaaaaaaagaaaacctgctgatgcggctgctcgactgttggtcccatcgccggtggcggatggaatggtccgatgttgggattgtagccgaacagtgcggtgggcatgacgtgttggtggtgcgtcggcggtgccgtctgcggcggcggtgtctgttgctgctgcatgtgcgctcctccggtgctgacagtgggcgccgagagcggtggcggcggataagcgaacgacggttgctgatagtgaggatgatgatgcatcggatgttgctgatgctgtccgggcattgggccgatcagttcattgggctgtgaaagtgtaaatgttgagtaggtaaataggtttaatatgaaattgccatataaaaatatttccggatttttatggcagtttttgccttgcaaaatccgactgaaatgcaacctaagtgcagtttaaggaagtgaacgaaaataaacctgctgatgcggcggttcgcccaccggccccatcgccgccgccgcctgctgaaaggtgccgaaattggtagcgtaaatgaacagtccggtgggcgtagcggacgccgccatggcgtgaagttgtgccgcctgtggtggcggagtcggctgctgctgcatatgtgctccggtgcctgcgttgggcgcagacagcggcggaggcggataggcaaattgcggttgctgataatgggggtgatgatgcatcggatgctgctgcattttcaaaattttcaaatctttaatcacaaagcagtcagtaagataataatgacttttgcataataaaaaatatcttcactctccatttagtaacaacgaattaatcactcggatgtgcaagatgcgcttgtggtggaaaataagttggcaaaaagaccaaaataggaatgtttaattctgattctacagaattctgtgaatatgtttttggactgcaattagaaactaggatactatttacaagaaattctaagccaagtagtttgtttgacaaattaaattcaaattccataaaattttaaagctgaaaattgcatttccgtttatacgcgaaagcttgtgcttaaggaaatgttggtcaataaacaattgtaagttgtcggcttcggcactttgatttgggatcgagccagttccctaccgccaattccctaccagccaattcctaccggccgattccctatcgccaaattccctactaaggcatttgggccatttccataccaaagtatgaatattaataaacagtatgtttaaaacatacaggaaaatttattcactgctttttagacctagcacgtcaagaagagcttttggatgataccaaatttttcatgattcgatcgtttaaaaaaaggttagagtgccaaatctctcaatttttcgagttttgaaccgtcgtcctaaaaataggttctaa

SEQ ID NO: 25061 - DNA, 1056 bp, Heterodera glycines
ctttctcctcccttttccaattgcttttgcatttgccgaatctctccgcccccttttttgacttatggcctcgtcctttttgggtaaaagtccgaattcattcacaaacatcgctcatcatcatcagcttcttcagtcatcgcatcatcaaaatggcggcaccgaaattggttggactttggaaaattaaacaacacattttgttaattaattgttaattgtcattcccaaatttttggcaattaattaatgtcaattaaagagctactaaattttgaatatgcaaaaaaaaaaaaacacttcattttcggcttggcttttttggtctagaattttcctcttccaattttttcctaaatttttatattttctcccaacagaaaaacggtccccctcctcctcctccacggcacttaactccggcgatttgctgtcagacaacaacgaagcggcaatggcactttcctcactgatcgaattgggtaaaaatcggcaacaaactcagcgagacgaggctgaaaatggcattgacaatgagtaggcaaagattggcttacaattagcgtttaattgtcatttatcttttcttaattaattgcagcgattgccgtttcgatgggtccgtcgccgtttcgtcgccttcggtcatttcgtcgacttttgcggcaacaccagcgaactgttctgccgaaacattccaatcgcacgccaacggcacacacaatgtgacgacaatcaaaacggaggacaacgaatcgggcgacgaattgccaccgcaaggcaatgcgaaaaaacaaacgaacgaaggcattttaaatgccaagcaaaaaattcgaatacctttattttaaattatgaccattttaatttttaaattgcgctttgttcagatgattccgcgtcggatgcgcccgttcacgaaattcgctgtggtctgttgaacgcgcggctgcacatgcaacgctttacctgcccgggcattcatcggaagtgcgttgagttcgaaggtcgaccaaagataaaatttatgtattttttggaggggaaatgagcaat

SEQ ID NO: 25062 - DNA, 2091 bp, Heterodera glycines
catcaaaattgcaagattttaaattgtctttgtttccggactgagatttgcttggcaagagagtcacaaaaaaaatttgttaaaaaattaatttaaaacaccgaacaaagtcacacgaaagataagaattaatttagttgtaaaatatttttttttaatataattaatttaaatttaatgtttaaaaagcataaaatttgcgaagctgacaacagaatcagctgccttcgttcacaacaccttgctgcagggtctctgattttattaattaaaatgacgtatttaagaaaaaaaaacaataatggcccatctcaccgtttaatcactataaattttttttcttttcttctgcgctatttcaaatgttttatttttcacgcaaagtcttcttgaaaagctgtgactaatatttttgaaagattaataaatgcctttaaaaaatttttatgtaaaatagattttttcctggattataaaaaatagaaaactgaattccatactatccctgctgatacatacactaatacagtaacattaattaaaataaatatttgatttttaatgaataaatgcgaaaatgaagaaaaaaaagcacaaattgtttgatcattttatgaattttattcaaattttttataattaactgaatgattgcgtgcctcattttgttaattaaattgtcacacttacgcctaataggcaggcaatttcaggcattccatgtgtgccccatatgtcgagaatgttcaagatcactcccgaatagcgtgtccaccaatccttgctgccaggattccaatttccatttggcaaatttagctttgcaaataattgttgtgttacagcggaaggattctcaaacaatttggcactgcggtacaattcgccaatttgtgtgattttgtttatcaaatttggctaaataaatattaaataactttttaaattattttttacccataaatccccttgattgattgtcattgaatttgtttcaaaagtcgggtccttaaatgtcgggtccccaagttgcaaatcctcaaaaatcgagtagccattgtaatccgctaccaagtttgagcttaaaattttttcgtaaaaagctgcaaaaataaaatatatgtatatgttacgtaaaaagcggcaaaaataaaatatatgtctatgttattgatcactttaataaaaatttggctaatattgccctttttattatatacaaaaataaaaattcttatattatacaaaaagaattcaataaaacaatataataatgtcatttgaatgaggtcactttaatatattcctaagcgcagcattttattcaaataatttttatatatgtaaatttcttttatttaattttaattaaccatcaaattttcccttactatttttcaaatttatttataaaaacaacatgacccatggcttcagatacgaaggggaattaaaatgattaaaatatgaattaattggacgacattttttggaatttttttaacatgtttaacaaaccagctctgaaaaatttgaagtagattatattttcccattttaggttattatcataaatttctaattttaaaaatcaattttttcagaaaccctaagaaatgtgcaaatttgcctcgtttttagttattttttttgctgtttttctgctttttgcaaaaggtgacgcaatgaaattaaaatccaccaaagattggataaagaaaaaattctcttcaacttcttcaccattttcatcacaatcagtatcatcttcatcctttcataatccattaatagaatcatcattttcctttaatcctccagaagaaaaaggtaaacaattcataaatttaaaatggagaaaaaacttgatacatttattaaaaacaacaataattaatattctaagcaatcactgcagcgcactttttccaaaaacttttgggaacagggacagacatcatctgcgactcccgataataatgagcaaaaaagataaaactgaaaaacgcaaaaaattctcggtctgtcggcttcggtttaaaaaccgaaaaaaccgaaaaactcaaacatctctcggtcgcttttttttgg

SEQ ID NO: 25063 - DNA, 2181 bp, Heterodera glycines
atttcattattgcactaaaattaatgctttttcattatggcatgacaaatttataagaaaaacattatcacagtatttctttctttccttgagcgctggcattcaatcgaaaactttttcacatattattaattagaaaattttatactctttccttgattatttttagaatccgaaaattttgaaaaaatcagcatatttgggaatactgatttatattcataccaaataaatgaaaacctgcaaatacacaatacgctcctctataattcagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgtgtgttttgattgaatggtaacaacaagctgacaagtcaattttaggatggttctcccccggtgaaaacctttgaacacgttcccagtgaaatcggagcagaagaagcggaagaggtcggagtggagcacttgctcaggcatgttcatattgcatatttgtgctttggtagtaattttaatgaccaaacgcaattttcagagacatcaaaaatcaaacagccggcaccctctcgcaacgaattgctaaatcagttgacggaattcgtggtctcgagaaccatttggctggttttacgagctatttgcatcgtgttgcgagtcgagaattgcccatcaaccacgctatcatatttctaatacaagtcgctgggaaattttgaaattgttcttttaaagccctacgttgtttttatattcctctgcttctcaaacacccatttcgttcttatgaatccctttcgcaggaaatgctcaatttgttgccggaggtcctctcaccggactttgtcgacgcgcacaatgtgcagacgaacgaccatttgatgtgcgtttacatcggttcgatggtgcggacgataatcgcattgcacaatctgatcgacaataaggtgaaggaagggggatgaagccgtggaagagaaacagaaaagcatatacatttactatagtcaacccccccccccccccaaaaacggaaaaattttccaaaaaatttcgctacgcccgaagggaggggtacccacccgcaaccccaaatcctgggaccgtccctggttcctcgagacgtatcgatttgtatataattgtagaacttaacctggacctggatccaggcctggtttttttttctggattcggcaaactggatttttgtccaggtcaaatacgaaaatccaggtcctggcaaaacacgaaggaaactggaattactggacagcattttagaatttattctttcaagtgaccgatgtttttttcaagttttcaaaaaatgattaattgatttaaaaaccgattattattgaaaatagatatttttagatgtttccaagtaattaattgattttttcaaaaaatttgttggctttttaaaagaaatttcaaaaaatccaggcctaggtccaggtctcgaggagcctggattttcctggatgtttgtccagaaaatctaggcccagctccaacatagagtccaggtcctggcttttttcaaaatcgagttcatataatttgtgccattttttctggggggctgactatagttcagccataaacgagaaagtttgtttaatggacagattaagagatatttttgctctcacaattaaacagttaacgctgcaaaaagtggcagaaaaaagtgcgaaggaaaagacggtcaaagagacggaaaagaatgaagcaaatgacaaagagattgtcaaaaacaccaaataattgtatgaccattttgctggaaaatattttaaatcattgacggacatttgttgtagcctgctgttttcattttcaatatataacgtaaagacacaaactgctggggagtgttatttttattaattagataattaaattgcgaaaattattttcatggttttattgtgtcttctggtttaattcatattaataaacctaattgtaagatctaagtgcattccggtgtcttttccatttatcttctttctgccggcaacgaaattttttcccagccccattcggtggaacgataaacggacgacacaatccaattggacccgggcgtgtgcgtca

SEQ ID NO: 25064 - DNA, 1264 bp, Heterodera glycines
  misc_feature (1156)..(1156): n is a, c, g, or t
  misc_feature (1184)..(1184): n is a, c, g, or t
  misc_feature (1189)..(1189): n is a, c, g, or t
  misc_feature (1209)..(1209): n is a, c, g, or t
  misc_feature (1237)..(1237): n is a, c, g, or t
  misc_feature (1259)..(1259): n is a, c, g, or t
cggcttttagtaaagaataaaacaaataaatattgtctattttatagtgtaatattgagccaattgtatcaattgattaatagtgacggatcggatagaattacatataaacaattcacattaatatatcaaaatgaaaaaagacaacaaaaaatggttgatgaattaacatctagtacaaagattgacagaaacaaaaactcttatggaattgaggatttaatcgtaattcaaaattattttgatactaaattcccgaatagattcttaattgtggctttttctaggtaaaataaataatttattttaatgaattttttaggaacatgggttaaaaccaatttttaaaggacaaggccatagagaacatttgatatgcgtctttaacgaaaacggacattgggatggtaaaaaaaattatttttaaaagaatcaaaaattttaggtttaaaaagcatcaaacaattttttaatgttaaatataagtattgtgtttattgtgaacaaactttccaaagcacaactaaacattcaattaaatgtatcataaaatgcagccgatgtggatcgtggggtaaaatattcaaattaaattcatctattttgaaaatttaggaaatgattttccgtgtaaaaatagtctaattaaaccagaagaatgtaataaatgcaaccgtctgttttataataaaaaatgttttcaattacacttggcccgtgcatgcaaattatataataggtgtattaaatgtgacaaagaatatcagaccgatcacacccatgtttgcggtaaagttgcccgaaatttatgtactttaatgttatttaggtgaaaaaatatgcaaagtatgcaaaactaaacatacgaagacggaaagttgttatatcagaaagattaaagtaccaaataaattgccgaaatatagaattatatgctatgatgtagaatgcagcgtaagtaattgacgataaattttaaaaattttatatttagacagataataggattaaagaaggaaaatattttggattttatgagcataaaattaattttatttctgcaagatacacgtgcagcatgtgtgaaggagtaaacattaattgccaaatatgcgggccaaaagggaaccgacataaaaaatggtgtacaaatganacccaaaaacctatgattgaatttttanaatgngtattgtcatttcaacattnaacacccctatgtatgcgcattatgcangtaaaagcaaaaaaactatgcngttta

SEQ ID NO: 25065 - DNA, 1231 bp, Heterodera glycines
ttattcaaaaaaccatcaaacgaaatattttttgatataactttgctcaaaagtaactaaattgtcaaattttgatatcattcgatagcactaagtgttttctattagcctacaaaatttcaaaaagtttcgataagtttcaacaaagttatgaccaaaaatgttcaaaaaaaaacttgggttttttttttgtttctcaggtcatagcttttttaaaagttaatgaattttttttgaaattttgcaaaatattgaaaatacttagggctaacgattgatatcaagtgtttaaaatttggttcattttgtcgtaagttataaataattttctgtcaaaaattttccatttgatggtttttgactaacgtcccacaccgttcaaacctacatttttttcaatcccagatagcttaaacagcattgaaattatgaaaacacaatcttttgtaaattagtgtcattaattctgtagtttgaataattgacgatttttcaaaaacttacaaatgatcaaattatcggacgcattcactttctatcatttatttaatgctaattaggctattaggggttgaaaaaagtcagacttgaaccccattttagacataggcgcaaatgtccgaggcgcaaatgtctgggcacgcctcgaacccaacaaattgtatttagtttttttaaaatttaaatgtaatgtcatcatatggttcgccaatgagcatatcgacacgcaaagtcatcatgtcctcctcccggttgtaccaatccttttgcttgctcatcagtaactaaattatttcattttcattatagtctcacataaagcctggagcgggacgggaaatcccacgagtggttttcgcgggatcccagtcgtaatttcggggatttaaggatccccgtcgtaatccctggattttgcgggatcccagttgcaatcccggtcttttgtgggatcccagtcgtaatttcggggatttaaggatccccgtcgtaatccctggattttgcgggatcccagttgcaatcccggtcttttgtgggatcccagtcgtaatttcggggatttaaggatccccgtcgtaatccctggatttttcgggatcccagttgcaatcccggtcttttgtgggatcccagtcgtaatcccgaatttttgtagaaaatgcatcagttgatacaaatataaaataaagttctgtaacattaagtattgtaatataaaagtaaatat

SEQ ID NO: 25066 - DNA, 1650 bp, Heterodera glycines
  misc_feature (1397)..(1398): n is a, c, g, or t
agttcctaattgcaatttgccttattctctaattccttgtcagtaaagtggtgttgaaaattaagtaaatctttccttgaccccaaaatctcaacccgaaccccagcaaatcccaaagtccctccccgaatatacgccctttctccaacgcactaagaaaataggacacgaaacttatatttttaaaaataatgatatttgatttttatttcttcgtccggaaaatgagaattcggaccaacaaaatataaaatgtgtgggtaagtgcatgtttttgtaagatagtaaagggaaaactggtgcttaggttcaagtccgcagcacgacacaaatatttttatttgcttatttttgaagcaattgaacaattcttgatgtcattcgaagacgcttaatgaggagaaactttttcaaaacaaaagttaggaacttgaagcaccaaaaaaaaattatgagtcttttagaaagggtttctaccagggatggcacggaattccgatttccgacttccgatttccgacatttttgtggtcggaattccgatttccgacttccgatttccgacatttttgtggtcggaattccgatttccgacttccgaaaaaattttggacgtcggaattccgatttccgaaatttttgataaaaagtcggaaattttcggaaatttctttttttttaaatttatttttcaaattacataaaacgttttgccaattcaaaagatttatttttcggtgtcaaattattaatttttatatgcattttctattttttttgttttcaaatgaaataaactagagtgaagcgagaccgcccacaatacatgttagtctcctcaagaaattgctggtgccttcgccggtgttgcttgtgatgcagcgtacgactactagctaattggaccgtaacctgccatcgaaagctgaaattatatctctcttagctgtacgttcccgtatggcataagatcatgccctacgcaggaattttctcggtgcagaccgttgccttgctatgtatatgcgtccaagagatactatcaccatggtaggtggttactgttccgatattcgtgagagctgataaaacatgtggttgctatgtccacgctcactagatattcggtgaggtacgctgaatgagaaaccgtgtccagtgtctgagcattgctcctttagagctcatgaccatatttctagaacttgcttggaagatttctacggtgttaactccacctcgtatcattgtacaggatgctggctactaggtgacatgtcatgtatctcgttgaaagctgtccagttactggctccgacgagtgaaaagagtactactccacgtacaccaatgagcgaaaacctggccagctatccgccgcttacatgacatgccannccgtcactcaaatactctgacgatagaacaggctgacgataagcaatccaatctcatgcacaattctattgtataaatctcgctctaaaggccgaaaaaagcacgctcgacacagactcattgtcaccacccgtcacctaaaatctactcagcgtcggggaagggagccatggggttctagcaactaacttacctgttgaaattcggacaccccaacaacttgttatatctattccaaaggaatgcaaattg

SEQ ID NO: 25067 - DNA, 1145 bp, Heterodera glycines
cccagcaatctccttcctcccaagttaccgttacccaaaactctcaaatgcaaaattctgagcaggaaatcaggattttggaacccgaaaccccctcccgtattgttaaatatcaaattgcccaatcattcccctttaccattgcagctaaagttagccaagggcttggtcacgccgaaaaatggccaaatttccttatttctgacccaattcaaggcaagtatctgttaaatggtgattgtatcttcttctcttcatttgttgtcgttcctccctctcatccaattatctcttcccccctttcgactattcccactctaaaagccttccataaaggcatcaatccccaactttatggctgtcaatatccccttcatctcgtccaaggaattgccgttgggcataaaattttcaaaacatctcagggtaaaaacataattttcaccctggtgaccggagaaggacttattacccccaatttcattccgacaccccatctcaatcatcccctcataaaaggtgtgagacttaatatttatgtcaaacaaattgccctggggacccaaatttctgagttttacacctttccccaaaacttcccaacaaacaaccttccagcatcgtcaggtgacaacaacttcgccatttcgatggactccacatcaccgcccaggtacatctttcctttcaatccctccctcacaaaaaatgacaatattaactcttttaaagccatttccgtagccttaaaagcacagcccattttttgtcctcctcacaccaaaccacctctgtttatacaaaattaaaattggtcccccataatccaaaaaatgaagagatctgctcatccgtcaatccctcaaacccttcctgttcctcttctaatgcctcccaagcgatacgaatccaaaaagtatttccatatttcttcacccactctctctcttcattatctgaattcataaagttcaacaatacctggaaacccgactccctcctgattggctccgtcaacaaaaagatttgtgctcaaggcactgttaaaaccgtaaaactcactgaccctcaatcttctctgttgaaatcacagttaatttatccgagacagaaggtcacagctttgatttggaggacctgatcct

SEQ ID NO: 25068 - DNA, 1619 bp, Heterodera glycines
agatattttttaattaatcggtgcaaaactgattataaatgtttttatatttaaaacttcaaattttatatttaatttttaatttttactgcaggaagaggccatccaaattctggacgacctgtacatggcgctggaggaggacggagttgggcagcagcggttgcgcgactgttgtagcagtgcgacgagcaacggcagtcagcaccaactggtcgggagcagtgcagcgtcgaccgtttccaccggcgcaaatgccatcaacgccggcactagcaaaaacgacgacagcagcgccgtcgtcggcactgtgcccaccaccgtttccgtcagctgtgccggtgacgtcatcgtttccacaacggcggcaccatctgtgaaaagtgtccgcggtgttgctgcagcggcacagcaacagaagaaaggtttgctggataaacctcctctcccctttttcatttttttttcactcgcaaaaagtcaccaaaatttggcattaaaattttttgccaaccttaattaaaatattacttttttaaagttattgccgaacactcgcgagaaccatcctcctcagttatgaccattgcttcaacttcatcctcgtcgtcctcagaagtgaccacgaaacgaaataaagtgggatcggtcactgcttaaataaagacggtttagacaaattttcattttggaaataagcgtgggcaaggagttcgtaaaattgcataaaattgtttatttaaacgcatattttcacaaatttggcataccccacaggtgccgttctccaccaaacagtttgaggcccctcaaccgccgtccgctgctgaggctgccacccatcagcaaaagcgccactcaaaacctgcacaaattccgcctgatgtgaggaacggggacctttacttttatatgccttttaccaatatttttgtaaaaaaagccataataattttaatcgcgtatctttttaatctaaaagaattattttagcaacggtcggaagagcccatccaaattcacattccggacgacgaattgctgcgcatggcgttggaggtagacgaaatggcacaacaacagcaacagaggaggcggcacacgaccagcaacggcagtcggttgagcagcagcacgaggagcagcagcatgtccagcagcaacagtgccgccaattacaacaacacaaaaagcagcgaggacaaaaagggcgtggtgacgaacatacgcggcaatggcattctccccaccaccgtgtccatcaatagcacaaccaccgtctcggtgcaacaaagtacggttttgtccgccatgccgaacggcgcgggtggtggtgaactgctccaaaaacaacaacaaccacaagcagccattaatgccaatgacaatagccacggtgacagtagtaacacatcggcggcatctaccgtagaccaccactcctcctcctccgctcgtgccaatgattccctcaccaaaaatcatataccaattaatgcaattacatcctctaaaagaagccccacatctgtcgacgaaaacgacgatgagttccaacaacaaaatattattttttccgacaacagggtcaatttcttaccaccgtcgtcgtcacaagt

SEQ ID NO: 25069 - DNA, 1022 bp, Heterodera glycines
tcaattagcgtgattcattgggcggtgtaattactttttaaagtaaagtttaattaatgtttataaatttgtttttgcaatattactataagatgttgaatatataaaagttatgcacgaataattgtattaataaatttatttttatttcttttggtcgcagtcaaatattctcttggctttaactagtagcagtgataattagttaaatttattcattgaaagcattaactgtagcaaacctatttttccgcctaacagtcctaatggagtgctttgctcatattaatttattacctaaaccataaaagctaatatcagtgcatcgctgaacataaaaaatgagcatttattgaataaaatttgttatcaaattctgttgaaaattatggttattgtgtttattttaacctatctatattttatactatgcagctatttgagtttaattggttggttaaattaatttaattaaatctttaatttgactgattggacaaattatcgttgatcactcatttttgatgagctaaaatgagatccgtaaatcatttttatttatagcgctgagtattgaatttttaaatttttcatctttttgatctgttattattttataaattgctgcacttctcattaattatttattttttcaagtaatttaaaattttgtctcattttatttcgttataagttttcttgagtcaaatataattaaaaatgtaaatgaacattgaaatttgttttttctttcttgtgaaagattaatggtcagatttataaatagaattcttatatttttaatatttcggcattaattttttgtctttttaaaaataaatttaataggatttcttttttattaagcttagttttatgtgaaattaatattttttgttaattaaaatcattgccctggtaatttggttttatttaaatctttaatcaataaattttgtattgaatgaaaatttttataatttgttcagcctttattaataaaaatcaataaattaatttat

SEQ ID NO: 25070 - DNA, 918 bp, Heterodera glycines
ttgtagggctcaaccgtatatagtaatgcgttttcggggaaaacctcatgttgaaggctgtagaaaaaagagatagccatttttttgagaatatctattcttagttatggagccattttccaaccgaccatttgtagggctcaaccgtatataggtaatgcgttttcggggaaaacctcatgtggaaggctgtagaaaaaagagatagccatttttctgagaatatctattcttagttatggagccattttccaaccgaccatttgttgggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggctgtagaaaaaagagatagccatttttctgagaatatctattcttagttatggagccattttccaaccgaccatttgtagggctcaaccgtatataggtaatgcgttttcggggaaaacctcatgttgaaggctgtagaaaaaagagatagccatttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatatagtaatgcgttttcggggaaaacctcatgatgaaggttgtagaaaaaagagatagccatttttctgagagaagctattcttagttatggagccattttccaaccgacca

SEQ ID NO: 25071 - DNA, 1388 bp, Heterodera glycines
  misc_feature (1384)..(1384): n is a, c, g, or t
gggcgaatcaatcgccgccggcgcaccggaaagcggtgacagcgacggcaccgctgatcagcccgcccatttgctttgggtttgcgcttttcctcgccggagggggcggggagggcttcttccgtctcccccatcaattataaccgcaatatcctaaaccaccgctttccccagcccctccccccaattatccatcacttatatctcctctggttatacccacccttcaccccgccccccaccaccaaacaattggttgtcttcgtcatcaaaaagcatcgcaagcgagcaaaactgcctcttcccgtctttacattgcaaatgcgtctccaatacaataataaaaaaatataatccggaaaaaaatcgggaattggattctttttttgaaattttaatttaattcttttaaaagcaaaagtcaaacattcaagcgacaaattaaaccaataatattctcattttataaaaatttaaaacaaattttctattttcaaataatccaatcaatactttttttaatgatcaaatctcagacatccatttttactagtgcacttcttcccattttttgagaaaattcacgagaactgggaacgaggaagaaaaagcggatggtattctcgaacgggaatttcttaactgtctataaatggcaagggattgtccttgaaaactgacttttctgttaaaattgttggtccttgccttgcaaagattgttaacatttcctcaaatcactgaatatattttaagataatgttaaaacataatagaattgtgtttttattatacttaagtttaattaaaatttcttttttctttttaaattaataatcagggctgtcaaaaatatgcaaatgcatattttttcctggattatacgtagtctaattagtaggatggtatttgcgtatgaaagtcgggacttttatttgcatatttttgcatattttgggttttttctgcatatttcatgcatatttaaccattttttgtacatattttcagctttttttttgcctattttgccatttttcgtcaaatatttccgatttgaatatcccttacaaattagggaaaaaattttgattatgcctaaaattaaatccaaatattaatggatgcgcgagtgggtcaacagtgagcttcactgccgaaaagcttgagaaatttttgatttgaaattgcaaaaacaaccgataaaatttatgatgaataaaattttttaattaatttgcacccctaattttcgacttttttgtgcatatttggtgcatattttgcgatttttgtgcatatttggtgcatatttcacgactttatttgcatatttacgcgctatatattggcctatttttgtgcatatttttgacagccctgnttaa

SEQ ID NO: 25072 - DNA, 1877 bp, Heterodera glycines
atacatattaaaggccagaaaatggtttattttttggcaatttaatggcaaatgttaaccaaatcgggcgatggatggcaccgaaatttgctttcctttttttttactaattaatagggttgtaaattatatggactaaaaaacgcgaaatatggacattaaatatggactaaaaaagcccgaaatatggactaaaaaggacaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttttcatttttcttgtgaaaatttccaaaaaatggccaaaatatggactaaaaacccaaaaatggcgaaatatggatttattcccgaaaacccccaaaatatggatttatatggactaaaaccttcaccaaatcaaaaaattttaacgcagaaatgctatttttaagcccctttcttcatagcatatgcgcagaaaaaatatgttaatccatataatttacaaccctactaattaagcaagcaatgaaaaggattaaattaaatttaattaacattttttttctataccaaataatcaaatcgagtgaaatttttgttcagcggagggacgccacaggaaacaacggcatcggcaacggaagaattaagctttggagaaagtgaaaaagtggacaaaatggggagcagaagcagaaaaagaaaaattgggcaaaaggaggccaattttatggccatttcgcaacaaattttggccgattgatttagcggcgaacatttttttgctcgaaatttcagtgtcagtcagtcaaatgaggaaaatgccatggccatcgaatggattaatcacctcattcgataggacatttcattcattcccttccaaaatcaattcaatttctgctgatcagagagcaaattggcgaaagcatcttttaaattaatttatatttatcgtcggtgacgaggaatgctttaataatgtgttttttgttgcagatgaaaatttgtagacaatcacgacgagattagcgacattaaaatgtgttgggttgcatgaatgggaggagaagactaatgaaagaacggacacacactgaactgatcagaggtgaattaaatgagaaacggcggagagcggtgatcagaggagggcactcatttgcatttgattctcgaagtcagtcgagtcgagaagggaatttggacacctaaaacaaaaagcggaaaattggaagaaatctcgactcgaaaaagctcaacaaaaagtgcacagaaaatgggggaggggggaaactaacggaagcgacgattagtgttctaattactcaaatttgaataaatttgaacagtcattggcgtgaacagagaaagaaaggcccacacaaagcgaaagaagtgcaaaagtaacagaacggtgaaatggacaagcaaatgagtttaataattgtaagaatactgaatcgcaatatttgaggccgaattattcaattttttcaggatggagagaaaaaggacacttttgggggtaaattttggagtttttcgtgagttgagcgaccatcgcagagaaag

SEQ ID NO: 25073 - DNA, 1121 bp, Heterodera glycines
attatggggagcaaaaatccaacccagatttaaagtacaggctataggggaagctattcccgaaaggatccggtctccccataaatctgggcgctcgggttcggggggactgccccgaaaccaaaaaaaatcgattttttttcaagtgtccgttgggggtactcaaacaattatggggagcaaaaatccaacgcagaattaaagtacagactatagggaagctatttcccgaaggatttcggtctccccataaatctgggcgcatcggttcagggggactgccccgaaaacccaaaaaaaaattttttggataaaaattatttaaatgaactgactagataatatttaaaataggttatttctcttctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccccccccgccctcaaaattttgaaaaataaataaaataataggagactcagaattttgaaaattttttataaaaactgatgacgagctaatgtgataaaacgggttaattcttttcctttcggtatccctgcgaagtttggggcgcttctgataagtttctgaaaaaaaagataagcctaaactttttggcctgtttaaaaaggaattaaaaatttttaaaaatttattcatct

SEQ ID NO: 25074 - DNA, 851 bp, Heterodera glycines
agttgagggcgcacaacggcgcggaacggatgcaacagctcgagcaagtttcaaggcggaccggggaacacatggagatgagcatccaatgcttgaaggcatggatggcattgctttaaaaaaaatcaccttattgttttagaaggagctggccgatcggcacgttctgatcagttcgcagaatgagaaaatttctcagctggataatgccattgccaagcagcaacaactgcggcatctgtttttgtacgagaacggtggtcaaaatgagagagttgttggagaagcagagaagacgagagagtgcatggctggcgaagacagtggaggagcagagaagcagacgcaacaacaacagcacaatgaattggatcggacacggcacgagatggacagactgttggagagagtgcgcgagttggagagggaaaagcgacagagacaacaacggcaacaacacgtgggcggaatgacaacagcagaaaccgtagacactggagatgttggaaaaatgccgtcggaggacaccgcatcaaatggcattgacgagcaaacggatgctttaaagcatcggtatgacgagaggcgtcacctgggaaaattctttgaaattttggccaattccaaaggaggcaactgctctcgacccattaaattgaaatctgtccaaataaaattaaaatattttaaatgttttaattatgcttaagcattcacgagttggaggaagcacttcgggagtccgtcggcatcacatcggagcgggaaaaggcgttggcggagcagaaaaaagtcaaccaaaaattgtctgatcaggtgtgacacgggtgcacacattctccacccccccc

SEQ ID NO: 25075 - DNA, 1439 bp, Heterodera glycines
  misc_feature (323)..(323): n is a, c, g, or t
  misc_feature (337)..(337): n is a, c, g, or t
  misc_feature (340)..(341): n is a, c, g, or t
  misc_feature (343)..(344): n is a, c, g, or t
  misc_feature (351)..(351): n is a, c, g, or t
  misc_feature (357)..(357): n is a, c, g, or t
  misc_feature (378)..(378): n is a, c, g, or t
  misc_feature (383)..(384): n is a, c, g, or t
  misc_feature (391)..(391): n is a, c, g, or t
  misc_feature (397)..(397): n is a, c, g, or t
  misc_feature (400)..(400): n is a, c, g, or t
  misc_feature (403)..(404): n is a, c, g, or t
  misc_feature (406)..(407): n is a, c, g, or t
  misc_feature (415)..(416): n is a, c, g, or t
  misc_feature (430)..(430): n is a, c, g, or t
  misc_feature (436)..(436): n is a, c, g, or t
  misc_feature (439)..(439): n is a, c, g, or t
  misc_feature (463)..(463): n is a, c, g, or t
  misc_feature (476)..(476): n is a, c, g, or t
  misc_feature (492)..(492): n is a, c, g, or t
  misc_feature (497)..(498): n is a, c, g, or t
  misc_feature (522)..(522): n is a, c, g, or t
  misc_feature (525)..(525): n is a, c, g, or t
  misc_feature (546)..(546): n is a, c, g, or t
  misc_feature (565)..(565): n is a, c, g, or t
  misc_feature (573)..(573): n is a, c, g, or t
  misc_feature (575)..(577): n is a, c, g, or t
  misc_feature (582)..(582): n is a, c, g, or t
cgactttttcactttgatgcccacacccatcggtttcattttttgtttggccggctccatctgtcccatttcaatgcaagtgatgccgagggaccaaatgtccgctaaaattttaaaattaaacaaattaaagggcatgtgcaagcagttgtgcttcaaccagtggtggttatctttatctgtagaaatctgggagggttcttctggcgcaaacagaggatttcggttatgggacgatctaccgacaattctcgccctatttccggatttttttttgcatttaatagaaaaccttttcatatcattttaaaaaaaaaaacacncccctttcaataanaanntnnttaaatnaccttntcaaacaaccataattacttnacctnntcaaatnaccacnaanatnntnntaaacccnntcaataataaaatnaccacnaantcccattttcactaccaacctccntcaaactaccatnaactatcttcttattnacccnnttcatttaactacatccaattttnccncatattcacataaaaattttntttttttcttctatttatntcataatnannnatacnttttcttataaaagaataaaattaatttataattagtttattttaaagaattttaaaaaatgtttaaattggctcaaaaattaccacaattgattatcgagaaaaattattttatggaggtgtttttggttaattctttgttattttcgtaaaaattatttgtctctcgaaattttttttgtcgagttttgactacctttgtaaaaagtggttttaaaaatacttaacattaagataaattttttattttggtatcagaagaaagagcacacttcaatctataagaacttatttttttatatttttaacttacaattttccatgttgaaaggctcatggtaaatatggctaccatgggtatgatgatggtagcttttctaaccaccaactcccgtcaaatgaccacgaactacattcttattgacagggtaaaaatgagggccatggtcatggttaaataaccacaaacttcgtggtcatttgaccaaagttcgtggaatctcttgttgaccgaggattatcaccaacttcatggttatttaaccattaccaccttcttattgaccgggcccggaggggaaatttggaagtgaaacggaacatggcaaagggccgggggagggggcggagtcaaagcaatgccaaagggacggagagagggcatgacgagagagtgggcggagaggagagggctagacagaaattggggtggacagatcagtgccccgaggggactaagggggggggggaagggaaacagtaagagggatcaatatgggggtgacagggcagcaaaagctttcaacaaattttcggatgggtaattttgccaatttcttatcttccctgaccaagtg

SEQ ID NO: 25076 - DNA, 269 bp, Heterodera glycines
tttttttttttttttttttttttttttttttcctcccccccccccccccccccccccccccccccccccccccccccccccgcccctccccccctccccccccccccccccccccccccccccccccccccccccccccccccccccccccccccccccccccccgcccccccccccccccccccccccccccccccccccccccccccccccccccctaccaaccccaacgcgcccccccccccccccctccccctcccccccccccc

SEQ ID NO: 25077 - DNA, 2030 bp, Heterodera glycines
tcccatgctttcttctgactctaaaagttcaccatcaacccggttatttaacgaaacatttcgattttgtgtgttagcggtgttattcggcctgcttaaattccctacaactccgttttgctgttgctgtaatgccgccgcatctcgagctcgttgtctggtgaatggtggagagcggttaatcatctttttaaaacaacacgagttttattggagaatcttgaagagcacaacacgagtgctttattggagaatcttgaagagcacaacacgagtgctttattggagaatcttgaagagcacaacacgagtgctttattggagaatcttgaagagcacaacacgagtgctttataattcggtgggatgcatgaagagtccaacacgaggacagaaaaatgataatgtcgatatatgataatgtcgataaaatccaaaatccaacacgaggattatcgcaacttatatggccgatgtaaaagttttccgtttagtcgtcactaagcaagccaaccttttgttgcaggagcgccaagttgaaaaagaataaagtttgcgtccacttttcccaattcaaatgtcaaaacggtgattgtcaacagttctctgcgatctgtctttacaaaacaaaacaaaacaaaacacaaataaatttataccaaacaaaataaaatagcgacgacaaacaaaataaaataatccagcacaatttctctccaaaattaaatcataaaacaacaaccaaaaacatcacaaaatatattgagtctcttaaaaatatacgaaacgccacagaaattaataatttaaaattgaaatgaagtcaattagcacactgcaaaaaatatgcacgaaaaatgaccaaaatatgcacataaaattgccaaatatgcacaaaaatcgcaaaatatgcacaaaaaacttgaaaattaggggtgcaaaataatttaaaaaattttattcctcataaattttatcggttgtttttgtaattgataatcaaaaaatttctcaaggttttcggaagtgaagctcactcttgacccactcgcgcatcatccattcagagttggatttaattttaggcataatcaaaatttttcctaagggattttcaaatcggaaaatatatacaaaaaatggcaaaatatgcaaaaaatcagaaaatatgtacaaaaaatggcaaaatatgcaaacaaaagtcccgatttttatacgcaaacacaaaaaagaaagtgtttttcctactatttagagcatggagaagccaggaaaaaatgcatttgcatgttttttgcagccctgaaaatcacaaattcttatcaaaaaaatttcgggtccgctttgcagggtttggatacacaattgttgtggatagctttgttgtataagccttatttttaaatacgcattttgtaaatgtgagacaatgtctcccgtgttgaatgttgttttaggggtataaaaggaaaataatttcatgattatctcccattgttgctctcaaaaagttggacaattactgcactaatgtttacttgtttaatgcatattcaggcacttttacagtttaacggattcgatgaaaaaccaaaggtgggacccttttaatgtacaattttttaaaattaggtatgtcaaaataaatcacatgtccttgatcagtgaaatggaaatatacaacatttgaagaagctcgacacttttggcgcaaaacgctgttctgcgttcacttaaaatttcgtaaataacactggagaaaattttggcacggagcaaaaaaaaaaagagaaagtttttgggtgtgccctccctgaaaatgttttctgaatatgggccgtgtgattggcaacatgtcgaatgacttttggtttttgtatggcatttaattttcatgtgttaaaaataattacaaaataataaattaaaaagtgaacagttaaagcgggaataatgttaattaattagtaattaattaggcagtgtgtaattaattatgtttacgtatgtgcattattatttattatttt

SEQ ID NO: 25078 - DNA, 1025 bp, Heterodera glycines
  misc_feature (872)..(872): n is a, c, g, or t
  misc_feature (917)..(917): n is a, c, g, or t
gaagggttgatcaatttgacaggaatagagccttaaaaatagagaaaaatcaggagaattttatgggatttatttgggatttctatcttaaaaagaaaacaagttattccagaatttctgaaaattttcgatttttcagaaaaaaattcatgcattttacgttatttttaatgattttaataatttaaaatattttattgagttaataaataaaaaattatatttaaattaatttttttttgatgaataaattttataagtttaaattaatttttttttaattgatagaatttcatgtatttttttaattaaatttgttaaaaaatattttcattttaatttaatgaatttactaatcactgttgtatcaatttatatttaaagatttgttgtaaattaataataaaagaatttatgtaaaaaataataattatcttttaataaagaatttcatattttttttaattgtttataaaaattaatttcatattaatttaaatattcaattattgtacatttcaaaattctctttttaattaataaaaggaataattaatttattttttaaaatttataataaattgcattcaatttttgtacctcttctaatcaatcacagttgtaccatttctaaacacttttgtacctcttctaacaattttcccaaagcgcgaagcgctttaccaggggcgcaaaaactgactttggtgacagtctcagtgttacgaaaatttttgcttttgctcttagggcttagtgaaccccaaaaggcacaccccccaactgtggcctacaactttgccagcaaaaatttaaaaaacgggcgcgaagcgcccgtctgaggccgcgaagcggccgaaaaggcccaactnaattttaaaaaccgggcgcgaagcgcccgtctgagctcacaaatnttaaaaaacggccgcgaagcgcccgtcagagtaaacaacattttgaaaaccgggcgcgagcgccccgctgaaggcgcgaagcggccgaaaaggcccactaaatttaaa

SEQ ID NO: 25079 - DNA, 890 bp, Heterodera glycines
  misc_feature (852)..(852): n is a, c, g, or t
aaacaaaaagattaaaaaaagtattttctgtaaaaaatttatcaaaaaagaattccttttaattatatcacaaaacaaactaattgaaattccacttatattcttaatttgtagttttgtcgagaataagcatttaaccgactttgttttttacattttaaaaagagaaactttaaaagttgacctttaatcagtaatcaccaataataaatggttataaaaattctatttaaaaacataagagaaaaacaaacacaaataaaaagaagcaaaatatagttaaagaagagaaattagcacgaataaaagaatgttaaaagaagtaaacgaagaagaaaatgagaaaatgaaaaaacaaagttaataattttttttgaatcattagatacaagcaatagttttcaatttatgagttttcaaaattctaaaaaatttcctcagatagcggaatttaagaaaagcgctgcactgaccaaaaatgccattatcaatcattccattgcacaaaaaattaaataaatttcacacttttccttgccaaaatgacttcaatttccactgtcaaactgttgtttatgttgtaaaatgcgttatgctcatggtttgtgccccaaaaaacctataaaatacgaattaataagaaaacaacgaagtccaagaaagtcacaaaagatcgctcaaaaggtaacctcaaattaaattattttacataatttaacaattgatgagatttggaatatatttctccagtcacaaagttcgaatttaaaatagaacgtatttggaataatttttattagagatcgacattttgaaaaaagccaggacctggacctggatttcctgtacaanaatccaggaaaatccaggtccaggaaaatccaggtttc

SEQ ID NO: 25080 - DNA, 1706 bp, Heterodera glycines
ttccccaaagaattgagtaggaattcctccgatagtctcttcttcacttttgccattcccaacaacaaatcggcgccattgaatgtgactttgagcactgaggccaactcgggaatagtggtgaatgggcgagagtatttaacacttaaatccccaggggtaattaattaattgccttttgcgtcagttgtcggcccatctctgtgccatttccccgcgtagtttctcctcctccgccgattggtctttgccctccaatggcattttggcggccaccgcccgttccgatcagttccaatccgtcctcctccgtcccgcgtcactccctctctccgatcagtgccctcccacaaatcgttcctccgccgatcaatccgctcttctgctgctgctcgaagtgcgttcgttggtcggcggcagtcgcggcactttggcggtccgaaagaatgacgcggcggacggagcgatggcattttccgcggagggaatgccaagcgaattggaagagcaaagcgcggaatggtcgctcattaaggggcagcagccgcttctcctcccaatccatggcaattgttccgtcgaagactgctcgaatttagtgcgcttcagtgcccacttggccataaggttttggccgaacatttgcaaaacaatcggccgaaacgatggacaatttaggcaagggtcggtggaattggccttgatacaacagtgtgacaatatcagcaacaacggatcattgaaggaaacccaaaagttctttctgttggacaatttccttccgggcgaatatctgcgatttatggacattcatttcggcgacaatagcacggcaaatggcacaattctgcgcgggaatcactctgaacatccattggtccatttgggggggggaaagggactgaaaatgccatccgacaaattgctacaggaactttcgtactgttctctgtccgctgagctcaatgagtccaattcctcttcttacggcaacattcaactgatcatctcttcctcttcgtctcagccctctctcgtggcactttctcagcttcggactttcaacgcgcggcatttaacgcagccgggcaaagggccgtccatcggttggcacttttaattggccaattaattggttttcatcaatttaatcccattcccctcatttgtcaggtcatttcgccctctttgttctccttttggtcatttccctcattttcttcggttttttggctgtttttctgtcgcgtcactttttccttaaacagcgccgcgttcacaaagaaaatgaagagcaacagcagcagaaggaaggcgcccattttgagatggaccaaatgcgtgaaaatcggccgacgtcgacaatttcgaaaagggagggagcggtggcggaagtgaaaatcaacgcgagtgcgctggaggaaagagcgatcggtggaagtaatgggggcggatggatgtgatacggtaggggaaatgggaatgacagagtacggtaataacaggaagaaaaacgggcatttgaagtggcattaaaagttaaattgttttctaagtttttctttactttttttcctttgaaatggaatttgttaccgtactagtatacagtacacatttcatcgttttgtgcgcaaaatgtacaacaatttgactgattttgatcttctcagctgctgtttgtttggtctctttcctatcgcatt

SEQ ID NO: 25081 - DNA, 1521 bp, Heterodera glycines
  misc_feature (1472)..(1472): n is a, c, g, or t
  misc_feature (1488)..(1488): n is a, c, g, or t
cgattacctaatatctaaaacagtaaaaataactattttgaagcaattttgcaaaatgttttggtttttgaccccaaaatctgattttttgagccctacgttctcatttttaaaaatttgcgatccgaacccgaaatgaaaaaattatgtgccctaaaaaatcgaaattttgattgtattttcacttacaaaatttttcatgtttcacaggtcaaaacatttcatttaaataaataactggactgtgctgcgctgcgaatactatccttgaatttggtacattaatgggattaatttgaatcgaagatcccaaatgggtaaactgtggcttgtgataaagaacttcgcattaatttttaaaacaattatttttaagtcaaaaataatttataaattttttttataaattgctgcccgttctttcataaattgtttcatagtttcccaatttgatttaatgggcaaataatattttttaaataaaacgacttcacttgatatttaatataagctcttcgaattaacttcattctgacataattgttaagaagcatataaattcaagtaaaatttagctttttcattatcttatcatataataaattgttttgattattatttttgatcaatgtttttgaatatatgtatctagaaaccatttaaaattcttagaagatttttgcttcactgtgtaaaattagaaattttcttatattggaataatataaagaataaaattaaagtaaatcaattttttcttatgtgcaaatgcttcaaaatcaaataaatttgccatatatcatttctgttttttaattttgcaattaataggttttatcgtgttcatatggttgaaaattttttcccatttatcgtgagaaaaacaattacttgtttccgatactattttatttacttaaagtttatttatttgttttatttgtcattctaaattactattcatttaattggacaaaaattgctacatttaaaatgatttatataataaaatttataaagacaaaaatgaatttaaatattattaatttatcttttacattgttgttccaattaatatatattttactatatatgctcgaatgcattgtttcttttcttacatcatgcgccacaataatttataaatatgatttttgtagttaatatttatttcatttaaaatattttccacgtatataggttaattttatttttttgtttaattactacttttgttgatattttaagtataatttaaccaaggccgagaacaaactttttttaaattaagcaactcaaattttttttatttccatgcaactaattttattaatatttgttttgaaaattattacatagttaaaagttcaagatttaaaaatttttgtatttgtttgttcaattaaatttaaagatttagataaacttgatttaattttggaataatgattttgagaaataaagcccattanaatagagcctcatttnttgagtgggttttactcgggactcattttatgt

SEQ ID NO: 25082 - DNA, 922 bp, Heterodera glycines
cccccccccagtgcgtttccgaatccaatcatcccccccctgctcttccctcttcattttctcgtcgcgttcagtcgcccctcttccaatctcattcatgataatttcttccttacatttcaacaaatttgtttcttccgggaagaacaacctgctgttgccccccgccccccgagggtcaagtcaattttcaaaacggaacccctcgggcggcgggggagctatttttggattgaacttcgatgctttcttttaattcttttgaacattcgtttccttttcttaccaataattaaaaatgtttctgatttttcttcgatttagagaaataattaattaatgtgcgcaaacataattaggagaagaccaaagaaattacaatagtaatgaattgataatttgttaagtgaaatttgcacatcttcaaaatgtttctttcttttttcttccttttgccattttcaccgttttcaaaagtttcctccgccgttttattatccgagttggaaatccctcagagtttcgtgcagattcttcggaagggccaatgtttttggcttttcccctaagtgaaaagtgacattaattaaaataaaattaattaattattaaaaagggcggggaatttcataaacactataaaaggtgttattctcttctcttttatttgatttacatgggaattcgtcgttgccaaagtgtccattctccgccgtcctttggtaaatcggacgcgttaagccaagttgtctacaaggaacagaaaagtatgaccgatgataaaaagcctaattatgcattaattgcctaattattgccccagggcgaaggtcgaagtttgtctcgacgattttgagaaggtcgtggtctttgaaggggaagtgccgaaatgggtgacatcatctgaaagtgccactgaaag

SEQ ID NO: 25083 - DNA, 1381 bp, Heterodera glycines
gggggttattttttggttttattgcattttttgttgagaaattttccaaaaaaaggtggaaatataaaaaaatagggacaaaacgccaaaaataatgaatttttcattattttagtgacgaagctccaatggtgacatgaaatttgggcatcagagtaagggattcaaaaaaaaataatacaaaataaataggtaaaatgctaaataaatcgttaaaatctagtaaattttaagaacccttgtgcttaaaaaaaaatttatgttttcttaaaaaacggtaaataaataaaataaataggggagcaaaatagaatttagtgctaatttggattttggtgatgaatggttttggcatctttcatttgtgcttttatatgccatggtttctctgcccatctctgctgttcccattttgtttctcttctctcagattaattgccattgattaatctgtccatttgattttccttgggttaatttgagtggcttaatgccctcctctgccagtgaatgggaacggacggcattttctttgctcgcacaacggcactttgggaaaagcaacctaatcctcaaccaaaaagtgaaaacgacccccctacccctgaaacgaaaaatcaaaatttttcaagaaaaaacgtgcaattttttaaattttggaaaattttgtttttttcaagaatttttttgtaagaaaaatgaaccaaatgaaaaaatgggtggtttttgtgacctctttttatttttcattaattttttgttaaaaatttggagcatggtaaaaaatttttcaaaccgtttaagcgtttgtataaaaattacaaaattcgcccgaggggttaaatccaacatataaaatgaaatttgtcgatggttttgcgccaccaaacctttgtgcaggtggtcgtttttccggcaccctgcagaccgacaaacatcaccacatttggccgccctttgaccggttggaacggtgtgacgccagggtcaactgaaacatggacggatgaatgaaaagatattgtaaaaaaacagacgtttcaaaacacttttctttcaaaaaaaatttgttagaaaaaaaaattcatttttcggaagggaaatgatgcgggaaggaacgtagtgtaacccaaatttatggagtaaaattgtttcgcagacagaccaagaattgagagcccgaggctttaaaaaaacggaaaacaggactttacttgtaacacaagacctggcttattgttagtgaaaaaatggtaaaaaatagaaaaattcccatttttcaatttgaaaaaaaggaaaatttcgttttgaaaaatgaaccgattccttgaaaaagtggcaagaaattaatgaaaaatttaaaaaattatgctcatgggaa

SEQ ID NO: 25084 - DNA, 1418 bp, Heterodera glycines
ctccaaaagtccgtcgtaatgagtgggcttctgaaagccgccctcttccctggccgtcccccaagggttcgccccactcccccaactcaaaaggttcagcacaatgattccctcgcattgggccaattccaccggccttccgtccacttccaattcaattcgtttccataaatccttacagtttcgttcgaaagccttctgaagtccgatcttcacatattgagtctgacattggaaaaggcacaaaattgtcattcgtccgtcttcgaaagatttcgtcactttgttgaaaaggcgtgagctgaacttctccgggttggcgtctcttttgttgtggaagcgaagacaaacgtcagcatcaatgccaatgccgaaataattgttcctaaagtgccgttggccatcctcgctgaggtcatggcagttcgtacaatgtatacatttcgtacaatggagtttcgtacaataggcagtttttataaaggcttagaataagcataagccttcggcttaagcttaggcttgcttgggcttaggctttattttgtaaaaatttttattgtacgaactgctattgaccctcttggctggaccagcactcacatgattatcatgctggtctggtcctccgggttgctcatcacttgcgcttcgttctgtccctcgtccatccccgcggccgaaggctgtgaccgttcctcttcgtgaaaaacgatggcccaccggtccaggcggacctcttccgcctcgatcacttcctttaggatgtccgccgcactctcttcccccgtgtagccgcctccccacctaagcacccgtgccaaatcgttgccggtgccgagcggcaaaacggcgcacggaggtgagaaacaagcggcatcctgaagcatgacaaaggttgaaacagcaaaggagttggtcaattggccaagctgtacctgttttgctatgtcaagacattgcagcacccacccaacggtgccgtcgcccccagcagccaaaatgcgatacttggagatgttgcggaacacgtaaagtccgaccagaggaccgcctttgagaacgtcgaacacttggaaagggttgagcaagcgacgaaaggctgacaaaagttcggtgccttggcacccgccacttttgacgttgaccagcaccagcaaaggctccacgtcggcagggatcatgtgctgctgaacgtttggcagacacaaaactctgaagttcaattggacaatttttgaagtgatcggaatgaatgatcagaatgagtgatcaacctttgtttattccttctttttttactttatttgttctgccatttccctccccaataaaatgccttacacttacatcagcttcttctcctcatacatcgcgttttggagcttaagtaccgctgcagtggctgcctttggcgt

SEQ ID NO: 25085 - DNA, 1609 bp, Heterodera glycines
ttatttaattatttccactttaaaattatccagagaaagtgggtggcccaaacaaacacgtggagattgatgaatcgaaatttggcaaaataaaattttggaggggtcatcgagtagagggcgtttgggtgttcggagggattgaaagagagaccgggcgtgtcttcatgttgaaaaaggtggaaatgggtccaaatattaaatgtggaaaattttaaacacagaaataaatgcggaaaccttagtgccattgatcaaaaaatggattttgcctggcactacaattatttctaactcttggctcgcatatcaaagtctttctatggaaggatttcagaccatgacttgttttgcactgtacaataattatttttagaatatattttttgagtcttaataattggattaccaatgctgttcagttcaaagtgatttattaatttattaaatgaatatattttgactaaaagtgtcattacatcataaaaataattataatttaaagaaaattttctttcggttaatttttacgtttttcaattttacattgattggtgaaataaaattattctattttaaaataagccttatgttcatttttaccgcggcataatttctaaatgcgttatttttaaaaaataaatattttaatttgttttctgtgatttttgattaattcaatttttaacaatttaataactctttattattaatgatttcaaaattctatgaatctctaaattccagatctggtattttttgctttttacatataaaattattttctttttttcttttgactgtccttatattttaaagttttgcgacacttttagaaatattatttgtttttattttccttttaattctttaataaaaaaagtaactcaataattatttaatcattctgctttataattatttatttttcgtttgtgtgtcaaaaaatatatattttaactgggcattttaaaattgtttctgcaaaatattttaaaagtttgttattattatttatgacatctttttcttacattttaacaaataatttaaaaaatgaatatttttcttgcaggtataatagtgattgtgcttgtggaataactttggtacaattaggtttatatttaaacaatattatagctcaaagcagatgattgctagtgtatatatatatatatatatatatatatatattttagattatttaaaagtttctatttcatctttttttcggaataatgtataaaaattaaatcatctaataaggtattgtattcttttattgctttaaatttaatggcaaggatttaagggtaatctttttttatcatgaaaagagggtactttaaattcaatgtactttaaactcttgcgttcaaaatgctctatcaaaccagatacattgtataagtactttatattttattataaaacatattgaataataataggtaggcagtattacataaaaaattatttcttttttataattttttacattttgtttaaaaagtggttgcaatttatggacttattttgaactaataaattagaaccctttaatttaaattcttgattatttttttaaaataatattttattttat

SEQ ID NO: 25086 - DNA, 1538 bp, Heterodera glycines
ctggtcatagatttgttgttgctgtttgttgtaatttgtgcgggtgctagacgccgccaagccgagagagttttttgtccatcaattttcaaatatgagaattgaggagcggtgtggggtaagattgtgtttacacaggatatgcatgtaggcgtataatattactacatatgtacaaataatgctcacgggtttagcactttcgcttcctaaaaacacattttttaagtgcaaattccgcatttgcataaaatgggacattttttgcgaaggaaattctttttttagacggaatcataattgatgaaaatgattacttatgtatatattcgacttactttagcaaaccacacaactttcatcaaccatttttgatttttgcagaggagtcagattttttatttttggaaatttgtcgagtaatatctatcaatcatcaccatcacctattcttgcctttttatttgcccaaatattgcataattagtggagcaattgtaaaattattttattaccaaactccaacaacactcagcaaaagtcattcaaatccgatgggacaacgtccgtcaatgcagcagagcgaagtcgcggtaagcaccggaaacgagacaaatgctaaattttttgtaatccgggatttagcgagtctataacggcaaaattaattaggtatctgtcaaaaataggattaaaaaatattttatgatttaaaatttttttttggcaatttcctttttctattggtacctcaaagtttaaatttgcttagaacataaaatggaggaaaccgtttttggcggttgttgtaaaattgccattcttttattttatagcggcgtcctcgtgccggttctgaacttggcagcagcgcacaaaccacgggcagcagcagtgcaacggcacacattcacaaccatcggagagcgaatggaacgcgcagcagacagccgcagaatgacacggtttaatttcacatttcttggtacatttgtgtacaaaattatagcgtttggctagaaaatttcaaatcgggttaagtacatatttgggcgctatttacaaagctttacattttgaaattttttttacttttttggtcaattttttttttttgtttattttgatgtagaacttaatattcattattatatgtaaataaacaaaaacaaaaaaaagtgaaaaaatttttaaaatgtaccgctttgtaaatagcgcccatgtttgtattaatatttaaacggttcgatgatgaccagacattttcagcacgtacaaattccaatttttaccaaatcctaaaaaaactaagaaatgcacaagtttgtgttatcatttaaaacaccacgaataaaagccattttccttaatttataatttttttttagagctcgccttcttccgcttcgtccgcgtccccggcgtccgcgcattcttcgcgttcattcaccgaagaggccgcagaaggggtcactggtggaggtgccgagaaaatggaccgcttcttcaatcaagaagggctttgggacggtcccaaa

SEQ ID NO: 25087 - DNA, 1458 bp, Heterodera glycines
gctgccggtgaggacgcgtctacagtatgtacaatggcgaaaagtactgtggatgggtaaaaaagttatttgtcctcacgcggcggatgccccagcggaggagaagcacaaattgtggacgaaatcgatcggcagctgaggagtaattaatcgtcaaattataggaaaaaacccgttttatggaaaataattaaaagaataatttttgcgggaaatttttatgagaaaatacttaatttaaaatgcgcaaattaccttattaagcctttatgaaaatgaagatcacttatgaggacgagtgtccgtacaatttgggcttcgcccgtgccatgttcgacttggccgctgctgctgctggccatgcgggcaccggcacagaatggcacaatttgaaaagtcaatttgagcaggaaagccaagcaatcaaagcaattggccagggattgaacattgaagttacggatgtgcattttggacacccaagcaaaggcaaaaaaataatgattttaaataaatatttattttgaaaatttaaaagatcattttcaaggaaattccgcgcaccaaaatgtgccgagtccgagccatgtgattaccaaccctggccaacaaagttcggttggccatggaaaggaagacgaaccgttgtcatccgatttcgacctttgagggcatagaaaaaaggaattaattagaaggaaaattcatagtacagaaaacattttgttgattatttatgaagaatatttatttgttttgaataattataatattaaaaattgtctagcataaatattcacaatatttttaattttcaataaaaaatatgacgagaaaaatctatttaagcaattttacccgtttttaatttaaaaccttttaatatttaaaatccgattttttcataaaattcgctaataataatagaattctccttttttataattcatttaaaaggatcaaaaaaattctttacattttcctataaatataagtatttcttttaccacgtatcatttaattcttatcaagataaattcgttaattttttattaaaatattttagacaattttttaaaaaaatgtttgccaaatttatgttatttttattctgctatataattggcaaaaaattttcattatgcgaacaaattttgtcgccagcaatacaagattattcggaatgcggagtttcgaattttgacccattcaacgaacgaagcgcggaggacacggaaattagtcatgcaattaagcggggaatcaattatcattagatattgaaataatgaatgcatattttaatttaatatttaattgtttgttaattaggtcgtaataggacacccgttgatgatgaccgggcattgccatggatggccacattgcaaatcctcaatggtctttttaataaaagcataaataattaggagaaataaaaaatccaaaattaaataa

SEQ ID NO: 25088 - DNA, 1856 bp, Heterodera glycines
ggcaaagatcaaaggtccacgggagggaagccacacagaagggaaattacgtaattatgggggggggggtgggaatgatggggacatcagcagaagaagaaagtgtctttatgggatggcattgggatggaagagtggtcatggcacagcgcgcagagagagagagagagagagagagtgccaacagcgcagcatcgacccgcaatatttgcccgtttctgtcccccatagatttccattgcccgtacagttagttctcttcccccttccctgacatactgtataaaatgttacaataaggggtaccatggtccattaaaattgctttaccattgcaagggatcgtttattactgtataaacaccgtaatgagtgaattataattgactcttctgaaaaaactcaacaacatttaatttaattactttggttaattaccgatcattttcaataccgtattctcggctttaaatacgcttttacattacggaacacttaacactgatagaacaacatatatactttttcctataaatgcgttttccctcatccattaacgctaatttcccaaaattaaataaatgagccagctacagaaattttaggtatcacttattattactcacaatttccatcctttcaatgcgttgccaattcttccaccatttcttcagaatctcgtgcgaccgcttcagcccatcttggcacggctgtgccgcaccttcgcctccgccaatggcacttctgctgccccaatttcgctggtcggcatcaaagcaaattgtggcttcaccgccatccttttggccgtacaccaaacggaggccagcagagaggaggaactgcagctgatgaggccacacctggacatgttggccaaccttttgagcatttttgtcagttttttaaatttttggggaggggcgggggtaaatgaggtcaatcagaaattctgatcagatccgatcatctttgtctttttcatccaaatccgtttgggatgcttaaaagcgatttttcagcacaacattgaggagcagcgacggcttgctcaccaaatgcaattgttcctttgcatgactcagaatgtgttctccagtcttcgtaagtctcgggacaaaagggcggcaaatggaggacaaaggccaattttgaaagcttttcttgggctggcattaaattagcgcctttttcaattttttgcctctctctttttctccgtttttctctctctctctcttttccttcaatcttacactatctttctccgtttctctttctctctcttcctcaattttccgtgaaattaattagtgatcacattctttctctctttgatcacgttctttgttcttgcactctgatcactcaaattattccgtcgtcttttttgatcatttttttctatcggaagggcggcaacaaaagtggcccccaaatttgtgaatttgtaaaataaataatccagttactattatttagaggacatgaatcaattggtgcgcaacatcaccaaagaggccaaggcattggtccatgccgaaatgtgagggggggggggaatggggaaatgccgcggggggaataaatgatggaaaaatggaagacggtaatttatgattctcgtttgatgaaaatttcccaaaatcttacaattataatattatattaatacataatattggtataattccaatgcttccaatcattgtttttccttttgcttttccttcaaaattttgtccatacaaatccttctgtctgattgatccttaaactcatcttttagttgttcactttttctgttggacaaagaacactccgagttggtcagttgattgattaattatttaatt

SEQ ID NO: 25089 - DNA, 1205 bp, Heterodera glycines
gtaatactgtgctttgtcccccccccccttttcgaaaattttttatgatttcaaaagtctaaaacattttcccaatggttttcggggtcattgatcatgcatccggcacccatttcgactaattcggaatcccggcttcgaattcgacaaaaagtcgaaaattcaaaattttcgaatttcctctttttagtctaaaaatttccaaaaaattgcgttaagttgaaaaaaaaaactttttttgaattattctggtctaacttttttgaaccttaacgaaatttttcagaattcggcaggattaatgtaaaatccgcccatttcagattatgaaatatgcaaaatgaagcagtgttattaaatggctctgataaaggaggagcctcatttgaatttgatgacggatcagcgtcatcggacacaactgatgccattgatgatgaatttgttgtccccaattcgaccgatgaaagtgatgaaacttgtgacaccttttccgaatttaacgaagcgcacacttcgtcaagaaaacaaaagaaaggaaaagccaaaagaagggaaaaacggtcaaaggcgttaaggacgacggggaagaggcttattatatgcaacggattaggtaatgaataataccaaagaagcacttggccaatcccaatttcagagagcatcgttcactccaagaattggccaaattgaagggcgaaccttttgatgacccaaatgacttccaaacactgtgcaatgactgcccatttcaaattccatttggaacagactttacaggttataaaagaatgatcgattgtactagtttaaatttggagtcatttgtttgatttttttgttgtttaaaacaaacgatttttataggtaccaaaaaacaagcgttcgatggctctacgaattgcattttcaatacgtcggagggtaatggatgagcaaattacgtttgccttcccattggcacttttcagcgttttggccgatttcaatcactttccatctggggatagttttgattttatggtaaaattagtctgtgttttcggctaatttcttttttctcctccccctaaaaaaagtctcccattttgactccttttgcgagttttcttacaataacacttttacagattcttttctgtgacattacaagtgaacagcgtcaactctagcttcagtacatcgagtccaaggcctgtgat

SEQ ID NO: 25090 - DNA, 1039 bp, Heterodera glycines
  misc_feature (9)..(9): n is a, c, g, or t
  misc_feature (37)..(37): n is a, c, g, or t
cagtatacnttttaaacacaatggctgctgaataatnaggctcattattggctttttcacttcccattgcttttcattttatagctttgagcggcgaatgtaatttatagggcttccacttgctttttaggtaacaaaatataaaataaaaaaaattaatctaaaaattaaattttttatattacaattgtaataaaactattaaatattttaaagttatttttaataggacaacttttaaatgaaaacattgccaagaaaaaataaataaagttttggagaaaattttttgagaaagtttttcatttcttaggggataaatttgttgaaattttctcggtcattctcaggtaaatttttcatttttatactttttttgttaaattttttccgaaaagaaaaaggccccaaaaattgcgaaataggcacaaaaaaaagaatgaataattcgaaaattttccttttattttcaaataaataaaaaatgtcagtttttgattccctccaaaatattttttagagtttcaaattatgctttgataaaccatgatcatgaatctcctggattactgtagctccattgtatcccattcttccccatttcaatacagtatgcaacagtaacgcctttattccgggaaagaaaatcacacaattcttaggctttctctacccgataggtctcgggaacagatactgcccggggggagaggcccgatgtgatcatattatcatccatcatgttcaatcataactgatcaattagtgttgtagtaaattggttttccaatttttcagagttgacgatccaatttccaatttcctggcaattattttgtcagtcacttttgggtttgcttcttttatttcaaaatattgcttcatctttttcagtttgtcatcattggtatggtgttcttaaacaaaaattacaaattaatttcactaaaattatattctttcttttacttttaatgaaatttggcattaattcttttttccattttaaaaatgtttcttgagaaatgcccaattcctt

SEQ ID NO: 25091 - DNA, 1079 bp, Heterodera glycines
  misc_feature (26)..(26): n is a, c, g, or t
aaatcgattttttcaagtgtccgttntggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgcccccaaaacaaaaaaaacgatttttttcagtgtccgtttggggtactcaaacaattatggggaggaaaaatccaacgcaaaataaagtacaggttatagggaagctattccggaaggattcgggcttccccataaatctgggcggcatcggctcggggggactgcccccgaaaaaaaaaaattgatttttttcaggggccgtttgggggactcaaacaattatggggaggaaaaaccaaccccgaaataaaggaaagggtatagggaagtttttcccgaaagatttgtctccccctaaatctgggggattcggttcggggggattgccccaaaaaaaaaaaaaaaatgaatttttttaaggggtccggtttgggggactccaaaaaattatgggggaggaaaaaatccaacccaaaaattaaaagaaaagggtt

SEQ ID NO: 25092 - DNA, 1898 bp, Heterodera glycines
tttccctgaaattgagagggattttaaaggaaaatttaataataaaattattaatggcctaattgtaagtaccgcgttaatctgctggatacacatgtccgcatcacacctaaacaccgaatttaaacaagattagcaattttaccttcaccatgaaggatgtttggaaaatttcttgcgccatgcttttgagaaatcggccgggtcatttttgccaaccaaatgtttgtctaacaactgaaaatgcaaaattaaaacagaattttaatttgaaggctctaagaatttgtctaatttccgagcttcgaccactaccacctcggaacactaacattcaaatgacagcaatgagaagaaagggccgaatgatagttttggtcaaaggtctccaaactccacacactaaggtccgtccgtttcattttcctcatgccttccatctcatgactttggcacgacctctttgtccctttgctcatccgcctttcttcaacatttttttgccgttgttcggattgaacgaaaagaatttggcattcgtttgcctccgcaaaagtaatgggttcatggcactcagaaccacagttggaaacaaatcgtcggaaataggcgtgggaatttattttgtgggttggatttggcgaaaatgccaaagaattatgcacgtaaatggaaaagcaaatttaaaaataaattttgaaaatagaattggacaacaaattaaaaaacggatttttgggatgccaaattttggcaattcaatcaatccaaagcatttgtagaattttgctattattagtcactacgtttgcgctttcctttagtcccttattttaacattttgtgtattattttggtgcttatttccaagaataagtaatggtctgagcagttttttttagaaaaacaatattttaaatcggtaacggtgataagtaaaattaaagcccggactcttctgtaagttggtaatttgctcattttcccaaatcacctttttgaaattggcgctgtttttgcgccttcggcagtccgttggcgttccgtttccctccaatgaatggaccttcatcatccctttcctttttctctctctctctggtgtgaatctgaaaaatgtaacatattattgggctgacaattttggagaatggattagtgagtcaatcggaaggcggaaacaattcctgacgccttttgtttggttgggcaaataaataagggcataaaatggggtggcggggggaggtcaagcgaataaattggggaaaagccgattttgggaattgggcggcgaatttgcaagaaaaagcaacagcaaagagaacttacagcagcaaaaggtactcaaaattggccactaattataaggaaaagttgcgcaaattgcttcagacggattcacttcacagaaaataattcagagaaaggggcgacccatcggacgaccatttccaaatttgaagcttcaaatggtgcgcagcgcaaatatcccacttttctgtgcttcacagcttccgcattgaatgaatttgctgttggattttgttgctgctatggaaaaatgggcagaagcattgatttttttgattttttcattttggtggatttctttttttctgatcgattatcaaaaatatttgcattttttgggtctctaaaaatgtttaaatgaattgttttgtttctgtttttgcttatgcgtctttcttttaccaaatgggtttaccattgctcttctcgatgttcgccaacaattcttttgctttccgctgggaatgctttttattttttgcaaggataggcggctcaaacatcggatgcatgggttttggaggtttttgtgaagaatcagcagcaatggagctgattgtgaggggagggggggggggaggagg

SEQ ID NO: 25093 - DNA, 914 bp, Heterodera glycines
gttttgaccgggaaactcccgggttttttcccggttttcccagccagaaattcccgggttttcaacccgaaaagtcccggtcccggtttagctcaaaaaattttttactttttgtaatttttgctaaattttaataaaattatgataattggaggggatgtaaagctatcgctcaataccaagattgattaattctaccaagttttgagctaaattatgatatattatttggcaaataaaattaaaattaaatttaaatatttcaatcattgatactttttgtaacttcgcccaaattgatatttttgaaatttcggctcacaacgattcttgtttgtgttacactatctgtattcatttttctcttgggtgtgatgccagaaggaacggagtgtgtgagaaagtgggataaaggacctgaaagaaccgctaaaaggggcgcctgtagctcagttggttggagcacggcacgggttactggggtcgtgggttcgagtcccaccgggcgagttaccttttattttctacatgggttcttttccgtttgacaactcactagttttttaactttttgcaataaatactatgcaataaaagttttcgaaacaaaaaaaaaatttcaattataattcagtgtcatggaatgcagacattacatataaattaaaatattaattttgattttatccaaaaattctaaaaaaattataattgttgtggcaaaatttgttagcatcataaaaataaaactttatacatgtaagtaatatactctcacaagtttacttaatcaagaaatattttcaaccgaaaaatttttctaatatttatgttatgaaaaaaaatgctaatggtgcagtaatttcacttaaaagttgacgaacaccgacccgaccgatttggtccaccctaac

SEQ ID NO: 25094 - DNA, 473 bp, Heterodera glycines
agaaaaatgggaagaaaaaaaaagaaacgaacaacaggagaaaagagaaataattggaaaatttaataagataaaagagaaaattaagcaaaaagaaataaaatattcgaaaagagaatggggaaaaattgaaagaaaaatagcgaaaaaattggacacaaatcgccgatatatttatgaatggatcaaagaattgggattaaatcaaaagaattgctacaaaacgattagtgatgagcaaaaatttgaaattattcaaaaattcattaaaatgacaaatgaatataagtaaaaaggaagaaaatattcgaataaacaatggcaacaaaattatgccgaaatttgtaagaaaatcggagttaaaccattcaataattagttaaaatggaggaaacaatttggaatgaggaaatttttaacggaagaagaaaaaattggaaaaatgaaaatttattggcaattaaaaaaagaaa

SEQ ID NO: 25095 - DNA, 2802 bp, Heterodera glycines
  misc_feature (19)..(19): n is a, c, g, or t
  misc_feature (1859)..(1859): n is a, c, g, or t
  misc_feature (1871)..(1871): n is a, c, g, or t
  misc_feature (1919)..(1919): n is a, c, g, or t
  misc_feature (1993)..(1993): n is a, c, g, or t
caactgaaatttaattaantcgaaaactattgaaaagatactaattcgaatgaaggaatgttttgggtacaagaggacggtctcgcacccgaagttaatggtagagcgcgactcaattgctttcttcattccgtttttcagggttttggctcagcgacaaggcaggaaaaatgagagagttgaaaagcggaatgccacaacttgacccgtgctgttttccattgctgtatcctaaaggcactgcaggatggcgttggtttatgaagaaggcaggggtgcaggggcgttcggtatataagcaaccatttgttttgtacattttttagtcatttcatctgttaagtgtgccgccgttaagcctgctgaaatgcccgcaacaacaacttgcatcccaaatgacaatgctgacacggtcgaagaacggcaaattgacgaaagagagacccaatttgacctagagactgatatggacagtgagcaggggcgtcattcgaaagtgacgtatgaagttctttattttatgtgtaattttatctgtttttgttaagccaatgattgctccaattgacagtgttttggaacccgtttttggcgtccctccgaagaaacgagaacttggcgtgcggaagcccggacctttggaaaatatttccgagagacaattttaccgctaccgttttgcaatgcgagaaaacagcaggggcgcctttcattggctttggtttgcccgtcgtttggctgaatattttgtcaacgctgttcttaatcgaattgagcgcaatgagatggagcatatcaaggcaatccagcaacggaagaactaccgccaaactcttgctcgagattacatcaaagccattgagcaaggactccagcagcaggggcgcaatgccaaattaggcaatacgtgtaggatccactgtattttgtaaatacttaggaattttaaaaagacacccaataagtaaaagtggtgtttataaattcggttttattcttaaagattaatgaagcaatatctgatgataatgtttcatcatccttacgaattaatgaagtattatcttgccattaaataagagcacatattaaatcattgatttaataataatacaccctatcattttcaataattataatgcttgatgacattaataaaaaatcaataaaacaaaaaaattaccaaaaaataaaacaaaacagagaaaagatttataggaaaataaaacaacgttgtcagagatgaattaaaaaatataaattggttggtttaaaaatatctctttttaaaaaacgttgaggtaaaaaagattctgaaggttctagaacaacatctttaattaagagttgaagaggatattggttatatttaaaatctcttaaaaaacttatgatattctttttttaaaatataaaaaaatattaaaagaaagaataattgttagaatttataaaagaaacaatggatataacaccgaattatctaaatatgtttttgaattagacccttttaattatgaaaaatcattaaaagaggtatgagaccagatatctgaaaatttaattcctggtgtaagtggtgggctacaaatagatatagatggtgaagatattcttagaaaatacaaaattattgagtaaaaataaattaaattatataagctaattaatgaatcctcaaaattttcaaaaaccaaaatcaatttttttaaattttatttgaaaaaattttatgtaaaaattcgcaaattcccattacgaattaaacatacttttagtatctttcatcggtttaatagtgctcaatcagcatgtaaaaaattgaattaggcttggatcaaacgagaaaaaaaattcancaggcatactcnccgttacaggactaacttaacctgaaaacatttcaacgcttattagtnttatttaaaatttttttttaaatttttagttttccattatctttttattgcaaaattaatgcttaaatattttntaagaaaggtgctctgaaatacaccaaactttgcagcgtaacagctgagaacaatgcttatttataattaattttccagcccatatggtttcattacaaaattttttggattttcaaattttctatttttttgctttttttaaatcagtgaataaaattgtttgccgccaaagatgatcaaagtttcgaaaaatttataaaatgacaaaattttaaaaatataaaatatatgataaactcattaaactttttaaaatgaacagcaaccaattctctattaaatagaatcataaagataaattaaaataactgaaatatgttaggtggaataacattttgaaaaaaattcaaaaaaattcatcatctgtcgaacggatccgaacccatgacaaatggtcattaaaaattaagaggataaattaattaaattaacaattcccacactccgcttccttcttctggcatcacactcgagctaacctgaatttgttaaaaaagaccgatttttaattgcctttttttactattttatcttttttttattctaaaatttttctttgcgaataaatcctgacaaaaatgtaaaaatattgattattaaatcaataccaattgagatttataaaaaatttattcctatgcctattgtttggcaattgattcacataaaaattataaatgcataattttcctatatattatattttattttaaaaaatataaaatgaaaattgtacaattctctatttttctatttattcttgtcatctttgacataattaaactatcggaacaaagaggagcaggta

SEQ ID NO: 25096 - DNA, 1093 bp, Heterodera glycines
agaaaataggcacttaactcgaaaagtagcttaacaacagcccaaaaaaacatgtttttcgtgcgtttcaggccacggggagctcaggaaaaaatagacttttgcctaaaaatattagccctatttgccaccgaaatgtttgtccactaaaacattgaaacgtggcgaaagaagtgccaatttgaggccgagttgaggacgacgaaaaagggggcaaaatgtccatccaaatgtcgttgcaaatccaactgaaatccggggaaaaaaataattgagcggtcttaaattcttaatttttaaccctaaaatttctcacattttcctcaaaatttgtttcagaatcgacccaaaaaatttcgaaaaaatacaccccaaaaaatcgacccttaaatcccaaaaatttcgaaatgacttcatttgtaactgcaatcaatgaataaaattgcttgccttaatttgaaattatcttcatataaaaaagattttatttaaaaaaattatacccttaaattttgaacttttttggccttatttacagccttattttcgactttttcgcccttcaaaatcatggacggacgttccataaaaaattttaaatttaactaatttactgaaaatttccccaaaatttacccactcgaaaatgtgcctattagttttgtctccgattatttacccaggcggcagatttatttcagctatttaatattctcggataggatccatcccgaagtgcatcaaattgtcactttaattgttttcccccgggcaaaattcgcaattaattaaacaactatttgacactaattagtttttacatccctcgcacaacaaacatatgttatctctataagcaactgaataacgcattctctccgtccatgtgaccatttaaaaaaatattttaccaatttatttactttgtttttcattttaattgaagcaaattaaacctaatcaagaaattaatggacttttcatttattgggtgttatccaaaaaagtatacatcataaattaactatgctttttatattcgattcagatttttttaatacgaatttccgccggtggtgccttttatcaccgc

SEQ ID NO: 25097 - DNA, 1037 bp, Heterodera glycines
atcggtttcggggggactggccccgaaaaacaaaaaaatctattttttcaagtgtccgtttgggggactcaaacatttatggggagcaaaaatccaccgcagaataaagttcagactataggaaagctatcccgaaaggattcggtctccccataaatctgggcgcatcggttcggggggactgccccagaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaacaaaaaaatcgattttttcaag

SEQ ID NO: 25098 - DNA, 1143 bp, Heterodera glycines
aaatgcatttgcatgcccacgaccaaacgcagcagctaaaccagcagaaagtgccggacagaccgtcgcttctgttttggggggaggagtcaccgtccgccggggccgacgccgtttcgtccgtcccttttcaccactccgatggcattttagccgcttctcttcccgaaacagcgaacgaagcgacacatttccacgttttcagtgccaaccaatgaccgaatcgtaaaacgaccaatttttcggtgttctttcctttggggcggaccaacaaaaagccacacattccatggcatttaggtgcttaaaagtgccaccttccccttttgccggtctctccccccatttcctctgattggtccctcatgtgattgatcgtctcctcaatttcacattgcctcaacatttccatgtgaatttccgattcattttcttagtcaggaagtttcacaatttctttttttggccacaactccgcgaccaacaaaaacctgtgaaatcgaaatttctttacgcactttgtctcacattgaactgcctcgaacccatttacttattttgatgactttattattttattgaaacagcagaaatgataaatttataaatataaatagccgtaaattgtatcaacaaattcgaccccccccccgcaaattcatttgcacgacaaatgcaagcagttcttctgttcagtggctatcattggcgaaaattctctcagtcttttgccacagcgcgcgcattgaaaattaatggtgtaaaggcgcgcaagtgagctgaaaaagagttgaaacactttgaagctgacgtttgggttgttcgccagaaatttggtcacctgaaaaacaaacaaaaataaaataataattgaagtgaaagttcggcactgaccacattgccaaacgcagtgaatttgtgataaagttcgtatctgctcggcacgctaagatcgacctgtaaaaatgaaaggaattcaaaaagtatgttttttcactttaatagtgccattgcgtgccctatttatctcttttttgtcattctttgcctgttttttggtgccaaaccgcggcatttggctgaagtgacattcctcgtggggcgccacaaaatgaacgtattcaatgagtccgttgttcacca

SEQ ID NO: 25099 - DNA, 2181 bp, Heterodera glycines
  misc_feature (53)..(53): n is a, c, g, or t
aagcagagacctaaaaagaatctgaaaaaagcaatatttctatgttcgtaaantttgcgaattttggaaatagggaatttcgaatcaaattaaaatattttgagcatgatcctaaatttcaatagttggaagcatggtttgtaataccatattatggtattatttagaatgaatgatttttgtaaatttcccagcagatgaaagatctaaccattgtgccaatcccactgccatagtttaccttcttgcgtttggcgtttccgcttccaatcacaaagtgccttattcaagaccgatttttttgcctccgtttcttcaacttctccaagatattgaagagctcgatttctgtaaaattgtttgtcctcaatcgctttttcattgcttctttgagttgttgctgtttgatggcttcttcttgtgcttcttctttttgactcctttcttctttgagttgttttgcctggtgttaaatttggaaagtcttgaaaaaatttaattaattgtaagcttaattggtcaatattttggagcaccttagccctgacatcttttgaaaatccttccgcttttctttctgcatgaaattttgcttcattactgagcaaaaatttcttccgttttctttctacttataactttttcctcttcatagcactttttcacatttttcggagagatttcgctggaattcaaagatggcattttgtaatttagaagttttttttaatgaaaattaaataaatttactaaaaaaagaacagattggagcaattttttaataataaagattattatcgcaaactaattaatttgaattgaccaaaaaatggttcgcatataataaaagagaaacattgatttgggaaaggaaaatgaagaaattcatttcatttgggtgttgtcataattaaatgacgaggattatgtgcctgtgtcattcaccgatggcaaattatcattcaaatttttcaaaaaaatgatttcttgctcaaatatgcaattattgctttaaataatttttaatttcattatattatttgaactttgtatcttttcattgtcagatgaaaatgtgcgcactttcaagggttaggcatttaagtcatgagcttaccacaaagttgaaatgattttgtaaatgtcaaaatgtaaaactttgcaaaaaaataaaacaacgatctgcttaaaattcaaaatttttcaatcacttataaattttttgaaaatatccatttttaaagcatgaaaaatcaaatcatggcagtgccgagggaattttcaacttgtaaaaaggtgcgattttatgaaatttatatgagattttgcagactgattgtcattgtattaacgtatttttcaagtcattctgactactaaaaacaatttaaaaaatcaatttttcataatatgatttaaattcccaaccctgccggtcgcgacattggtttttgttgcaactcgggttaggaactcggaattggttttctaatggatgattagtgcacccgaaacacaccggaattgcaaaccaaaaggacgaccccacctaatttatttttttcatgattttcaaaaaaaaatttgaaatgaataggaaacaaattttgtaaagggcatacattattacggagacccattatttctaagaagggaaaacttttcaaaaaatcaattaatgtgggtgaatttattaataaaaaattagagaccgggcaagagggtcggtcgaacggtttcggttaaaaaccgaaaccgaaaaaaaccgaaaaactcaaaaaattctcggtcgaacggtttcggttaaaaaaccgaaaaaaaccgaaccgaaaaaaaccgaagaaaaattttcggtataccgtttcggtttcggtttttttttgaatttttatattttttccaaaaaaagcaataaaacatttttattaacagaaaaagctaaagatcacctctgaactaaattgtaaagctattgaagctctattgaatggtgtactaaagtttggaaaatgatagaaaaggcagtcaaaaaacatgtgtttgctccttgattctaaaaaaaccacaaagatttagcgatttggtgccctttttgacgttttttttccgaaaaattccaaaattcaaaaaaatcggaaaaatacacccctaagaaatgatctaaaaaaattcagagaatat

SEQ ID NO: 25100 - DNA, 2290 bp, Heterodera glycines
  misc_feature (1456)..(1456): n is a, c, g, or t
  misc_feature (2268)..(2268): n is a, c, g, or t
  misc_feature (2278)..(2278): n is a, c, g, or t
tcctccgctgtcgcatgagtctgatgagtttgttcatgaacatcggcgcagttcaagttagccgtttcttttttaaagcttgttaccattaaactgtttctagggcctaattgccatgccaattcctcccagggaaaatgcgccgcagaatcagcaccatccatagccacgaactgagccaatttcggacttgcccattgaattggtggccttaaactctcaaaatttgatttgtccttgtagcttattcacaagctcatccactgaatataccttcttggttcgggtgccaataaatttccgctagttcgaatatatttgttaaattacatcgtcctttaatattggtgaacatgctctcatttatcagctcatctggaaattttttgaaactgctgagtaaaccgaaattattcgttcatttatgctcgttatgtgaaatcgcaaatgacacgtcaggggagccgggggcaatactttagatggtgggccctcttttttgaaaaaatttctttttgttctaaaaagtcgcaaacatgtttatgtgggttttcagggtcggagaacccgaatacaacattcattttgaccaatttcgaatccctgacccgaattcgaacaaaaagtcgaacaaaattttcaattcaaagttctcactctggtttctaattgatcaaaataagctaaatttaatcaaaaagcattgcaacatcataaaatggtcaatatgtatagatacgaacataacaatgaattttgaattttctactttttgttcaaatgggattcgaaattggtcaaagaatgctggattcgagttccccgacccaggaaacccaaatatacatttcacgactttttagaacaaaaattttttgcaaaaaatggggtccaccatctatagtattaccgagttctataataaattgaattcgggtccgggattagaaggtcgaaatggttattatattcgtgatcagcgaccccgaaaatcacatttcgtcaaattgtcgagcaatttttaatgaaaacaaatggccgaataactatcaattcttctaatttttttaaaacaagattgacgggaagcgtttgatttagtcggaacagaacgaaaacgaatcaatcattcattccgttcgcatttttcgccctttcccatttcatcagtttgtaatttcttttattcgtcaaaagtaattttaatcattttgttgtccaaaaactctatatttaaattcacaattattatttttaaatttaaataaaaattaataatttattcattgtccttcgtttatttgcttttgtttcagttgggttgattaaatttaaatatcattagcactcaattaatctccaatggcttgctgtggtggcaaatggttgttctgttgttgctgtcacgtgacaaaggcaaaaatcccttttcaatttctttatgacgaagacaatntaaaattaattatttataaatttaattattttctccaaatatgtattaattaggctgcgcatattatggcatggctctctttgctttgggctctttttgccggcactttgtcttttgtctttgtgccattattcagcacgttttctttggtggtatgtttttttcattgtttatacttttttattattttcatattccaaattttttagtccgtttttctcgctttggtcaccaatttgccaataattgtgttcgatttgcttgggaaacggtcccatcgcatttatttgccattccttctgattaatgtgggacttcgaattaattaaaaataacaattaatttcacttccttcagggcatttgtattcttttcggtctttcgcacattgtttatctcattttgcactcagttttcatgtttaaagtgcctcacttctttgagagtaaaatatttacttttaaaattaatcaaatttaaaagtaaaatgcaaatggttcttttttattcggcattcatttaagtgcaccaaaaaaatgaaattagagttaaagctgaggctattcaaaaattgactaatgccaatttttggagcggagggaggggaaggaaatgcaaggtttgacgaagtacgagaaagtgcaagtgatcaaattaaagcataataattctttaaaaattaaaagcaaaacaattattttaattaaatttaataatttattatatttggaatttatataattaattaaaaataatgaagcttcagcccactacgcgtataattaatataaaattttacttagttcgcgaantattttaaantagtgacctgca

SEQ ID NO: 25101 - DNA, 1185 bp, Heterodera glycines
attaccctaagagctgctgaaatgtgaaattaattctcagaaaaatggttatctctttttaggacaattttctatctcgtaaccccgatgctaatccgttccggagagcctcttcaaaattttttccattaccctaagagctgctgaaattgtgaattaattctcagaaaaatggctatctctttttaggacaattttctatctcgtaaccccgatgctaatccgttcctgagagcctcttcaaaattttttccattaccgtaagagctgcggaaattgtgaattaattctcagaaaaatggttatctctttttaggacaattttctatctcgtaaccccgatgctaatccgttccggagagcctcttcaaaattttttccattaccctaagagctgcagaaattgtgaattaattctcagaaaaatggctatctctttttaagacaattttctatctcgtaaccccgatgctaaatggttatctctttttaggacaattttctatctcgtaaccccgatgctaatccgttccggagagcctcttcaaaattttttccattaccctaagagctgcggaaattgtgaattaattctcagaaaaatggctatctctttttaagacaattttctatctcgtaaccccgatgctaaatggttatctctttttaggacaattttctatctcgtaaccccgatgctaattcgttccggagagcctcttcaaaattttttccattaccctaagagctgcggaaattgtgaattaattctcagaaaaatggctatctctttttaagacaattttctatctcgtaaccccgatgctaatctgttccggagagcctcttcaaaattttttccattaccctaagagctgcgaaattgtgaattaattctcagaaaaatggttatctctttttaggacaattttctatctcgtaaccccgatgctaatccgttcctgagagcctcttcaaaattttttccattaccgtaagagctgcggaaattgtgaattaattctcagaaaaatggctatctctttttaagacaattttctatctcgtaaccccgatgctaaatggttatctctttttaagacaattttctatctcgtaaccccgatgctaatctgttccggagagcctcttcaaaattttttccattaccctaagagctgcgaa

SEQ ID NO: 25102 - DNA, 427 bp, Heterodera glycines
cttcatattgttttaaaagtaaagggcataattatagtaggacagtcggtaattagccacaaggttattttgataaaaatttccaatttttatattttaatttatgtttttattatgtaatttttcaacaaaaaagagtagaaatcaaatccaattttttttaaaaaagctcatctcctaaatttattttcttcccaaaaaatttagatttcgaaaattattttcaaaactgaattcattttattcaggatcaggaataaggaattgaacatggacaggattttgtgcgtaattttgtccaaattagctggtgccaaattgtgcgtaggccaatagggacgaagcgaccaatgaacaaaattaattagcatttgcattaaattaaaactttggtgtcattatggatgaaatttttgccaaattgctg

SEQ ID NO: 25103 - DNA, 1841 bp, Heterodera glycines
ccttaaagaaaaatttccttttttttggggaaggaagggaagggaagtattagaaattttccaaggtcattaaccgcatttttttaattgggatttttgatgggaaaagtttgggttaatttaattatgcaattcccttcgtccggaagttcagggatcgatttctccgacaagtcgatgacctccaaccgcaccagtcgcgtcacgacggagggaaatgtgctgaatttgttgttggacgcgttcatttgggtcagcgaattgcacgcggccaatgggtcgggcagttcagtgagctgattgccttcaattttaggaaaattaagtcgggaaaaaataaaaaaattagttttgtaattcttattgttagaaatttactcaattggaaacaaaaaaaaaaaaggcaaaccagaaacatcgagcaattccaatgtcttcaaacagccaatttcgtcgggcaaattggtcagacggttgttggcgatgtacaactgtttgagcatggtgaaagtgccgatagtcgaaggcaattcgcgcaatttgttcgacgacagctccaaaattctgagcaaagaatggacctgaaatttgaaaatttggaccttatttttcatgaaccccaaattatcgaccattttaagtaaaaaatgaattaattacctcctcgacaattcccgacggcactcttttgatgccggcccctttcagttgcaaacttcgacttttcttcgactgttccaaaaggcgtcgtaaggcactcgacgagagatcatttgagccgaattttagcgcggacggcagcgctttttgaaggcgagtcgccggactatccttttttgaggaagacgaagatgacggatgaccctttgagcgatttgagtgttcattgcccataatcagcagacaacaagaacgaaaataaaggaccaataaatggattaaatatctgaaaaatgaaaaatcggacccttttgttgtcagggcaggattgggttcaggaagttttttatcgattaaggtttaaaaaaagataaaaaatgatatgaaaaaaaagtaaaataacgacagatttaaaagattatattgaaaagaaagaatctgtaatcaaaaattttgacggcagccaccaaatgtctttaaaaacattttggtacaaaaataaaaattatcttgaaatttataattattttctcatttcgcacaatcagaaaagtctgcggcgtgtcgcagtaaaacgctgttcgtacgcgtcgtagccgggaagtgcctaaaaagcacgcgatttgatgagcaaatgaatgacaaaacaattttaaaatatttagccaaccatacatgtgcaaggggtgtctcaggccaagggccgtacgattgagccaggcggtgtctcgggaccgatttttcatacgaaggtccaaaattttctcagacgacgacattttttttttgttgctattcataccaaatttttctggcgatctttttttgtattcaggcaccttttttttgcggcgcgttttttccaaaaaacttttggggaagggggtggcgggcggtccggcggtgccgataggctttgcatggatttcgctaacaagggaaccacccgaactgtaagtcggaaagtgcataggtatgtgtgatataccattcgatagagcagggtcgccttctattggaaatttttaatattacgcccccataggagggaatcaaaaagttatgaggcctcaaaaacgaaattttaggcctaagggccgatttcaagctttttttactttctattaattcccaatcttgatactagtatttattatcatttttgcttatttttactaaag

SEQ ID NO: 25104 - DNA, 1402 bp, Heterodera glycines
  misc_feature (85)..(85): n is a, c, g, or t
  misc_feature (1316)..(1316): n is a, c, g, or t
  misc_feature (1367)..(1368): n is a, c, g, or t
cgaaaattttttattttggtgtaaaattgtttaaaaattttaacaaaatttccgaaatttgcaggagtagtctttcagagccgcntaagccaaaatcctccaaaatctttttcaatccaaaaaatttgtctaaaaaattgatcagaatggcacaaataaaatatcagaaataaaaataggaactttgagataccttttttcccatttttgttatcttacaaatataattgtcacactgtccaaacttttaacggcactttgaaaaatatttttcttttatttaaaaaatattaaaaattttaattccaccggatttgtttcaagaaaaatcaaatttttcacttacataccctaacttttttgtttttcaagaaattgagcaaatttgttttcaatacgatctatgtgactgcattatgcccttgcgacgtttcgcaaaaccaaaacttggtccatttttggatgattttgccggcctttggctgttggcggcggacatttggcgccaaatcccaaccaaaggattataatggaaaaataattagtctgagctatattaaccaatgccaattcatcgaacccagcaccatcttcctgcttgcataagacaaaaaaagcgacttaatgagccaaggcctaatgatcacaacacgtcgcctctttccaaagacagccaaaaattgcaattaatttgactaattaatattcataacgattgattggcagcagtttggatgacttaaatcacatctcttttctaaccaaaaagccataaaataattaaaagaccttgatattcatagctgaaaagaacttaagagagaaatttcttcattcatgcaaaaaataataaaatcattgagtttgagtaagtctgaaaagcttaaagtttacggtagtacagtcatggtcaaaagtgttgtcccatccttccttgaaagatattataggaaataaaattgtaattttttgttttcaaaaaaaattcctggggggttggtaaaagttttttacaaaaaattattatgtcgttcctaaagagcacaaaaatctacatatgcaagcaaattaaatattactaatgattaagaaatataagaaaattgattaaaaaacaaatatttcagagttttattaacaaaatttattaaaacaaaattcatattattcaatagcaaaaaataataaataatcgaatatcgaataagataaagaaataaaataataaatgatattttttgttttatgcaattaaaagatttatttaattattaatttattaacttaaaaaataattatgcttaataagtaataantgaaacatgttctgaagtttccctatatgaggaactttataatttcataanntataatataaataataatatataaataaattaaa

SEQ ID NO: 25105 - DNA, 1880 bp, Heterodera glycines
  misc_feature (51)..(53): n is a, c, g, or t
  misc_feature (56)..(56): n is a, c, g, or t
  misc_feature (59)..(59): n is a, c, g, or t
  misc_feature (90)..(90): n is a, c, g, or t
  misc_feature (93)..(93): n is a, c, g, or t
  misc_feature (103)..(103): n is a, c, g, or t
  misc_feature (107)..(107): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (119)..(119): n is a, c, g, or t
  misc_feature (130)..(130): n is a, c, g, or t
  misc_feature (134)..(134): n is a, c, g, or t
  misc_feature (138)..(138): n is a, c, g, or t
gcggcactatttgatctgataaagaatgggacccccttaaaagcaggaaannnaancanccagggcccgacggaggcttatgcaggaggngangggagaaggngacncacnggngangngagacaaaaancgancaanaagcacagacacttctatttaaagtccgtttgtcatttctctttgttccaataaaataaaaatgtattcaaaaaaatttgcccaaattttgttctttctccgagtttctcttcccgttgtttcatcaacattgcgacaacaacaacaacaacaaccggaaaatacctactctgcttacctaaaaaatttgactttgtctcgacaacaatatgaaccacactattcatactctgaatatttaaggagactgtctttattcaaacgtaccaccaacaccattctcagtacaacaactgtcccattaacaactacctcgaacataaacacccatccaaaaagcgacaagttaattgatgagcatgtttctgctgttcttccaccgcttatccaaatgtgtaaggagcagcctgaggaaagcagcatttttcatcaagctatttgctgggccatcttcactctctatttaatgcttatcatcagtcttgtgctacaccaactctgttcaattttttggttgaagaatggacagcgtgcaaataacaaagattttgaacgaaaattgtcggacagagcgagcatttcggggctgctacgccagtgaccaattgccgcctccctctacactacagtaccccgcagcgctcgttgtgaaccgggacccccaccataagaagggctctcattggtgcgctatttatgcaaagggattggatgcaccagtgttctattttgacagccttgctcagccaatcccagccgctgttacgtcaacttttttgtgcaaattcccggagggactgaggaagaattcttacccctaccaatcctctttactgtctacttgtggtgcccattgcattgttttcatttaccatatgtccgtgggatattcatttgagcaatttctcactacacttagcaattgtacaagtcctgatatgtacacattagttgtatttaacaaaatattaaataaataaaaatgttttataacttgaaattgtttattcaattacgaaaaaaaacttattcgattgaaaaattaaaatagtaggaaccagggtgttgagttgtttcaataatcatcaaataaccaacatctcctttgtgatgcggattcatcaatcggtaaagttccatcccatcggcgcggaccagttgaccaaggccatgtgacgccatttctgttaccgggaattggagaagccgcggaaaatgctgccgcatcaaataaccgcctgcagtccgcttcttcatggtcagcgggtttgcgcttcccaagacataaatcagaattgcgccgaacagctctccaattttaattggctaaatattaataatatttcttatatttgtttgttttcttaccatggaataagtcacgactctcgtcgtagcggtggggccagatcgtccaaaagatagatacgccaaaaagtcggcgaaatatttggcgtcttccagttcatcttcgaacccgaactggatgaacccgaactggatgaacaattcgccacacggtaacttccttagtgcgcagagcctctcgaaatttcgagcaagattgatctaaaaattcagatttattataattttaaatattaccaactatatttaagaagtaaagatgccgcttggcccgaaaaatttcgaacatttggaagataaccactattccagacggtggacgagtagtacctagggggatttcaaattaaaaaatatttaaaaaaaatacctgg

SEQ ID NO: 25106 - DNA, 1060 bp, Heterodera glycines
  misc_feature (1042)..(1042): n is a, c, g, or t
gtccatcactaagcactagggaatagttggacaggacgcagccacgccttggtttttattcttacggacaccactcgtatagtccaccactaagcactagggaatagttggacaggacgcagccacgccttggcttttattcttacggacaccactcgctagtccatcactaagcactagggaatagttggacatgacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacaggacgcagccacgccttggcttttattcttacggacaccactcgctagtccatcactaagcactagggaatagttggacatgacgcagccacgccttggcttttattcttacggacaccactcgctagtccatcactaagcactagggaatagttggacatgacgcagccacgccttggctttatttctacggacaccactcgctagntcatcactaagcactagg

SEQ ID NO: 25107 - DNA, 2278 bp, Heterodera glycines
tcaaaaagcaaaagcaccaaccttagcattactttttgtcatgcaatataaacaataaataaatataattatttacaaaatttagggatcaaattcaacacggaaaaggtccaacacattctgaagaatcccggcgtggtccatgccatcgttgagaaggttggttttttataaaccactaaccatgaaatttgaggctgtattctttcacaattccgcgagttttttcacataaattttcataaaaatcatttaaattgacacaaattgtaaattttccgattattttttattgacaattttattaatcaaaaattttacagtccgctgtcaagggcactgacactgtgctcgaggttggcccaggcaccggcaatttgtccatgaaattgttggaccgtgccggccgtctgattgcctacgaattggaccctaaaatggtggcagagctgcagaaacgtgtggtcggaacgtatgcatagatttttaaatataaattattatttttttttttgcacattcatgctgactgaccattggcttggtaaatcaataggtttttggcctaaaaaggactccgaatttgggggacgggacaaaatttcgctgcaaaatcagcgatttttctcaaaattcatatgaattagtaagtttttcgaaaaattttccaaaaaatcgctaaaaaattttcaaaaaatttttcgttggaatttttatacaagaaaaaaaattttgaaatttgaaaattaaaaaacaaagtttctttggcgaaattatgtcccggcgaaattttggggtgcaccccgaatttgatgagttttttgggcggctacttaaactgaaagactaaattggtgccaattaaaggcgcgaaatttcagtttcgaaaaatctccggatttttgagtttgattttcgagtttaggtgtcgttgatgccaagtgtttatcttgagaaatcaagaaaaatgatttaagattaatatttttgcttttttaaagacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtgtgtttaaaatttgaacaattttttttaattcaataattcttaaaaaaatttccacggcacgtatattatattggcacccggatcaagtcatccctcctcctcctcctccgtcgtgttgaaaaaaattgtccatttacattgcacaactttttcgcaaaaacttcgtttcacctttgacaaaaaaatcacataccccccccccccccccgctccatcgtcattcatcatgttgcaggtacgccgtgctgatgctgcagaaggaattcgccgatcgactgttggccaagccgggcagtaaggtatacacaaataaaatattaattaatccgaaatgaaattgtctcaaaaatggatgaaatttctcaaaaaaaaaaaaaaaagattgtaaacaacgcctttcggagcgcaccaattagtagaccctcaattttcaggaatgctcaaataattaaaaaatcacacaattttttaattatcaaaacaaaaaattttgtcccaaacaggtgtattgtcggctgtccgtttctgttcaattattggccaccgttgagcatctgatgcgtgtgaagcgttccgaatttgtgccacctccaaaggtggactcggccgtcattcgcattcagccgcgcaatccgccgccggccatcaattacaaggcaaacgaaaacaaaaaatggatttttttttaaaatttttgtttctaatttaaatctctaatttttagagcctggacgggatcgggatcccgcagggattgtccctagatcctggccccggggcttttttatgaaaaatttctagcatagacatttttttcggggggggggggggagacgacctcctccgcccaccttcgtttataatttttaattgtatttatttgtttttgttcccaattaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaggggaaaggtaaggggcaacaacaacaaaaaaaatgttgttggcgctaggcactttgtaaaaatattaaaaatttcatggtcattaatttctggttctgaaatttt

SEQ ID NO: 25108 - DNA, 1380 bp, Heterodera glycines
  misc_feature (1365)..(1365): n is a, c, g, or t
ctgttgcctatgttttgatgcaatttgcggggggccccttaaggggagacggatgagggcagcaggcggcgattaatttttgacaatgaaaagagggaggcgggggccgggccggggaggcgggaaacctcaaaatgaacacattgcccccattcatttattgactcagtcggtggactgacggacgacggccagcagtgcagtgaggacactgattgatggttggatgatccaaatccaaattgatggtcaaaccaaaagaatttgtccaaatctacgccatatcccttattgagagcattcattgcttaaaaatcgcattatttcttcacccatttgctcgggtactgtaaggcggaagaagtgttttctcctcatataattgacatcgggaaaatccatatatttttttgaggcgccgtcgccaaaaaattggacacctccgaaacaatttgacggcagcagaattgtagcttttttttaatgactgatgatgatcgaatccaaaaatttcccgagccttaattccaagacccaattcgagaccgagactctcaattctccattggtgttcaattttccggggaccccttattttcccattatgaatttaaaatttgaatccacgatgcgcgcgatccacagggttttcttttttttgtaatccgccgcgccgcaacaatttgaatccgagaccgcgggatttttctgtcaacgctccacccctgcgcttttaccacttaatttgcgtatatgtacacagttgagcgaccttgaaattatgaatggattggtgggtgtccataaatgctttcaaaacactccccgtcctttttcaacatacaaaattcggaagggaaggaggggggaggctatgatgaaaaggctgttcaaacaagtcggcgggtttgtttcacatccaccaccaccaccaaccaatcgtcgtcagcagttccaccatttccccatatataataatattattacccacctacctacccatatatgagtatgtatggtgcggcgcggcagcagcagcaaattgttgccgtgaaattttgaaattggatatttaatgcgtgcgcatggcgcgtcccgccgggggtggttcagtgacgatgcaattttctcaacccaaccaaacactctctcatacgattaataaccatcatcaacatccatcatcttccaagtagtactcgatcaaggaaggaaggatggatgatgatgattagggcagcaacttttagtgacgaaaaatcccgaaatagttaactaaaatagtgagtaaaaatgccaaaatagtgaagaaatagtgacaaaaagtccaaaatagtgacgaatagtgacataattttcagccanaaaaataagcaaaat

SEQ ID NO: 25109 - DNA, 1195 bp, Heterodera glycines
aatttaaataaaaacaaaataaaaaagcgattttatgagcagaaaaagcgcaaatttattgaacgatttgatgaagtgaatgaattatggccaggcaaacagaaagaatttgtgaaggaattgagcatttctgaagacaaatttcgcaaatggaaaaaagaattggcgccaaaatacataaaagtcaaagtaattgaatttatttttaagcaagttaaatgtaattattcaagaaaaccacaccaatgaggacaaattagaaaagaccaagcattattttgaaataaaggaagcaaatccaaaagtgagtgacgaaataattgccaagaaattaagaattggaagaacaattctgaacagatggaaaaaggaatgttgatccacttgttcagtgatttttatttgatcatgattgtgatgaattatagaaggataatttgcaaatttacaaaaagcattttggctgaaattcaaaattgacaattttaatcactaaataaaaaaaatttcaagttttatttatttttttctgtttaaattttcactcgccgcttctccgtctccccctccgccgtcggtcaatccctgcggcattggcacttcgttaacgcaaagcggagggccaaggccaacttcgaaccgataccgtgttttcgtttattatgtcatccgggaaaatgccaacaattttttgtccgcggaagactgaattgatgtgccaagctgagccaattgagtgcatgccattgctccatatttacacaaaatgcgttgcagttcatcgactccgccacaccgagttaatccgtgcccacagggcactccattgatggacgacaaaaatgagccgttgatctgcgggaacagcttggccgcggcggacctcgcactgtttggtttggccccctgacagccgcacatcagtaccaattggagacgggatttcccagctgggatgaggaggatgccgatttgaaagcgggatgacgcgaggaagccggtttacggcataattggtggactttttgcccatcgtaatttcaatctcgaccaattagcaggaaatattaaagtgattactaagtctgatgccccgtttccgtatcgttggtcagagttggccacaaaataatttacacctcatcatcaccaggtgagagaaggaggagagcaagtcaaggcgggagaaacatca

SEQ ID NO: 25110 - DNA, 1447 bp, Heterodera glycines
tttcagcttccttttaaaaaatgtgatcgtttttctccgtcattttcatcgcttttttgccaaatgttcaacagatttattcattgacactgcaaatgttcgcatttcggagtttattatgctcaacatttggccaatgttcaaggacaccatttgtgagatgactttgaattctaccgcttttcgtcaaatgcgccaattggtcccgtcattgctcaacgattgcccagcccttcgccttgttgctttcgatgatggcatttctcacgaatttccgcctgacgacagtgccaatgcgacggatggccaagcggtggccaaatggctgttctcacctcgccatgacaatttgacgaaggcgctcagccttgaaaatttagcagtggagcaacaatggttggcaaccatggaacaaatcaaagcggtgattattacccattaattttctattttttttttgcctttaggcattttccgctgcttcttctcctgtcaatttcgtcatttctgttggcttttcgtcgtcctctccgattgattccgttgtgccatttgaactgaccaacgaattcactcaagagaaattgacactgtcaccggaattggtgaacgtttataggcttatccgttgttcaattgcagcagatgatgagggaaaatggatgaaggaaatgaatgaattggttagcggacaaaagaacaacaaaattggcattttcatcggagacgacggaatcgataatgagtgaacatttaaaaatctgctaattttctcatttcattttgttttttttttattcagtcttctcgacgatttgccggggccgagtggtgatcattgatcagaaacagcaaaaaatgaattgattggatgattttgactgatgcgattatatgtgtcctaaatattgagatcattggtatttaaatgctggagaagtatttgatttgctcatttacaaatcaattaatggtaaactgcttaacaacaaaatcaatgagaaaatggccagaagagttataagaactaatgaatcaacgattaaacgtgaaaaaacagaaaattaatttaaaagtgtaagaaaaaacgaaacaaaagacggttagagagagaagagaatagaggctgaaaaaggagaaaatgaaaaattaatatggaaatgccaaaaaatggtgaacaattaaaaaaatcatacaaatttgaggcaaaattgcgcaacttctgagcccattcatcgggcaaatgaaatggcattttgggagaataaaacaaataattccttccaagaaagcgtgaacaattaactaattccattctcacaattcttttttagcttggcgtattgccatttccgtttttgacccaaatttatgccatttctcatgagaaagtatttcccaccaaaaaatgcttttttgctcttaactttccaccgaaattcaaaaa

SEQ ID NO: 25111 - DNA, 1609 bp, Heterodera glycines
  misc_feature (1508)..(1508): n is a, c, g, or t
tgaagttcatgtgatcttaatagaaaatggataaagacaatgtggttatggtgttaatttgcatacaggatctataaataaattaatattattttaattattaaaaatattttagttatataaatgataaatcgaaatttattaatgctctgataaaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaaattaaggaaatagtaaagttcatgtgatcttgatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaaatcatttgataatggattcaacagaaacggaaaaattagaactttgtggaaaatatattacttacagatttgaaggtttcagacgcggtgtagaatcttaaaaaattaatattatttaaatcttttataagatttacgcgatacaaattaaggaaatagtaaagttcatgtgatcttgatagaaaatggataatgaaaaggtggtttattgaaaaaaatggtgttaattcgagtgcaggttactacaatgtacgagtactttgattatcgatttttttcaatccatattttcggacccccccccgccccatacctattggatgatctttgatcccttcaaccgaaacctattggatggacgtgcgcgaggatttaattaattttaattaatttaaatgcgcgagagctgcgcgactttttccgataaattgtggaaaatcaaaaacatggtcgcggtctcgaaccgttgagagtggaagcgaggagcttaaccacttggccacaggggcagttgaaacgtatgggataattgttgacgttatgatgaaaattccgaaaaattgtgaaaaatcaaaaacatggtagcggactcgaacctctgagagtggaagcgagaagcttaaccacttggccacagggtgagttgaaaggaactggataattgttaactaaatggtgaaaaattttcccctttgcttcaccacaagcgctgcggaggcgggcgtgtggcggtgagagagtgatggtggacgcctctgtttcgatttttcaattaattgattatatgcgcatccctttaccgttgattaaggatatttaagctcctgaacattgcctttttctaattttttcaattttgataaaattttcatcagcaacaaacatccttctcattttataataaatattaattgcttaattatattcgtttttatatattaattttcttatatgaaaaagcatattttcaaatgaaaaaatgcattttaaaattactttaaagttaatgtattanatcactttattacgctactttatattcatttttatttaattcagattttagacctaatccctgatcattttttgtagagtttcgaacaatggttcgacttt

SEQ ID NO: 25112 - DNA, 1552 bp, Heterodera glycines
  misc_feature (24)..(24): n is a, c, g, or t
  misc_feature (64)..(64): n is a, c, g, or t
  misc_feature (106)..(106): n is a, c, g, or t
cttacgagatcagtcagtcaaggnttaggtaactgcaaaaattctgtgacaagtgacggtcttnttatgcgtcctgaaattcgatccgaaaatactgtcaaattgnatgatgttgcttatttacactaaagggtcgcgtggacgatgtcaatggagaagtcattgatccggccaccgggcttggaaagtccattctcgaggcgtacaatatcggctccgttttctccacgttgcgtgccgccatgcgtcttgctgcactgctcgacgttcatccgtcgctttgtcagtgaaagggcgagaatggttgagtcatctataccatcccactttaattgattctcaatttgactttctgtttatttttaaattgattcttactttgacttaaattatctgtttatgttttactgtattcgttgatttattaattttttgcttaaacttgatatggagaagaatgaaatacacctagtaacaggcaccgtatatttactgtatgcgctcattacctttttttagtaccttatttttgaaaaaaagaattcaatgatcagttacaacaaaacgaaagccaatgagaataatcctgcgggaaaaaatgatggagatggattggcatttatacgaaaacactttcgccacaaaaaaatattaaaaaaaaatttattcaaaattaaataaatttaccgatagtttgggtcttatttttgataaagtttatcattagagccttgaaaattcgccattttaattccctatatattttaagcgatcaatttgtgttatggacaaacatttcgttagaagaaaaccaattacaataattttttttgttctccatcgcggaaaatttctaatacgaaaagatgaaattttggtgaaattaaaaaataaaaattttttttttttttttttgtaaatgttcgggtcattttcaactccttcattatggcacagcatcgatttttgttgacggatctgctgttgtatgcgagcgaaatgaacactgacaagcccgaattttaaaatgaacggactcggggacatggaaaatggatcggacggatacattttgtcaaaatattaattttccaaatattgagcaatagcactggcgaaatttatgcacgtctaggcgggtccaggaccaggctttggaagtggatcgggatggattgtcggatccctgttttaccgtgcagcccggtcccggtggtttggcaaaaaaatacaggaccgggcggcccggtaaaagcccaccgagcctccaggcttaatttattttaccgaatgtacataaatatgtaggaaaaaaatcccgaaatatgtacaaaaaactatgtaccaaacaaataaaaattcttaaatggttattttttgggaaaaaatttctcgtaaagggtgaaacaggcacaaaatccataaaaatggcttaaaaataggcttagaatctatattaaaaattactttttaatgcctattttgcgattttttaggccctcaatcatcggaacaatgtttttcattttcagagttattctattttttaaaa

SEQ ID NO: 25113 - DNA, 1465 bp, Heterodera glycines
aaacagccaaaacggcaccgggaccccaaaaaaacaaggcgacgccagagcaaagacgaaaaaaaaaaaaacgctcgaaacgaagcaaaagcagaaaacaacacacgccgacaacacacaaaaaacaagcggcaacgccacgccgggagaacagcagcgcgccaaagacagcaagcaggacgaggggccccgacaggagaaaggaaaccaagaaacgcaaagaaagaagcccaccgtgtccttcgacgtatacaacatgcttataatcatgctaccaacaaagcagaaaaattttctttgataaatttgcgagtggtcaacattgtatgttctcacacattcccacaccgaatacccattgttcacctgttgcctgtcctgtacactcgtaaagaatttttttctgtccgttatgacccaacaatattcccagcacttcgatgcaaactctcactgactgataatgatgttcatgcaacttgtattgtttatcattctggcaaagcaattatcactggactcgcctctgttgagcatataaataaggccttttcactattgtcttcattcatcactgataacattgaataaaaaaatgcttttttcgttttttctattccaattttattctgttgtctgctcaatagcgtcaaagagaagtcctgaaccatggggggatacactgaaatcgattgacgacaatgccagagatttcaaatggcctgaccgacacgaaaagggtacatgggcagcagtcgccgcaaccggggaaggctccagggctaaagctgaaaccggtgtcaatcgagaggaaggcagtggtatggaggaggaggaggacagccatattgtaagagcggaagcgttgagtgaacgtgaaggcggtgttgcagttgctgcagccaacaaagggcaaacccaaaagacgagtgatgatgataatgattatcatgatggcgcgcaccagcaagtcgtcgtaatggcacgtggaggtgaagacgcccgtgcaaaagctgaagcaagcggaggtccaagaagtgtcgttgaaacacgaattagtgataaccaacgagggggagaaagattagctttgggttcggccattattcatagacaaggaagaagaagaggaggaggaggaggaggtcgaaacagaaaaccgtcagagaggcaaagaagaacaagggcgaggacgaagaccctattgccaacgataaatttcacccccgcccccccgcaatatatggagctaaacaatcgtcaaaaaggaaattgaacaagtcacactcaacaacaatgtgcacacaatgagccctgtcagttacccatatttgttgagaaaaaaagttgaaagaaattgttttgaacctgctgatttaaccttggctttcagttttgccaatttccttctccacttatcaatttttgactcaaaatgaaaaacttattaaactattgataatta

SEQ ID NO: 25114 - DNA, 1554 bp, Heterodera glycines
  misc_feature (1508)..(1508): n is a, c, g, or t
caagaggtgttgaaaaatagaccatagatgggctctaatccagtaatacggtatttcccccaattttcgtttttccagattcgccaaaaagtttacgaggcaaaagagcccgagaaaattttgactgaaacgcatgccaacaaaacggctgcttcggagttgcaggcaaaggccgagaaagccagccaaagggcagcgtcaatccacagtaaaatgatgaacattgattatataaaaattgaaaataaaacactgaaattatcaccaagatgtcacggtcggcatcaaggagtcgctggacaaggcggaggaggctcagaaacaagcgcagatgacactggacgaagccaatgccagcattgaaaagacaaagtcaccatttacgggagcagctcgccccccccccaccgccgtttccgatttaaatttaaaaaattttttaaggaaaaaaatcagaaattttttttctaagaaaatttcaagaaaaaggaatatacactgggactaaaaatcttttttttccgtgcccctttggcaaagtccaggcggggccctgatcccatccggtctacaattgtgtatatgtaaattgaaaaatttatgtttcttcaggtccaccctttctttgacagaagatgaggtcaaatcattggagttacgtgttgacgaagcaaccgatcgaactcggaaactggtcaacatgactggtgaaaaagcaaccgaaaaataaaattcaatttttcttttttcattttaagaccatctcaaagcggaatacattaaaattatgtccaacacaaaggcagccggccaaagcgccgccggcgcatcggaaattgcggaccaagttgagcaaaaacacaatgctatgaaggtgagaaacaattttaaatgatattgaaaattatttaattgtctataaatcaggtgacggtccccaagattttcgacttgggttttaaggggcgggggggggggggtgggtattacaatgaaatagatcggtctgctgtttagttttatcgcatttggcatggttttttggaatcccaaaaattagttatcaaactctttcccaaattaaattttttttttctttatttttaatttatgaaactcctaatgcctattataattaattttttaatttcagtccacctatgacaaagtgttagctttattggaagagaaagaaggcggaaatgaggagcggaaacagcgggcggaagagttgcgcaagcgcacaaccgaattgttggcaaagattaagcggagtcgggaagagaaaatttgtgagctattttttattaatttattttttgttttttaattttttagccctgattgaacgtgctgattcattagacgtggaactgaacaattttcacacctcaattgaggaactcagtgatcagattgatcaggtgaccagcgaaattgatcgacgcgttgagttccatgccacatgcgatgcctaattaagaattcccatcattttgtttccacgnattgcctattttaatttataattttaaaaaaacgaaaattaatgtt

SEQ ID NO: 25115 - DNA, 2423 bp, Heterodera glycines
  misc_feature (2271)..(2271): n is a, c, g, or t
  misc_feature (2349)..(2349): n is a, c, g, or t
  misc_feature (2358)..(2358): n is a, c, g, or t
  misc_feature (2394)..(2395): n is a, c, g, or t
atcctattaaattattattttgtatggtttccgtaaacattaatgaaaattgtaaaaggaattaatgaaaaacaatctacaaatattccttagtgcaaaaaaccaattaaaatggatttaacgctaggagtgaaaaaataaatattcatgtaaataataaataaaaaataataattataataaatgaaaacaaaatttttaataaagcgaggaaagttagtccaaaaaaatctacatgcattttgacaaattttaataaaaatgaataattaagcaaaaaacaacattaataaagaatacaaaaagttgaacaaagaaaaattttatacaaaacgcaataacgaaaaaatataaccgttgtttctaaaaatctaataaaattctttgtttttaaatgcagttttataagtaattaattttaaaaaataacatttatttcatacaatcaatcactaatttatttctaactttgctttaattaacgacaatgttttcaatggattacgttgtttaaaagtttaacaatatatccaggaatataataaataaatcaaagaaatataacacattcaataaaaagataaaacgcattggttaaattttagcttcctggaaagcaaatattttgaaaaaataattcattttatctaattaggttcttttatatctttattattaattaaaactaaaatcaataaatacaaaatttttaaaaaaatatacccaaattttttaattttttccgggtggcgattgttgtctgcggagccggccccgaaaaaactcctttggctcaaaatatcaaaatttgatgagtttttggacagaatttgttaacaaatagtagttttacaaaaaatactttgaaatcgcataaaaaaattatcgatgttcaaaataaatgaagtcaaaaaataatgacaaccaaactatttattcatttaatattcaagatattaattactaatttttgaatattttaaatatttaatttctattttagtaaatttttaatcgcctttttaacatacagtaaaaaaaaattatattctaaaaacatttataaataataaattaaaacatcaaataaaccatttttatcaatttttatggaaatgaaattaaaccaaagcaaaattattataatcgtatcaacaatggacaaaaatgagaagagagaaagcctcagtccaaaatttcattttaaaatattataccaaatctaataaaataacatatttggtcaaatttaaacaaacaataaattaaatgattataataaaaaaataaaagatttacataattacaataatgaataaaaataaaaatgaattaatattttgcgtctatatacataacaaataatgttttttttgagaaagaatacatgtgtaaataaaaataatatatagaaaaggcaaaaaaaaaaaatcacaagaaaaaattaatcaataaattaattattatggacagaatcaataataaatatttgaaccaagttgagaaaaaaattaactattaattcctaaataaagccttacgaaataagagagaaaacagcatgcaaaaaaaaaaaaacacagagcaccaaatggaacgccaacaatgtgcgaaaaatgacaaaattaattgcaattgacaaaggaatgagcaaaaattagaataacgttttagaatttaaagaacgatttggtctctttttggagaaaaaaacgatttttaggggtacagtttctaaaagaattttttgatttttcataagaaagtttgataaatttttaaaatttgaaaatatatagaaaattgaaatatagtacatatttttgtatttggtttatttaattctaaacccgttaacaaattgattaaaattttcaatttttgctcagcaaaaaaagttaaaatgcagcgaaattaggaaaatgctctgataatcacctttattaataagatgctgatagtttttgaaaaaatccttaacaaaaatgcaataaaaatgaaaaacaaatgaccccaaaaaattgaaatatttaagtttttcgtgttaataattatttttagtagataattttaattatttatattgtttagaagtaaaattcaaagagtaaataaattgtttaccattaatgcccaatattttaaatttttgaagcagtaattcactctgaattttgtgttactgtgtatttttaataaatataggttttttgtaaattaataaaaattagatactgtactataattatattattattaaaaaggcttatnaacgtgtcacacaaaatcccaaaattagtagaataaaaatgaaaataattaaatataaaaatggtaaaaattaatttngtatagatnaaaagagaattaaaacagaaatagaaaaatttattnnatagacaaaaaaaaaatacaatcaaaaa

SEQ ID NO: 25116 - DNA, 1156 bp, Heterodera glycines
ccccacgaggccgcgaagcggccgagtgagtaccttgggcgcagaaaaattattaaggaggagggttcattatttatttatttttttacaaaattaattcataagtatttttacagaaactgctctgaaacgcaccaaaatttatttacaagttgaataaggcactctgactcttatattatcaaaaagggagatgaataaatattttaaaaatttttaattcctttttaaacatgccaaaaagtttaggcttaactttttttatataaactgatcagaagcgcaccagattttgcaagggcatcaaaaagacaaggaaaagcaccgctatgatgctaacaccagtaactcttaatttaaaaatttttattaatttttaaaacttcactattttaaatttttaatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggccctattaagcttcagaaaatctcgcatgaattctcatttttaaattttttatagatttttaaatgtttggattttttttggcttaccaaaacttcatcgaacctggttctttctattctctttcaaatcgccccaaattttttttacagcttaacaaggccctattaaggttattttccgaaaatctcgcatgaattctcatttttaaattttttatagaattttaaaatggttggattttttttgggttaacaaaaattcatcgaaactgggtctttctattttctttcaaatcgcccccaattttttttt

SEQ ID NO: 25117 - DNA, 1464 bp, Heterodera glycines
cgcgcgaacgccgtcagaagaagcggacccctctctgcttttggtggtggcgccgcttttctgtcagattcttctaccatttgtctaaatgcatttcgtatgaaactggtggtccgttgcccacttacacgtcactgtcgtcgagggtttgcaccgaatcatcgtccattcgggcggttcggaattggttgtgagactaaacataaaatctacagactgaatacgataaaattgattgtaattgagaggggtttaaatcatagtataggtacgaggccttgtaaatttctcctcaatttctcacagtttcgtccgtccgtcggtttccattcaccgcgttccctccaatcgctggcgttgtccataaactgttagcaaagtgcgaaattcgtcgtcgtgttccttggctcgtcatcggctgctgctcgtcccacatcacttccccatccccctcttcccttcgtcccgagaagaaaaagtcaatggctctctccaaattccatgcgcatttggacaacagccgacgtgcgctgtcatcgtcagtgcagcctaagagaattaaattggaaaacgatcaattcaacacaaaattgaaccggtgaattctttgaatgattgcaacgcattttcggagtccatgaagaaatggcgagaaaaagaaagtctgtaaaatcagaatcacagctagtaaaggaaaatcgagcaaaagacaaaagaaaaaacatttatgcatcttaattcttaaataattttatcatttttacagtttggcataatgttttaattttgaaaatcttaaacaaaaacctatgtattaaaggtgcttggggcattccggatggtacggaaatatgatttcctaaaatttttggggccgcggaatgccatccctgcttggcatcatcatgtgttttcgacaaaattataaagtgcataatcgttagcatgcttaaaatgcaagtatagaacaagcgagaatttataaaaattggagaaaaatgcttgacaattgttgtagtgactgacacacataattcgatcgtcggctgtaatctgaatgccatcagcaggtgccgcctcaaaatttctcttggataaaaatgaccattgcttttgtttctattggtgagaaggatcaatcatccatgtgtctttggccagacatgtaaaaaagtaacaaaaaaaaatatgcaaaaattcggactttttgtggttttagtgttgcaacttttttataagttgttcaattgcttagcttctaaacatgtagagctttcgactaatagtaaacctaaaatttggtcaacaaagaaaaaagttatgattttggcagttttttacagtaaataccccgatgctttcactttacccgaaaaatttcacaggtggttttgaggtcgttgattacgattctgacagttatttaatgatgtccaaaccttttccccaattgaaaaaccaaat

SEQ ID NO: 25118 - DNA, 1274 bp, Heterodera glycines
aatagggatgcgatttttaggtaagaaaaatcccagaataggtacttaaataggtaaaaaaaactcaaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaataggaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaggtaatagtagaaaaatcccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctagtcgtatgtctcagttttgttgccaaactgctgtttaaaatttcttttcaatttcttccacattgattcgacacgagaaattccgaaacgcttccaacgcagccatattaattaataagctggaaacataaaagagaatgcaaaatatatctttatgcgtcttttcgtgcatttgtattgctttagttgcatgaatgtgaattttgatgaaaaatgaattttcgactttttgttcgaattcgggtccggggttcgggattggtcgaaatggatgtcagattcgtgctcaacgtacctataaacccctagaaacatgtttttaagacttgaaaattttgaaaaatttttcaaaaaaggtgtgataccatctaaaccgaagcgggtcaactccgtccccccaactccgtccaaaaaaacaaaaaaggccacctccgccgcaagaaaaaattcacgaattttttacaaataaatttgagtttatcagaactttatgaatggcagacaaaaaatgagaaattttggctttattaggtcttaagctattctatttgaatctgacgcttgtacaagaactcgtacgattatgctttgtcgcttataggtggaggcggaatttttcgggttttgctgagacgggattttgtcgcgacggaattttg

SEQ ID NO: 25119 - DNA, 1962 bp, Heterodera glycines
  misc_feature (1922)..(1923): n is a, c, g, or t
tttcttggtttatttttaacgcaaaagattaaattaacctttcaaacaggttattaacaaataaatattaaaattaaatttccaagaattgttatattctattttctcatatattaccttccaaatttcctttttttctaatttaaattgaaattaatttaaaaatacaaaaattcaattttctatttttactagcaattaatttcgaatataacttaaatcaaagcaataatttcactacaaaatatatttattaaatagattttcatagtttaaccatttttaatttgcatttctctttcttttctaaaatttgcaaaaaattgtttttgttttcgccaactttccactgtctcacattttcaatgggcttgctaattatgatgatcaacattgtgatcccccccattccgcgaataatttttgttgttctcttatgatcacctcttcatccatcaattctttcattcatttattcaatccccgcgtccatcaccaaactgactgattgtcttttcttcctcgtccttccccaatatcattttgttatttatcaattagcacttcattattattatgattttgattagaataatttgttcagctgaactcggacggggcagtccccccgccctcccccctcttcacgtgcgttccccgctctgacgggcagcggacgatgcattcattcgaaatggcctgatcccgtcgagcggcacgtgtgtgtgctgagtttctcgacaaccgcgggcggagaggcgggcggaggtgggacgacaaaatgtgaagaaaagaggacgacggcgaaaacgacgaccaatttggggacgggggggacagggtggctgataatgacagatactaacaaatgtgatcaaacggcgtagcagcagcagcaaggtcgacaagatgtgatgattaggtatttgaaatggaagggggggggggggggaagagggaggggtgggtggaaaaaatttaagaaaatggaattttttttgtaaaaaatttcattcatgtgtggggcggggtggggtaaatggaacgtcgtcgtcggcggggtgtgcagggcgtgacagcaccaaaacctcaacaacatcccagcagagcagagaaggagtcagtcagtcactcaaaaaattgaatcagcgcccgccccttttccactgatcagcacccaaataaaatgcaaacacacaatggagcggagctgattattttttagccaaatgataagataatacccgccgttggttgcttaaatgtgttcacaaattcagaaatttgccgttgtccgctcatttgttttgtgttgtgctgccagcgccgaccattcgtctcagcccttcccatcatttcaaattccattattcccgtgattgtccaaaatgatcggcggaatcctggaagatatctggacgagatttatcggtacaaatctctcctgatcattttcattctgttcattgtgtagtgatctgatctgacccgccaccaaaataaacctgaaaaaattgttacaaaaacccatcttcgcggggataatggcacctgggggatttcattttatttttccatttatttagacttggtggaggacatctctgatcagtacgacgattctgagcaaccaacaatcatccaccacgaaccggcaacaccaacaacaatgtttgacaactatggtccgattgagaagattgttgtggtcggcaccggcctcatgggcagtggcattgcgcaaattgcggttgagtcgggcgtcaaagtgtgcctggtgggccgtagtcaagaaaagtgtgatcagacccggctgaagatcaacacgggagtgcaaaagtcgatcaagaagcgcatggcaaatgaaactgccgaggtaaacgacggcaaacatgaaatggcatgggcaaaaatgatgcacnnagtgaaaatttgaaaatgcacttttcataaccaaaattt

SEQ ID NO: 25120 - DNA, 855 bp, Heterodera glycines
gatttttgtgtatttaaaacctattttgcgattttttgtgcctaagaaagggaatttggaagtgggtcttggcgcccagttggcggcgcccagttgagctggcgcccagttggcgtcgcccagtcggcggcgcccagtcgacccccaccggcgaaaaaggtaggaatttttaccggtcatacgcaaaaaatgaccgaaaaataatcccccagtctccatttatcccccatgattactcactcaaatttactcacaattcctcaaattgtaattttcgtttaattgccgtctttcccttcgaatcgaattgccatttcgccaattgtcctccttcaaaacctgccttttccccttttttttctccgcttgcgcagcataaacaacaaaacaatctcaacggatttgggacggacggacgatcagcgaagcacagagaaacgaacgaactgagaaaggggcaattgtcgtgtccgtccgtccgtccgtccacagacgcggctctcccccccccccccctttcttccacggcgttcgccaatttcgccgcattttttttttgttcgccgtggcgcacagattggcgcagtatttaaacgttgttttcgcttctgtgtagccattggaccatttcattttgtcctgccctcctccccttcatttccatacttactaatgaatcaaatgcgttcatttcgtaagaaaaagttgacttcgatggttaaaacgccgagcggagattgctgacgaaggaagttccttgggtgggtgttcgattcccctccgaggctaacgtttgcccgtttcgaattaatttttcgttgactttttctaattattacttttttgcttacttag

SEQ ID NO: 25121 - DNA, 1178 bp, Heterodera glycines
aaacagcgccgactgcaattgtggcccgaacagctgacgcgccacagttcgagctcctcgatttctgttaaatcgcttaataacacatgctaaaaatccctttccccctcgcctctcttctctcattttttccttttctctctctctttctcttacaccatttcccaatttatcgtaccttacattcgctatcccatttgaagtgacagccgccccatttttgagcccaaatattgcgaaaatttccccatcgtttccccaaacaaaccctctgacggaaagggcccattcctaagggtggaaataacaaaagcgctcattaattaacaaagggaaacattttgggggagtaattaaatcacatttttgtcccgggacataagcaaaaacacaagacaaggatccgaagattgaagtaagtaaaaagggtcattaattggggtgcttaatccatcagaggaggaaaaacgaatttgacaagcgaaactggggaaattgggaaaccgtaacatttgaggaagagagaaaagaagattaattgaggggaaagacaaaaggcaattgccacatccggggacttttgaaggaacagcggattttcacaattatttaaaatcttttaatcttgtggcgacggcacacgggtggacacccgttcgatgtgcgcagattctaccattatatttgcgcgggtccgctcgggctatttacgatggattgcgagaggatgctaaatcaaattggaaaaccttagtcgacacactcgccaccaatttaaagaaggtttcctccagccttgttgcgcgacagatgctggccaaacgaaagcaacacgtcggcgaaagcttggacgaatttgctcaagagattaggactttggtagcgaaggcgtacccggatacgtcgcttgaaatgaacttcgaggcattggcattgggcgacatggaagacgatgtgaagagggaacacgaagaacgcctacacaaatttagagctggaattgcaaaggactttttccgcgcaaacatgacggcatcaatcaaagaaaaaattctcttcatggatgaacctccgacatttgaggatgcgatcacacaagcaaaaagagttcaacaaatgcagggagcgttggcagaagacctctgcaaacaaacgcaaggaacaaaagctgaagttgc

SEQ ID NO: 25122 - DNA, 1064 bp, Heterodera glycines
ttttaattaacttagtaaaatcttatttaatataattactgtaaaataataaatattttataaatttacaaaatattttaaatattaaagttcgttaattcgagtttgctttttagatttttatttaacaaaaatttcaaaaaaaaatttaaaataattttttatttaaattcatatttttttaaaataattttattttgtttttatcaattttgtttttgttgtttttttatccacttcaaagtttgttgcgctcattttatgtatttacaaatgttacactaaatatttggcctccgaagtgataacaacagttattattttcgcaatttctctctatcaaacctaatgaattaatttttgtaaaattttttatttaattaataatacatttttaatgtgaatttaatttctcactcgaaatttatttatgaaattggcgggaattactatgttttattgcatttttttttattcttctcttttgtgtatgtttaataaaaaatcgatgcacttttttcaaccgagaattctaattaaaaattgcttttcttcaaactctcgaaatttgattatttgaaagttaaaaattaattaatttaataaaattttttttataaattgtctttttctatcaaattataataaaactgtttattaaaaatctcaatttcttagtttattattttttgttatattttaacatcttaaaatttttatatgttatgaattaagttgattttaatttgttaagatttagaaatttattaaaaattatattattaataggatttttcaattagaaaatgtttttattttatatatgtaaaatgattcaatctctttgttttttattttattcataaacgtattaattatttaatttaaattcttatataaattttacttgaatttaaaaaatttttattgaaaattttagacctttaattatataatatatttatactttttttctattttatttaattaattttaatgcattaagacacaaaaatattattaaaaattacagcaattaatagaatttttcatgacaaaaaata

SEQ ID NO: 25123 - DNA, 789 bp, Heterodera glycines
aacagaaagtgaaagagaaagtggaagaggaagagaaagtggaagagaaacagaaagtggaagagaaacagaaagtggaagaggaacagaaagtggaagaggaacagaaagtggaagagaaagtggaagaggaacagaaagtggaagagaaagtggaagagaaacagaaagtggaagagaaagtggaagaagaacagaaagtggaagaggaaggaaagaggaagagaacgagaaataggaagagaacgagaaagaggaagaaaagaggaaggaaaaggggaacagcaaatggaagaggaacagaaagcggaagagaagaagagcaacagaaagtggaagaggagcagaaagtggaagaggaacagaaagtggaagagaaagtggaagaggaacagaaagtgaaagagaaagtggaagaggaagagaaagtggaagagaaacagaaagtggaagagaaacagaacgtggaagagaaacagaaagtgtaagaggaagagaaagtggaagaggaacagaaagtggaagagaaagtggaagaggaacagaaagtggaagagaaagtggaagaggaacagaaagtgtaagagaaagtggaagaggaacagaaagtgtaagagaaagtggaagaggaacagaaattgtaagaggaacagaaagtggaagagaaagtggaagaggaacagaaagtggaagagaaagtggaagaggaacagaaagtggaagagatacagaaagtggaagagaaacagaacgtggaagagaaacagaaagtgtaagaggaagagaaag

SEQ ID NO: 25124 - DNA, 1801 bp, Heterodera glycines
atgttcaaaatagggaagtctcttttagggccaaaaattccaaaataaggattcctaaaaaaataacttaaacccttaagaacccccgaggatttttgaaaatattattccacaaatgaaaaatggtgcgccccttaaaaagaaaaattcaataaattgcaaattttttaaacaaaataatgggaaatgatggaaacccttaattaattatgaggaattacagcaataaaattagtctactgtacataaacatacattaagcattggaaaggagtagccaacaatggcatttgagccccaattggaaaggaccgcaattgaattggcattgccacgagcattcgatggaaagatttcattaacaaaaagccatggaatcgagcctaaaatatttctaattattatatgtaattacgaaattgttgttgttttttttgaatttcattttattttttttattattttagtttttcaaagcattttaacttaaatggtaaaaaagcctgtaaatttatttccaaattacctcacaaaaatttaataaattctcatgagacccggtctctaattttttaataattaagtgcgtttagttttttattgccgcaaatccggtctcatatttgactgataattaattaattacctggcccagttgcaaacgaaatgacaaacagcagaacaaataaaatcgaaagatatgaaacccattgaactgactgaaaagcaattagcgaaatttgttttattttttgaaacaaaaaaacccactgaattaagcagtgaaattgcgataaaagcgctcgacaaaagcacgcccacgaggccagtaatatgcaaagtccgacgtccaaggcgttccacctgaaattcagttgggggtaattaattcttaattaaggctagcaggcttggaaaaatgaagccccttttcaaggacacagaattcaagggcatcattagtgccggtctaattaaggcgttaatgggccatcggacacggaaaaacagagcctttctcaaggacgcaaagggtatatttttcactgaaatacccaaagtctacaattcagatcttgaagattgggtggttttccttgaataaagacaaattttaagggcgcctctgaagccataagcatcgtgtccttgaaaagaattagtttcaaaaaaccgaaccaaaacgacagacacaaaagtcattagcacattcacggttcccattgcgatagtggccacagttggccctaaatattccgtaataattttaataagtaatttttcccgtattaaatttacattgcccttgaagtccggcattcttgaaaatgtcagctgaatagaacatagctgaaaaaaaagaaaaatgtaatttatactgagacgattaaatacaattttttaataaaataatggggatcaattacaatttttaatataggtttgatcaaacaatccgatcggataggttttcgtcaagttttgaaaaattaagataaggcttgatcaaaacacaaccgatcgggtagtatttgtgtcaagttctgtaaaattttcttttggcttctttattcaaaaaaaaatttgtaagtcaacaccaactttccattaattaattagtcaattaaataaaaagcacacctgcgttgattccggttcactgctgggacaacatcatgaacactgccaacacgaggggccacaacaacgggggacagaacatggcacgcatgctcaatttgggatgggccacgcttgcaaccgcctcttcattgatctgctccaactcggcatggacctg

SEQ ID NO: 25125 - DNA, 1170 bp, Heterodera glycines
  misc_feature (17)..(17): n is a, c, g, or t
attaattaacgaaaaanatacgagaaaaataatgaaaaaaattgaaacgtaaaaaaacaattaaaaagaaaataaaaaattaataataagataagaaatttaaaaaaacaaagagaattacggccatacaattaattaaaataacaaaataaattaataattatgatgaaaagttaaaaaaacataaacagagcccaatttctattttttgcccattaaaacaatttttggagcgtttgactcatattttggcttaaacattcatcaaaatatgctgttattaaaatagaaaatttagtcaaattttaaatttaaattattagaaattaaaaattggtttttcgtgttgacataatttttaatatttcgtgtatttctagtccagaaatctgagccctgtttattaataaaaggaaaaaacgacgaaaaaattaattaattaaaaaaaatactcccacaaattttcattcaatcactcactcatcatcatttttttcacctaaaaaacaaagtgtaatagttggaaaaggggggataggctaccgtaccaccggtcttcatgagtcgttccttcaacttaattcacatcattttaaatgttaaaacaattgttagattcaattttctcataattatttaaataaattaaaataaaacttacgcgttcgatttccatcttcatgagttgttccttgaattcgaatttttgtcgttccaattcggcttccaacttggaaatgcgcaattcgtttgccaacttttgttgttccatggccaatttggtgtcctttctcaactctttcaatttcttccagagttctttctgtaaaagggagacgaaattgtggtacgcaatcacgaacaatgaagaatgggggtcggtcccatatagaaacgaaagcgaaagttatcgttgcttcaaaaaacattttaactattttagaccaaatatgaaattcgaagttgagttttcgacttcttgtgcgaattcgtatcaggggttcggaatgggtcgaaatgggtgtccgctttgtgatcagtgaccccgaaaagcccaagagtcatgtttttgtcccaaaataagaaaagagaagatgggaccaacccccattcttcatcattgtcgaaattattctttttttcgctccttttaaatttgtgaacaatttc

SEQ ID NO: 25126 - DNA, 1761 bp, Heterodera glycines
gagtttgaccatagacaaaattaaattcactatagaaagatgcagaattcttttctctatcgatatgcaaaatttggtgaggatttaacttgcaggaaaaaagttaaacgtcacgaagtgaattcggtttttctctattaacagagataaagaaatagtacgccaaaataagagatgtttttttctctgcactctctctttattgacacatgtctcgttttttgactcggtgtgtttacccatggcaaaatgactgggctttgacggaattgaccgggaccgggcttccttcgggatgactaggtctcggtggttttccaaaaaaaaagggaccgagctgccccgtaaaagcccccaggctcgtccgctcaatattaaaaactgcgtttgctcttgcctctggtgctaggtttatgtagcggcatattgaacaaaataacttttttttaaagaatgaaataaattccaagacggaagagattgtttttcattcattaataattgggagcaacacacacccaaaaaaaaaaagtttttactttattttcctaattttaatttctttttttttgttagatacacaaatcaaaaattagcatttgccatttataccgagcgaaatgggtgcctacaaatacatgcaggaattgtggcgcaagaagcagtcggaggtgatgcgctatttgctgcgcatccgctgctggcaatatcgccaaatggaggccatccaccgctgcacgcggcccacgcgtccggagaaggcgcgccgcttgggctacaaggcgaagcaaggtgtgtgcagcgagtgaaatgcgagtgatggaggcggattttgagggggttggcggattttcgagagaaaaaaactcaggttttgccaaacaaattgggtggcggcacggcaatttttatgaaaattgggcgaattttttcaaaaattaaaaggtaatcccagccgtaattggcgcgttcagccctagttaaaacactcggggtctccaagttggttcatagaaaaaaaaatcctacaatcattgtgtcatggtgtcagttttttttttttttttttttgtaaaagtgccaatctgtgtgatgaattgatgctttggaaaaaaggggaaccgcccaatttgtcgcggccaactcaccgtgttgagtttttgtctgttaaaattttactgttttttaggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggtttgtttcaattagatgggcctaacaaattgtgcggttttcccaaaaaatggtcaaaacttggtgattttagagcaaagcgcattgaaaaccaatgaaaaaaaaatgcgtcaaattttaatctgccctggcggtaacaagaaaaaaggaaggtatgggagctgccacaatttcacccgccccttgtcatcccaggctaagtagcccggcccatcttttatttcaacccttaaagtttcacaaattttctgactgattttccccccttcccttttcccataggcccgtgccggccgccgtttgggcgaacttcgtgtgctcaattcgtactgggtgggccaggactcgacctacaaattcttcgaagtcattctcgtcgacccatcgcacaaagtgcgttttggtttttgtttgtttgttttgttgcgatccttt

SEQ ID NO: 25127 - DNA, 1036 bp, Heterodera glycines
cagcagtttccctgcaaaatttgtgagcctctgatcagtctagaacgttgggtgataaaatgaaaaaaataataaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctacaggcaaaaaattctaagaaaatttataagcatttcctggattgtcagcagtttccctgcaaaatttggtgagcttctgat

SEQ ID NO: 25128 - DNA, 1345 bp, Heterodera glycines
agtgccaagtgggctggtaaataaattcggactgagtgccgaactcgttttaagagcacgcgggttttgctgtgcattgaaattcaaataatctttgtcatggtattcagtccacattcttttttaataagcgcataaagttttgttgtaaaattttctctgtttaattttctaatagccccttatctttacccttttttaaaaatttttgcaaatttttcaattcaaaaaaaatattcacgaaaatttcaaaaatattaaattaaatgataataattaggctgggaatttatgtaaatagatattttttcccctgggttctatggtcgaaataataggaaaacactttcttttttgtgtttgcgaacaaaaattgggacttttatttacatatttcggggacttttatacataatttacatttcgggattttaacacatttggtacctgttttgaaattaattcttacaaatttttattttttacatattctgggaacatttacggaaatttttagaaatcatcaaaaaatccaaaattctgctaatttttcgtacatatttcaaatactaggtatttagaaaatttatagaaatttcttgttaaaaaagaaatttttatttaaaatgtaccactaaaaaatgcccaaataatatttataataaaaatgattctaacaataagccatttaaatcctatttcaccctttacgaagaaatttttctaaaaattaaccagttttaaaaattgtatttacataattggtgcatattttgggttttatatacatatatcgctatttttttttatatatttatgtttatgcacatattttgaccattttttgcacatatttttggcagcccttctagccatagttttctgaaaatttttattctatttggcatatttctctatgaaggtttttcgaattcaaaatcattttaccatttcccattttgcccgtccaggttcaaggagcagcatccggagaaggcgaaatcggacgaggaggacgaccaggccaaatactatgaggacgcacagcagcgcgagttgcggctgatctacgaggcgcagacgaacatccacatgaccatgcagaagatggagttgcaactgactgaaattgtgcactggcagcagaaacagcaacaacaacaacaacaacaggctggagcagtacagcaacagggaggaggagcaggtggttggggcagtttatgagcaaagttggagaggggttatgacgggaatagaacaaatttcgtcgctaaaattttcaaaaaaaaaatttaattttaatttctcaagaaaaattttttttagaatttttatatcaaaa

SEQ ID NO: 25129 - DNA, 1198 bp, Heterodera glycines
  misc_feature (1183)..(1184): n is a, c, g, or t
gagtgacaatgccacggtaaagcgcaagacttttgggcactattttttggttgggatgaaagccaccaattggccatagaccaactcggaaagaccaaggctaaatgagagcgtggaagagcagattataaaaagaaaacttacgcgagacagaccaaccattggaaaaggttcagacgagcggttgaaaacctggaaatatttgattggtcattaaaacaattaatcgaactaattaaaaaaagtaacaactgaccatttatggccaaaatgaacgatgagaaattgggcaagaaaagtggacagccaaatgatgcagaacatgtgattagaagaaagatgctgaacaaaatgaatggccaatcatcagacgaaatgcaaaagccatattattacactcactttgaacacatttcgttctccgtggactttgcgcgagtttatttcgttgaaaagggtctgacgggcaaaaattaaaacattttaatagataaactcgggtgcatttcgttcccccctctcgccgtttctccaccgttcgcccaccgattttatcattatttttttcaaattttcaaaattagaaagttatcaaaaaaataatgataaaatcggtgggcggggggaggaaacgagctgcttacgttaacgcaccattaaaacgaatgaattgaaaatgatggtgaaatgctcagatggaggagagtaaatggaggcaccgatgccactggcgacattcagcaattcagggcctaatttgcaggtgttagaatgagaaacaagggattcaaggtaatcactcgtgtttaaaaacgcgataaccgacctttgaagagcaaaaccatcaaaatggtgaattgatagacggcatggcaaaaaatgttgcggatcattgtgcgagagataagcgactttttgcggccgtatggtttgcgttccaacagttcctcggttggcatttcagtggcaagtgccaacgaagccaaagtgtccatgatgagattaagccaaagcatgtgaacagcctgaaaatgggtgcggaatcatttacaattagcatttcatagactgtccgatggcttgtcgttttttctctgttttatcgtcgtcactcactttgagcggtgagtcggcaattgtgcaggcactgacgacggcagtaaaaacggcgaccaaattgacnngtgagtgaaactgc

SEQ ID NO: 25130 - DNA, 988 bp, Heterodera glycines
agttttcgactttttgttcaattatggccggaatcacgaattggtcgaaattaataccatattcgtgcacagcgacctcgaaaacccccgggtaatcatcattatgtgtaaataaacaaagaaaatttttgaccaaaaaaagaaaaaaatttcaaatagaatttttttcaaatgggtggggaggaggggcgttgtattgcacccggagggtagcagtaagcccggtgccagaaaatttttcgggttggggggggggggaatctgaagaccttttttttgctcttcgggcaaaaaaattttcttcagcgcccgaatagagacttgtagccgtttttgcgtcaaaaaactgtcaaatttttttcaattttggggctaaaattccaaaaaaggaaaattttaaacactttgagtgcactttgttacgaaaatcgcctataaaaaaatcaaaaatgtacccataaaattttaaaatttttgttttggggggatataagtattattgctgaaaattttagattttccttggtggtaccccccccagacctagcctcacgcaaattttccaaaaaatttcgctaaatttttcaaaaaatccacaattttttgatgaaaatctgctaaaaatggctcaaaatcacaaaatttggtcatttcggtgactctggtcaatttttaaaggttactagtatttaaaataagggaacattaaaataagtgaaaattgtgagcgaagagtgggtgacagaggtggggctcggacagaaagatcccgggtcgcggattcaatttgccgcggtcgcgaatcgcgcaaaaaaatacatgtgtaaatggcagagaaatgctaatgtcaattggctcggcatgcaaatcagttgttgacaatgcgttacgcatttgggtcatttgctgaaatggccctaatgcaatctcacgcatttcttgcgcagtaaagtcctccggaacattgtcacgattgtagacgttaaga

SEQ ID NO: 25131 - DNA, 1406 bp, Heterodera glycines
ccatgtttcgaaaaatttggagcaggcgggggagggatgtgcgcgagtgcccctccgggcgagagagtgatggtgcgatgatcattcgctctccccccccccccccttggcagtacccatttacggtgagtggcaaatgggggggacagcaaatggcagatgcattttgcattttcacgaatccgtgtgatgctaacaataagccttcctttcgcagttttttcccatgattaaatcttgcaaaagaagcttgagctggtcattgacgaatttcggcccaacacaaaaaatgaggaaatttctcaacccacgggtgagggctaattttaggggaaaaattaaaatgctttttaatcattagcattagcattatcaattaaatctcatttcgttttcattccctccctccgctggtggtcgccaactccgtcccatccaattttagggcgtcataacttgcgggactgagttggcccgctcaacaaatgccccttttgttttcaaaattcggtgcccttcccattaaaatgcatatttttagctgattttgttttccgcataattaatataaagcacatccatcccttcactcatcagtttgtgtccgtacggtgcaaagccaacaaaaagccaaccaataaaattggggatttccctgactttttgctgggatttacccgaatacgagcacagtacacaattctctggtgtgcttgctatgaagtgttttcattagtttcaatttctaaaactttccgtccttttctgctgagctctttgaattttaaatgcccaaggctttccccgacaatccaaacaatcgatcatcacttgaagacatccccccccacttctcccaatctaataaaagcttttgtgtgatcgtttacgatttgcgaggaaattaacgggtaaagtgaaacctggaaaagatagggagaaagagagtgagagagcgggggagagagtgagaaagagagtgagagagcggggggagagagtgagaaagagagtgagagagcggggggagagagtgagaaagagagtgagagagcggggggagagagtgggaaagagagtgagagagcggggggagagagtgagaaagagagtgagagagcgggggagagagtgagaaagagagtgagagagcgggggagagagtgagaaagagagtgagagagcggggggagagagtgagaaagagagtgagagagtgggggagcgagtgagaaagagagtgagagagcggggggagagagtgagaaagagagtgagagagcgggggagagagtgagaaagagagtgagagagcggggggagagagtgagaaagagagtgagagagcggggggagagagtgagaaagagagtgagagagcggggggagagagtgagaaagagagt

SEQ ID NO: 25132 - DNA, 1074 bp, Heterodera glycines
cctatagcctgtactttaattatgcggtggattttttctcctccatcaatgtttgagtaccacaaacggacacctgaaaaaatcgatttttttgttttcggggcagtacccccgaaccgatgcggccagcattattgtgaggacgaatccttcgggaataacttccctatagcctgtactttaattctgcgttggatttttgctccccataaattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccacacggacacttgaaaaaatcgattt

SEQ ID NO: 25133 - DNA, 1006 bp, Heterodera glycines
tttgggggtactcaaacaattatgggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagtaagcctacattttttgcatatttaaaaagaattaaaaaattttaaaattaataattttcctgcac

SEQ ID NO: 25134 - DNA, 2265 bp, Heterodera glycines
  misc_feature (58)..(58): n is a, c, g, or t
caacagctccatggcacgtgaagaggccatcctttttaaaggctggaggaaaagcggngtaaaaagagtgtaaaacttaacgcacgccatttggcgctatttaattattcaaatttgttcatgagcaaacacacaatggcataaagaatgatggcaccgccgaaaaagggctcaatgagggcccaacttctgtcgtgttgttgccgacgaagtttgaaaagggctaacttaacaaatggatcgaattgacaaaatgcatggcgatcccttcattgtccacgcctttttcattttcgactgaccccaatcataaggacgcagaagcaaatgcaaacgacggacacaatgaagaaaatcaattggagcagaatccattccgaacggcaccaaccatcgccggcatcggcggacgccaccaacggggaggaggagcagcacgaacgggcgaacacgcggacaccgccgtggacggaatatgagcactgaggaggaaagaagacccaatgacagcacggacaaacggaggaatggccatcattagttggactgttctcacgtgggtttggcagtgcgagtgaggacacgcgttcagcgaaagatcgggcggaagagcgatttggaggaaagactgagcaatgtttgtgtggtaaacggcggacggagtccaccgggggtttccgcccaaacattggagttggaagccgaggacgggctgcggagaggcgggcgaggcggaggcagcgaacggcgaacgcgcggcaatggtcgcgttgggaggaagcactaaaaacggagcaaaacattcattagcagataatgatagaactgtcggaacccgagagaattcgtcagtttttatcgaaactttcgggcggaaatttaaaatttgtgtggaattggaactgccgaaccgagaatgtttttttttccatcacgacaatcctaacattattgttccggtgattttcgtaaaaaaatatttggcaattaccgaaatgggaatgaatgcctttcttttttgaatgtgagtaaatcataattgttcatgttatttatttgccaccccgtccggaagtggccaaataagtgtgtttcgcgaagagttgtgccaccgtcaacagaaggccccgttcggcagtgccatttctctcttcctcccatcggcgcagcgactcattgagcagttgctgcaccagcggactctccacgcgttcggttgggtcgacatggccacaccgaatccaattgggacaacggaaatgggaggcaccaaaattaactcaaaggaaaacggggaggaaagtgagccgggcgggaatggctttacaaattactgcccttggggggggagcctcctccctccgtcccctcaccaattctcgaatttgggcccgaaatgggggcgattccgagaagggcttccgacggcccgtcgacagcaatcggaagggtaagttggtgccggaagcactgtcgttgccggcggatggttcggcctatgaaatttcagtaatccggaaaaggagacacgaatcttacagctgcaggtgtccgtggggtggcataattttcctccgtcgcttcatttattgcgcccgccaccgccaaaagtgtgagaattgcggtggcgaaaaggcaaatggcacgacaaagcccgcgcggcattccttcagaatagccttagtattctcgcctcttggaacatttttacgcaaaatattttgaagaaattattataagtttaaacaaaattcatcggagttggaggacctttgaagggaaacaaaaacaatgcgattgaatttcaattgaccaaagggtccgaaatttcgcgtgtctttccctcgagggacattttggcacggggacacttttttataattcacaatagccgaagagaaaaaaaagtgtggcgacgattgaaattcccgcgggaattgtttggagaagtctaactttgtaagaacgacgagtcaatgccaaacggacggacatttgggagagaggggggggggggggttggaatttattggcaaaagtttaatgaatttccgatagagggccaagcgaaagacgaaaacgacaaaagattttagcaaagtgcgtctttttgggctattaatctctttgctcgggtattccgtttttgagggggaaaaggccattgtttgccgatttcactgctgttgctgccattcacgcacattttccgccaaggaaaagaaagaaggatgaaaaatggggggaaaagattcaaatgcaaat

SEQ ID NO: 25135 - DNA, 1142 bp, Heterodera glycines
aacaaatccaagcgccaaaattgtacagaaaaactgaaaggattcaaaaattgttgcaaatttccaaaaatggttaatggggagggggaacgcgcaacggcggtcgatggaatggacagaaatccatcgccaaagtggtgcttggggtcgacgaggcgaagagtgagtgccccccccccccattttatgatggggaaaaagtggcggactggggacggatttaccagcacaaacttttttcgtatcttattagtttgatggaacggaggcacacaaaaatgaatccgaattttcgagcgctgagacccgaaaaatctcggcacaccccaaaacacagccgaggcataacacagccgggaataagttctaaaaaaatttcaaacagaaatttttcaataaaaaaatcgtgaaaaattttctaagatttttcagcgcttttttttgaaaatttattcccggctgtgttatgatgtctcggctgtgttttgtcctgttccggaaaataaagtcgtgtgaactgcaatagagccccccaaaaaaatccagtccagagtccgacccgtgtatccatttattaaaattaggttttaacatttatttcagaaaaccacaaaataccataatgacataacacaaatccaaattgatcatccccattaaaaaagaacaattattatgagcacgtcaataattccataataattcaattaaatcgatcggtcaaattctgaacaattcatacattcatctgcgcactaatttgggccgtccaatgcgttgagaagcctaaaaaacgaaacgcaataaaatttaatttttgaaaaaaaatttcacttaccagtccccgtaacaaaactctcatcatgaatttgaatgtaaattttgttccatagctcatcaatttcacagcgaatcgcttcttcttcccattttgtccatttgctttcatctcgcgcaattggacaacggacgaacagaaaataattgctattggcaatgctttttcacgacaattgttccccagttaatccattagtcagatcgaagagcacaacggagtcagcaaaaggcggcgggaacaaaaccgaaacaatgaaattgacgggagatgaagccgatgcaaaagctaaaagggggggggg

SEQ ID NO: 25136 - DNA, 1998 bp, Heterodera glycines
aatatgtgggtggagatgggcacgaggagggaggagaacgagtggaggagaacgtggcattgacagcggcaagcgaagtgggcatggcgacgaattacgaacagagcgaccgaggacaatgggttaagggagaggaagaagcggtggagaaatacacaggtggagagaggaaaaaaccgattgagataggagagatagtagggaaggcggagagaggaagagagacagacagattgagatagtaaggtgattaaagagagaaagggagacagacaaaccgagacaagaaaaaaaagagttgggaagacggagagggaagagatataacaaataaataatccctttaaaatcaaattgcggcgatggcacttttcctttgctttcagtgacacctctttctgtgaatgcttcaattggcaatgactgaaaaagagcagaaaatcagaagtggttttgccaagtttccacaaattaactcattattatcccttaattatccctgacacttccgaaatgatttatcatttaaccaatggaaaatattttatgttttttgtccattaattttgtgttactttttataaaagtgaaatttgatctgatgtgagtcagattttgcgattgttcatttacttttgagatggacaaatgaatgaaaatacaaacgaaaaacgaaacgaagaaaaagaaaagagacgaaaagatttggggggggggaaacaatgggacagcaaacactgaccagggaaatgggaggagaagcacaacacggggagggacagggggagggagggaaaaggaggggaaagaaagggtcacgcctaccaaagggacgacgggcagatcagttgctgatcagacggcacaacattcgcaaatcagcttaaaaacatttgccagatcagtccgccccccccccctaattaagcagctgtccttaattgagcacggattctctgtccggcaatgattcgctttgcttcttccattaaacgtattaaacagtacaaaaacaaaacttccctcagtgtaattacgactctttaagacaatgccttttggcttttcgccgtctttcgtctcctccaattgcctttctgctcgccttttaactgtcccccaccacaaaagtggggcccgggcccccctcagaattgtccgtcgcccaccgacccaaacaaccgaccgccgttagttttgctttgccctttgctttggctctgatcgttcgtttttgccaaggtccgctctcgagcgttggttcacaaaagcgatgttcgaagtgagtggcacaaataaacgccgaaatttaatcgccccgaaggatttgtttccgtttgccaacctcggctggggccccgaccgatgctttccctattcatacgaaagttttgcaatcgctgcgcgttatttcccccgttttgggaccgaaagtcccaaagagaacggactgagtcggacggagaacgaacggagggatttggcggcattctttgcccacgccattcaggagacgggacagaatgacatttcgctttaccaaaggtcacccatccgacattcttttctcggcaaaagtttcccccttctccttcacattttgaaaatgctttaaatgggaattggtcattttgcttttggcactcattttcagtattcccaaccaatccgcggctgatgcctgcttctaccgtggcggactgttcaattggtttgagggtgggcccgtgtcagcatttttggactccaatttgccgggctttcgtcccaccgatggagcgaaatgtttgagcaacggaaggttcgatgggatttgaaaatgggcgtttcgatgattgattgaataatagcttgcttgataatttgctcgtttgggtgattggttgttcaggtactgctcgccctcccttttctttccttgtgccaatggcacttccgacgatgggcgtttcttcaaaagctgctactttggcagagggacaattcaaatttcgtaca

SEQ ID NO: 25137 - DNA, 1005 bp, Heterodera glycines
acatatgactagggatgtgatgtctagtgatttcactactttttgctcattgttttgaagaaaggagctcaaaaaacgcatttatgcgttgaaacgtcctcaaaaattgcaatgaaaattttctcataaattattctaaaatttattcattattttcatacaaaaaattttattttaaaaagtgtgtaagttattgctttttgaataaaattttgtcattttacacaacctaaaggctaaaaattagagacaaagtcggaccggacccggtactggttttttctggatccggtccggcgattttttggaaaaacctggattgacttcttttctggattgaccggtttttgatagaccgaatccggaaacctgttgcttctgaaaatatcagtccggtccggtggattcggaaatctcggtctctactaaaaattaggtatgtcactattcgtcactactcgaaaagtatttcacattatgtttgaggcttctaacatgcatttgtttaagaaaacatatcctttggcattctttcgctcccctctatcaaccgctgctcaaattgtccgttctgttgttgtttgtcccctgttgaaaaggttttgccaattcctattttcaaaattgcttttcaactcgatttttttttttttgtataaaatgggaatgaatcggcataaatttcgtccctcctttttttcatacatttaccacatttattctctccctaatgtttttttcgaaaacaaaaaactttgtggccctttggttaataatttcggcagcaaagaaatgaccaccagtgagtggtcagttgatgaatggccaaatcattggagttgattcgccagtttttgcattccgaattgtaatttgtcagtccattcgcattaaaatggtacaaataatccaacaaaaaaagcaaatttagaattgagaagatgcaggacagaaccatcgattattattatgagggggggggggggggggggggggggggggggg

SEQ ID NO: 25138 - DNA, 1183 bp, Heterodera glycines
aaacatttatttttaaataaatcgcatgacaaaaatgaaacccttttaccatttccatttcaacagaagccatacgtaaacccattaccaaggcataaaggattaacaccagattaacacacttttatcgctcgccataagcatttgtaaaaaaattacgtaaatttaggcatttaaatgccgcaaaaaaagtcattttctctcaaatataattttatatttttctacaaattatttttttcattgaagacagcctgtgatgtatttttccaacattttttttttaattctttttggttttcaccgacatatatcgatcctgaaaatttcaaatttttcgttttcgggttttccaccgaacaagccgatgccgacctttttgtcctgtctattaaattttttgttgaccaaaaattatagtaaaaattaaatgagaaattcacttatcaaaagaaattattttttaattttaatttcacaattaatttaatttttttattatattaaatattaaagagggatttaaagaaataataataatttatttcttataaattttttatcttctaaaagtattaaaatatttattacttttaatttgatatattcgctttaaacaattatggttcgcaaaagataaaacattccattcaattgtgccgaaaaccaaatccaaattttgaattaatgttaatgccattggcatttgcattgttcgtttttagcctccacccgccccctctcccgcgacggatttccgttggcaattgttcaaattttaataaataagattttttatcattttttgtcaattggttacgattaaaaaatgcgtcttgatgtgattaaacatcgccgagtctcacttaaagtgccgtccgatgcagctgacgctggcgacgaacgttctgcgggaaataatggcacttttttaaataccaaaacttttaaataattatttttatatattcaattttacgattttattgttaattaatatatttaaaaaagatgtccaaaagtcttaaaatatcaaatgtaacgtaaacaataataaaaagtgtttattaatcttcttaaaattattttattagtgtaaataatataaataattaaaaaaaatttttttttcgtctgttaaaatgtttatacatatctatataaataaattattattaattat

SEQ ID NO: 25139 - DNA, 1674 bp, Heterodera glycines
  misc_feature (1622)..(1622): n is a, c, g, or t
tcgctttactatctgaaagtaaaaaaatatatttcgattttttatttacataaatatttttcgcatttttcgagaacttcatcacaaaaatgctaaaaatcaaaaatcacatcccgactaagaatggaaagattttaaaaaattttctactaaatttattttttcttgaccaaaatttttgatttatgaatttttaaaatctggaaaatgtgaattatttacaactttaaccaagtgcataaattctttgatcgtgttcttctaagcaagcagttcatccactttttgcattgcaattttttcatcattctcattgcattattaccttcctgccaacttcgttgttccatcggttcatcaacgatcgtccatgccattccgcggatcgcttattgctctcctccttttcacgtacatcaatgaaatcgcttaaattgctcttcattaaatttaatttgtcattgtattgtctcttgagcccggaatcgagatttcggtattgagtaggaatttcgaaaaaaaactcaaaaaattcaggaaaaaataaaaatatcaaaaacagggcgaaattttttccactcccagccgtacaaattattttgaaggaaaacggcggcgggcaacaaacagcacggcaaaaaatcccagttttgacaattgctgattgtgagcgccaacccgggatttttgggattttcaaaagcagaattttcagttatacttttctctaaaatccccggtttttgctaatatttgacaagtcctaatgataataaggaagatattttcgagaatttcattgaaagctttctgagtttgggcgaaaatcccgactcagtaattgtctcacaatcagctgctcaccgcgagaatcggtagccataatcgatgttatcgccacaaccactccaagtccaatcctcattaacaccacggctttgttgctgaatgtggaaaaacatagaatatccatcttcatcatcatcatgagtgccaaatcacattttcccaatgataaaattcattatttgctcattaaaattacactcacagagaaatatattaaattaattaaaataattggataaaattaaaattcaaaaaaaaattttttttttttgcaaattctttgaaatttttcgattgcgtttatagtcaaacacttttggacacacccaatttcaagagtacccaaattttctgtcccacaagagtttattagatatttgccagtttttcgattaaatctgccaaaatataaatttaaaaccagaataataactatcaaatgcagatgattttgattaggtgcaatttttgttaaaagcccacgcgatttggcgcattatcactttctgaacagccacaacttcgcagaaagccaagacgacaacggcgtccaatttcatgtgtgacaccggcagaaagaattgcatatgtgaaagccgcttcacgagttcctttaagtgggcataataagttcattaattttataaaattttgaaattaaaattaaatttattgaaattatgaacgcggacattttattttaattattaaattttaacaaattcacctttcttatgtattggaacaaatgtgtccttcagctcttgtggtgntgagcagttccatcgatgataacggaattgccattcgcactcctcaaaattc

SEQ ID NO: 25140 - DNA, 1767 bp, Heterodera glycines
tgtgacaaagggaaaatagcatgggaaaaggggcataagaataaaaactaatgattctacagtcttacaaatattttaaatataaaatccaaaacctgcgtcaaataaccgctaggcaaattgatggcatgcgaaagcaaagataaaacgatgaccatagccaaataaaacaatgccttcttttgcgcatcgatgaagaggtatttgcgggagagttgtgtaagaacacctggaaaggaatggaaacataaaatgaattgaaaaggttcaataacccaaaacaacgtcatgaaatgatgtaggcgcttgtaagaaatttctgccgttattctgctgctgttcagttccattattttcagcttgttgacgtacatttccgttaccattagaatgttgtttacgcaaatcaacgtctgtcgatgaatttgcatccattgattgaaagtacagaatctgtgaaaataaaattatctaaagaatttgaaaacaaaacaaaagatacaatatagatagaaatataatgacaatgtcaaaagatgcgaccgggattcgcggcttatgagatgctaagaaaaatcagtccattttttggacaaaatctgttagcaaattacactcaaagcattgatgtttaaaaaattgaaatttttgaatttttaaattcgcgatccgcggcagtttgaatccgctatccgcgaccgcgggatttttctgtccgcgacccacccctcttacaattagctcctcgagaggaatcgattagtaaatcttttaccccagttttgaaacaaattctttaaatcaatttaaaacaaaacttaaaaattcattagggtaataaccggaaaagcaaacacagaattaattttttaagtgatttgacatttgtgttatcgatctcaattgactttgacctcattttattcatatattttgattttattttttgatcatccatatatattatatcacttactctacgacatactatctgaacagtcgtcagagtaagtggttttttgcccttctgatgactttttattcacgaataaataaataaataaaaagtcgaaacttcaaatttcgttttttcgcctaaaaatgatttaaaacacatggaaacattttgaaaaccacgaatattgcaataaaagatcattaaacccttttcattcgaaaaaaaatatgaagtttcgctttttgtccgaaatcgggttcgggattcgaaattggacgaaatggatgccagaatcttgatcaacgacaccccgaaaacccctggaaactttttagaacgactttttaaattttgaaaatttccgccaaaaaataggggctaccatcttaactctaatttaccctgaaatgcatgcctttgatggatgacgacttcaacttttgctgctgcttcttcttcctcggtttttgcctcatttttattgttgctgtccaatgttggggaaagtgacatgtacaaaaggcaaaaaacgaaaaagatgagctaaaatgaacacaaattttatttttgcacaaaaaaccagtcagaatgcacaaaattttaccgataaagcaagaaacactcttgaggatcgccttaacagtcgccgaaccaataaaaaatacattttcaaaattttagtacatacagtaaataaatgatgatatgaaatcttaaaatatgcgcatgaaatatgcaccaaaaattgcaaaatatgcacataaaaaatgaaaaatatgcacataaaaaatgaaaaatatgcacataaa

SEQ ID NO: 25141 - DNA, 2089 bp, Heterodera glycines
  misc_feature (909)..(909): n is a, c, g, or t
  misc_feature (958)..(959): n is a, c, g, or t
  misc_feature (972)..(972): n is a, c, g, or t
ctggacctggattttcctggatttttgtccaggaatcaaaggtccaagtcaaatgtgaaaaaaaatccaggtccgaggcaaaacaggaaaaaacctggattttcctggacaaaattttagaatttattttttcaagtgaccgatgttttttcaagttttcaaaaacagattaaataaatttaaaaacacattattattattaataattagatatttttagatgcttctaagcaaataattaattttttcaaacattttttttgatttttaaaataatttcaaaaaatccaggtccaggcctggatccagatctcaagaagcctggatttttcctggacctggattttcctggattttgtccaggaaatcaaggtccaggtccaacatggaatccaggtccaggtccaggcttttttcaaaatgtcgatctctattatttttaaaattgtttaaatattaaggttcaatgaattggactataagccttggtaccacgctgaacgatggtcggaaggcaaaccgtacattttgataagaaaaagcaaaaaattttccggttattttcttcataaatatgaatattaaatagtgttgctgagttatttcgtaattataaaaaagtttcaaaaattatttaagttacttcaaaatgattatggatttattttctatcattgaattgttaaatttggttccaattatgacaattttaatttttatgaaacgatataactcatttaataagcaatgaacaatagtttaataatccatttttatcgttcttttattttaggatattcggacaataatattgaaaatgtgaacaggcgttcgctgatttatttgtcggaaaagtcatttagcacggagcataatgtcaacacatcacgcggattaatcatggaacanttagtcaaatttatgggtaaaaattatctaaataagaataaaaaaattnnaattattaatttntaggctttcgtgaagagtttctccgtgccgacgcgtcgagttatattcagccaattacagccaataaacgaccaccgggtccttcttcgccaccagttttttccaatgaacaattaatgttcgtacattaaaaaatgttacagattttaaagtttcgaatttaaaaaattaaattttaaaattaattaatttgaaaggtttttgtaattggtttttaggtggccttttgaccccgagtcaattacaataccggcaacagcaagagaatggttcaaattatctgtttattgcaagggcaggcaaaattcggacattggcgcagcgcaaagggcgggaatattaacaaggcaaaatgaatttcaacaatcgtttattttacagtgaaaatgaaaatttcagtaatttaaaatattcactgtcaaattaaatataaattgtcttattgatttttttattaaatttattttcccaaatattgaaaaggtgggacgcggttaaattgaactcaatgttctgtcctgatcaagttgggaacgcggatccgagaatgggtaaaaatgcataatctatacaaataaatattttaaagattaataattttttaatataggcccatgcgttgtcccgagaaaaccaaggaattccaacccaggaaataattaactgaacttttgtatgtgccatccaagtcagaagcaatatatgtgaccaattattgacatttaaattggattatgtattatctctaagaacgaacctattttacattgaaaattgtgttgcatgaatatatttgtaaaatataatgttgtagaatgattttgatcatacataaggtttttgaaaagcttttgctaattagttaattcttgaattatataataaatatcatttaaatgattttcatctaatttaattaccccacagaaaaaggaaatcaaaagggttggaatttatatcacaaatccctaaatatttaagaaaaaatgcctaaatatttaagaaatattgttcaaaaatgtgaaaaattgagtgcaatttggaaccgatttttgaaatttttcaaagttcaaattcatttttgttttctaaaaaaaccaaaaatgtggaatattta

SEQ ID NO: 25142 - DNA, 887 bp, Heterodera glycines
ccccccccctgacttcgttcgtatgaggggccgaaagagtgggggacacttcgtatttgttgggataaaatgtgaaaaaatgcggggaaaggtcggagataaaggggtaagagagaggcgacttcataaaggcgtaaataatttaacaaaaccttaaaatttaatgagtttagtacaaaaaattgaaagaatttacgaaattgagtaatatttcttattttttttaccaattatgacttcttttttatatgattttcgtttttaaatttaatttttttttttaccaaattggacttcgtaaaatttatgaaaaatttaaaaatgtcttaataaattcattcaaaaattaaagtttttccttggcggtttacaaaaaccttttaatttttcgcaaaaaattggctcgaaattgcaaaacttggtcattttttgtgtaaatccattaacaaattgcgctcaaattttcaaaaactttcccggcggcgcctatcggtaccgccggactccccccccccgttccccaaaagttttttggaaaaatgcgccgcaaaaaaaagcggttttgaaaagcagaaaaaatttttgattcacatgactggaggactacgtaaattttggtctccgacccctccttcgacccccccccccctggatttcgttcgtatgaagtcgggtcgacccccttactatttaatgtatgattaattttatcggctattcctataaataattctaattaatataacaaaaattatacagaaaaatcatatccgcatttttaaaattgaaaaaatttaaatgatttaaaaaatgattaaggaataaagttgaagcttattttttaaataaattaaaatatttacataaattgttataaatatttaaaa

SEQ ID NO: 25143 - DNA, 2001 bp, Heterodera glycines
  misc_feature (74)..(74): n is a, c, g, or t
gccagggaacggatttatatgtggccaaaaaagctccaaaaatatgtgctaaaaagctcaaaaaaggccaacantatgtgccaaaaattgaaaaaaaactgtcaaaaaataagttactttctcaaaaatcacattttttatcaatttcgctagtacaattctaatcaaaaacatttcaattctttgtgacgtaaatatttttctcgcttcaaagatttatttatttttctgttttcattgataaaatttaaattttgccttaaaaatgaaaaaagtcataaaaaggtcaattcaaaaagtgcaaaaagagaaaaaactaaaatttttgtacatttttgtacatttttacaagaatttgagtgcaaaaaaagctacttttgtaaaaaaaattaaaaaaaaaatccccaaatatgtgctaaaactactgaaaaccaaaatatggtttcattttaatgaatatgcttgatgccattttcaaaaaagccgaaagacagccatattaatttataaattgaaacccactcgtaataattaagttaattttaaacaaaaaaaaatgaaaactgaaaattttcaaacaaaaaaaataaaaatatatcccaaaaatgacattttataaattaaaattatttatgacgcactatgaatttctttgatgaggatatatatatataagacaaagatgtaaaggttgcaatcattaatgctgtcaaaatggcatcggcatttggcatagatatgcttttagctgtccaattgcaacaacaaaggcaataagtgcgattgatgctctatgtccgaaacacacccattttcggaccaattaactcaccatttcccaaaccaggagaagttggacgacaaagccaatctcaacttggcggagggaagagatcggcgaatttggcacaaggcagtcaacgagggcgacacggttggacgagttgagcgagtgcaaacgagaacgaaagaagaatggcgaaaatggagggagaagaaagtgaggaggacatgaggaggaagttgcgaatggggaggacttgccaatctgacaaatttttttatcacttaattcgatgatcagggacattcatttttttctgcccaaattctcattttctttgcattaattatgctttaattttaaatgctttcaatcatttaaattgttaaattctatttctcatttcctctcctattatctccgacacatatctcttgcaaattgacggcggtctcatccgccatatttaagccattcattctttcccatcacttctcacatcattcacttaaaaaattgtttttaatcgacaattccgcttttttgcaattctcatcaatttttaaattaaatttcttcattggaattttattgaaatttgtgttttgcaaccagcaaaccggaggttttctgagcaagtttaccgccacacaaaactaaactgcctaatttcaaattgtggcagaaaaccggttccagcctaaattatttttaattaattttgtgtcatcaaaatttcataattgttttccccttttttacaggtgaaaagtatctgacattggacaattggaaattggacgagctgaacaaattggacattggacgcactgaacatttggacatttgacattgtgtgcaccgtctcggagcgtgtctcatcgcgcaggccagtctcaattctcaagacgcgccccggacagttacacatattccttaatttttccacaatttcatattcaaaaggtttagaaaaaataattaatttgttaattttacatctattactctcctgttatatatatatttaaaagtttttatatttatgaaaaattgaatatttgttttttattgcttttggtattttaatttaaaataaagaatacatttttataggattttactttatgtaatatattctcaagttcaatacaggtttcaaaactttctgtagcattactatcattgtttttaattcttaagataaaatattccaa

SEQ ID NO: 25144 - DNA, 1057 bp, Heterodera glycines
tttttcgaaattttggcaaattttagctgtattttgctcacttccgaaagtttttgctgacaacaaaatgagatattacaaatgaaaagtatttggtttgcaattgtgaagctagaatttaataaaaatttggcatttttaagttttaaaccccttttttggtagtttagtgtattttttaagtttgtttaagcaaatattgaattttttggaaattttcaagggttaagacttaaattttggcttttttagtccatattttggtccatatttggccatttttgagctttttagtccatatttagtgcttttatagtccatataatttacaaccctatttataaaggaaaagaaaaaaaaagttaaaatttaaaatttattggcaaataaaaaagaaaaacaaaaatgagtgatcgaaaaattgttgaaatgataactactcggcaaaaaacactcaaagatgaaaaaccaaatttggtaaagaaaactatggaggcaattgaatttttttgctagcaaattttttgaaaattgctgtatccgcagcattcaaaatttcatattttgtgcataatgtacattgccctactttctcccgacccaatcccgtcgtaaacttatccatctgttcatcccatcccaagccaatcctatccatctcatttccaatgttatcgtgccatttcttcctattcacctctgttgcatatgccatccatttctcttattcccttttgtgttttgccgtcattacccctcatcctatccaaagtccatccccattgtgcgagtatataagtccatccaatttccccgtagggggctgcgagatgtctgcggtgggtcagtctgtgccatttcttgcctttggcaatcctttcccaaataaccaattgcattgacccacccaaaatgctctgaggttgttgttacccaaacttattcccggttttttaacacataattatttgtcaatgcttttccttataataaattcctctctcctaaaacggtaatttgaaatggctgaaagccttaaattcggggacacaacaaa

SEQ ID NO: 25145 - DNA, 1404 bp, Heterodera glycines
tgaattaaccgtcctttctatgccatccctcatgtcggtcctagtagcctcccccccccccgcttcccccaaattacacttcccattgcgtattttgtgcctttttttgggtccaatgaccccctccttatgtgttcccctttttgtccccacctctccgattgcctccccatcgttggaatgcgctgcctccgcccgccgtccgtgtactgctagcgccccctccgctggtcagtgccggcgtcgtcgcttcctctccgctgctcatcaccgactgaatggccgccgaagcggcggaagtgtgcgcgagggcaggcaaagtgccaacgcgaccgatctttttgaaggcgcgcaacggaagccgttcgacacgttcgttgtgccgcttgtcagtgcccacttgggacgggggcttcagcattcgaacagaaagcggacaaatttatgcagagcaaaacttggccaatcttttcttggggtaattaggaagtcgaaaactgtgccaaagtaatttccaatcgatgccaatttcaatttgaaaatgtccccaggtggcggactctcttcgctataaatgcccccgccaggcgaccctttgccgccacttttgccatttgtccgattggaaattaattttccctctctcagccgcaaaaacaaaataagcagcatttgcgagtgaaattctgttggtaattgctacaattcgaattgattgcatttgtatggcctcgggggagagaagaagagcagaggaacgaagaagagaagaagaaaggtgagacaacgacagaaagggaagagggcattgagaagggaatgccgtgccgatacccggggcccattatttaattagtgccgtgccgacgacaccccaaccaattaattaagtttgttaattcatttgaattttacaaatgccaaattgcgccactctctgctgctgctgttgctgcctttgttgctccgtcgctgctccgtcttgtcccgagtggcgtcgtcgtgcctcgtccatttgcgccttttggaaagaaatggaggagcgcagcaaagagaattcggacagttggcgccgggggccactgaaaaaccagcgattataaagaagctgaaaatccttaagaaatccgagatcggcataaatggaaaaagtgccgacttctgtcgccccccccccgagcgattgcgtggcgaaaacgcatttcgaagttggaaaaggcaaataaacaaatgggggaaggcactaagcaccatcaaagtggggcatttgacttatttgccgtttttcccccttaattttcggttttgccgtcatttccgctaattgtttcacttttgtcgggtcaattaagccctttttgataattatttacttccgctgatcccttcaaattgtgccattgt

SEQ ID NO: 25146 - DNA, 1202 bp, Heterodera glycines
  misc_feature (56)..(56): n is a, c, g, or t
  misc_feature (75)..(75): n is a, c, g, or t
  misc_feature (101)..(102): n is a, c, g, or t
agaggagtgggaagcacttctgaaaaagtatttccaaccctactacgtttgtttantgggaaattttgaaaattngacctctttttgtaaaatttttggtnntattccatggattttgggtacgctttcttttctctcccctttccttttctcgaccccaccccttctgctgattgtcagatttgaatttacttgctgccttttgcagatgccattcgcgtgaagcgcctcgtctgttcgtcgtagaacaaccaatacatctcatccccttttgtgtgtgtaaacatcacaatcccttcgaacgattgcttttgctgctgcgtcggttgaatgcctttgctgctctccaccgtttcaatggcttttccgagttttaccattgcatttgctattggcaccaccgctggcgacggcacttcttttgaagaaaaggaggtcatgccatttggtgtgggtgtgggcgcttgtgagtgtgaggcgatgttgttgcatttttgcaaaagtttttggtgtctcgtggagctaattggcgcaccaaaagcaccgtcctaatagaaaataattttattcagaaaaaaaatgtggaaggaattctttaacttaataatgcggaattactacttatagtacaataaattttagcttaatcggttcacggtaagttataaaagcagaataaaaagacggttcttataatttagaacatactatagaatgtccgatttcattgtcatttttaaaaatttaaccgttagtcattttaaattaaatcaaatttaattaatactggcacaaataaaaaaaagtcgtaatttttaagcaaatcgccgccacctgcacagtgattttgctgaaatgttcgtgcaattggaactcgctgctgatccgtccgtcctcctttttgcgtgggctgtttttcgtctcgcaatttccttccgttacttttggctcttccagcgtttgtcgtttgctttccgtgtcgactcgcattttggcaatttcgagcatttcggccaccatccaaagcggctgctgttggtcaggcaatgatgaaaaacgggccctcactcgggccaataacagtgaagaaatggcgtcagtccctttgcgcttcatgttgctccaggcggacaacaaatcaccattcaagtcgatcagaacaccaagtcggtccaccttgagggagcccatgcgcaaacacg

SEQ ID NO: 25147 - DNA, 1190 bp, Heterodera glycines
taaacgcactttgcctttatctgttttcttggccggtggtggtggaggacgagagacagccttaaagaaaaaaagttcgtggattcgaaaacaacaacggcaaaaagaatcttcgtcagtgaatctcactttggtttttgcatccgcttttttgcccgatgacggcggcggaggacgcgaaacagccttaattaaggaagcggaagcaaatatgaagacaagacgaaaaacaagaaacaacgcacttttctccctttggttgtttttgcacaatcaattgggtccgctgaatacagagaagttggaacatcctgaaacgtattaataataggaatttaaaaaggaaaagcgcaaaacaaaactcactattcccgcgctaacgccctttttcggatgcggaaggcccaccggagagatcttatgatgggggcaatcaaacaaatgcaaaaattattggaaaaagcgccacgctgtgctcactgcggttgatttgagtggtttggtcgggcccgaaggacgtgaaggacggacgacagccttaagacagaaaaaagatgagatcgtgacgagggaatatgccgaaaaacaacaggaatattattcactttgcctaagtcggctttattgttcggcgcgctcggagcagcagaagttggagcagtacgaggaacaagcgaaggcggagcagcctaggaagggcccgagggagcgattggagtgggagaaacgacgacacgcgcggcagacggatggacgggcttaacagaaaaaagggaatgaaaaagcgcaaaaagaaatggcggcgtggacaaaacccacttttttgtcgtaagcaggcgaattgggccgctttttcttctcttttcgaccgaaacacatttatcagtacatgcaaagaaaaatataataatgctttgagcaaaaatttatcattttagaaattatttagcaaaaaaaataatgaaagaaagcgcaattagggaaaaactgtaggatgatcagagggcaaaaagaaatgatgaaaaagaagagcaaattaattccttttatatacatatgtatgcgcactttgggttaactccgctgtgcagagaaaagcctagcacatactatctcgtcgtttctctttttctttgcgatttctctcactttggcgtactatctcttcatttttaatgtgtaaaaacagg

SEQ ID NO: 25148 - DNA, 1122 bp, Heterodera glycines
ggcgccaaaaaatgagagcaccaaattaagtttactacaccccagaaacgtcttgttttggtaatacaaggacaaatgggcctgatcaggacataaccattgtgcattagcaaaagatacttaataagatccggcgccaaaaaatgagagcaccaaataatgttactacaccacagaacgtcttcgtttggtaatacaaggaacaattggcctgatcaggacataagcattgtgcattatgcaaagatactttataagatccggcgccaaaaaatgagagcaccaaataatgttactacaccacagaacgtcttgtttggtaatacaaggaacaattggcctgatcaggacataaccattgtgcattatgcaaagatactttataagatccggcgccaaaaaatgagagcaccaaataatgttactacaccacagaacgtcttgttttggtaatacaaggaacaattggcctgatcaggacttaagcattgtgcattatgcaaagatactttataagatccggcgccaaaaaatgagagcaccaaataatgttactacaccacagaacgtcttgttttggtaatacaaggaacaattggcctgattaggacataaccattgtgcattatgcaaagatactttataagatccggcgccaaaaaatgagagcaccaaataatgttactacaccacagaacgtcttcgtttggtaatacaaggaacaattggcctgatcaggacataaccattgtgcattatgcaaagatactttataagatccggcgccaaaaaatgagagcaccaaataatgttactacaccacagaacgtattcgtttggtaatacaaggaacaattggcctgatcaggacataaccattgtgcattatgcaaagatactttataagatccggcgccaaaaaatgagagcaccaaataatgttactacaccacagaacgtcttgttttggtaatacaatgaacaattggcctgatcaggacataaccattgtgcattatgcaaaaatattttataagatccggcgccaaaaaatgaaagcacccaattaatgttattaccccacaaaaacgtcttgtttttggtaatacaaggaaaaattgg

SEQ ID NO: 25149 - DNA, 1776 bp, Heterodera glycines
cgagggtgcgaagaggccgagggagtcccttcggtgcaggaaatttgttgagttttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttcagaaactgatcagaagcgcaccaaactttgcagggatactgaaaggaagagaaataacctattttaaatattatctagtcagttcatttaaataatttttatccaaaaaatttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttacttttgttttcggggcagtccccccgaaccgatgcgcccagatttatggggagaccgaatccttcgggaatagcttccctatagcctgtactttaattctgcgtggatttttgctccccataattgtttgagtaccccaaacggacacttgaaaaaatcgatttttttgttttcggggcagtccccccgaaccgatgcgcccagattatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcgggttgttttttgcataattaattcataaatatttttttcagaaagggttctgaaacgcaccaaattttatttacatgttagtttaggcactctgatgctttttctatcaaaaagggagatgaataaaatttttaaaaatttttaattcctttttaaacaggccaaaaagtttagacttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcat

SEQ ID NO: 25150 - DNA, 849 bp, Heterodera glycines
tggggcgaattattggtggtattgtcgttgtgatattgctatttgccggtggaataacggttgtagtagtgccagctgtgtctggaataattgatgtaccggggcgaattattggtggaattgcgttgtttcacttgagatttgtcctctttcgacctctccaacgtagtgatttaagacattattttgcgattttattgcttctcttggtactccaatcacttggttttttctgtcttgatctttacttatcggaaatgtgtactgaagttcgtggactactatggcctgtccgggccatgtctcagttgttactggtcccatagagaaatgcgtgtcccaatattctcccgagggaatgcgccacatcaaaagttcaactgctcctggcaggcgaacccaatcatcctttccgatcgtgaattgttcgatttttagggaatccccccatgatgtgacgagcatttccccgtctaaaattcctccgttcccttcttcgataactgtttggacattgttataacagttcactccgtaccagccgtactccttcctaattgatttaaaactttcccagcgcttctcgcttattctgttcattggacgataatttaaagaattttgacaatcgtccagtgatgtttccgattcgaatttcttcggcggatgatcaagagtaaccacgcgtaagaatgattcggtacatgccactgtcgtaacattccagcatttgaatactggaaatgaacgcggaattcgtatgggtatgtagagaattgatttgttcatgattggctgcgtctcagtcgggagagtacagttctgctctgctgggaaactcatagtcac

SEQ ID NO: 25151 - DNA, 1753 bp, Heterodera glycines
  misc_feature (1409)..(1409): n is a, c, g, or t
tgggcccgccaaattcgccataaaaatgtttcatccatgcgcgaattttttgatcgttactttggttcagcgagggcggtaacttccgtggaaaactccctttccctaaagactatccgctgaggccgccgacgatgcgatttgcgtcgaggatagtgcacccgaacagtgagcggactaccgaatgaatggattgacggcattggtgacattaaaacttgtcctcaacatttagttgaccgagacgggaatgtgtgcatttcgattcttcatggtattttcatctttttgtggggcggtggcggtggacaaatgttccattaaatgccgcagtttggttgagagtgccaaatataatcgatcaaatagcgtatttgaaaaggcaatcaacataaacattgacttgtaacttctttattgccattttcaagaaaaatacactaatttttcaaatcattcctttaccattgtttttgggttatgagtttggactttcgattctttcgtgatcatatttccaaccatttcccatgcctctactaatccctccaattgtcccattttttttacaattctggcccggttcggttgtcaagcattttctctttagagcctggcgatgaccgatttggctacgaaaaggcgtccgagcgttggctgcccgtccacacgggtcaatcgatacgaaaacattgcgaattgccaaaaatcgtttcttttcagttgagaccattctgatttcggtcatttcgatgctttccgacccgaactttgacagtccggcaaatgttgacgcagcggtaagcgaaggcggggagagacgatagatattttcaaattatgcaggaaaatagagaacatttagggcaatagaatgatttcaaatccattcaattcgggcacacttgaaaggagttatacccaaaaacggggccgacgcccaattgtcctttttcgaccccccaacctccgaatttttttaaaattcttattttactatgtttttttggcaaaattccctgagagttttttttttaatttcgactagaggaaacgatgcggggacggcagggggggaactgtttctctttttagggacggaacaaaaagcgcgagtctcttaatgaaaatatcgaattacagatttttagcgcattttaggattgatgcgataaataattttaaactgatattgacgtacgctaaaaacaaatacttcagaaaacgcaccgcgagaatccgacggagtacaggcgtcaggtgtttattcatttcatttttcctaaatactcgtacaaaatgtttcatgaaaattgttcctttttgttgttcaggtcgcgcggtgtgtgcgggaaacggaagagcaataggcaaatgcgtcggagtgaacggatggcaaccgaactganggggggaggacactgacaaatgaccaaccgaccgacccttttgaccccccccccccccctctcgtgtcaattttcgcctttcatcgctttttccttctttgtgttaatcgttcgtttcccgtttgtctcaattttcgttcaattcaaaaatcaaattgtttttgttttggtgttaagacagaactgattcagtcaatcgaatgcgaaaagtgttaccagcagaggtcgtattctaatcatttttgtgctgttttctatttgaatcgcttgagatcgaaatgaataaagtcaaattttgatacgacctgtgttgttggtacacatttttcccctggggcctttcg

SEQ ID NO: 25152 - DNA, 1191 bp, Heterodera glycines
  misc_feature (48)..(48): n is a, c, g, or t
taaatctaatctatgcaatgcttgggggccttttctatttaagaatgnaaaaaacaattataaggctcattcaaattccttgttttggcttttaatatcacctggcgcaaaaacaataataattattgttttcacaatactaatttaaaattcgaagtttaacctttacccaataattagtgctgaatcatttcccaaatagatttttcattcagtaaacataaataaatggtcacaaagtccattccatctcgatgccattctcgaaaacccagcacagactcctcagtcctagggccatacaacggacgattgagacagggcgggagtgtctcgggaccaaattttcatacgacggcacaacgacggggatcttttttcacattatttttttgtggcatgcttttttcaaaaaaattttgcggatcgtgggggagggaggggtccaacggtgcctatcggcaccatcgggtgaaaatttgtgcgccaatttgttaacatattttgtccgaaaaatgactaaatcttgcaattttaagacgctttttaaaaaataaagaattttatacaaatataaaagcacacagacaaaataaatggtaaattgtttaatggagtatcatttagaaaaaataaattggcgttaaaactattataagtgtgttagagaggttcatttgatacggctagcggtgagtgggtaattttttgcaaaaacgtattaatttcggtaaaaaaattatttcaataaaatacgattcctggaaatcattgaaatattgtttgaaaaattgtctttcaaaaaattttaataaattctgaaaacattcaaagaataaataaatactattttatttaaaaataagacaggcattatattattagaattttaacttattattattatttcaaaatgactctttccacggatatatttgtgatgagcggaggaagagcattgctggcaattgtgaccatattaatcaactgcactttggtgtttgtcacgcttaaagcaaaggattaataattaatgaaagataaaaaataattaaaattaaaatttaattcggcaattttaatatgttgtccgttttccaaggaatttgaacagcacatgcaattggctgatcggtgccaactcggcatgcagtgccatctattcatttacttattttgaccaatttggca

SEQ ID NO: 25153 - DNA, 1458 bp, Heterodera glycines
tttcgtcttgaaggcgaaaattcatcgcccaaaacccgttacttccggatctttctgattgattttttaattttttctcgcatcgattgacagctttttaatcccatcccacatacactaaattaagaaaagataatcatgaaatttttgattaatcaaaataaccaagttaaaattatgggcagtgcaatgcagtgattcaaaaccagcaatacgagtcgctttttgcattgcactttcgttgtcacgaacaataaggtgcactttttcagcgttcacaccataatcattaagaacttggctcagcaaaccacacattttttcgccagtatgactgccctaaatgtctgcaaaattgttaagtaaaaaccccttaaccgaaccttaattggaactgcttccatcacgcgaaaagtcggttccatattactgccaatgtaatgaactgtgacacttaataacgaatgttttccttcgtgagaactccagccatcgattgtaagagaaatgaagtctgttttccgaatgtcctcttttacgcgagctttcacattcacatacaaattcctcaggacatcacttgtaaaatgccgacgacttctaaattttaaagatttaaagaccatttttgttttagaccttattttgtacattggagctaaaattgacaataaatttttcaaggcttggtcttcaacaaaagagagaggcaatgatgccgaacaaataagtgccattactgcgtcatcaaccctttttgtcatttctccatccgaactccattgtgcttaatcgactttgaaattttgaaatatccaaataattacaaaagcttttgacgatttttggctgtgaagaagagaacggcgactcatttcttggcattttggcaggtgttgggctcaagcacaagcgagcagtacttgtacttgccaacaaaagactttgaattgattgttggccatttggtttcacttttgctttttcctcttccttcaacaattcttcatatttgtccggatgatgtcgctgcaaatgttctcgtagacacgtcttcggaaaagttgtagactttgagccgtaagaataactacagctcaaacatttcgctgttccatgagaaattttaaaatatttaatatatttgctttgtggtggcattttcaagctaaaaatgtaaaatgtgttaaaaagcatttaaaaagagatatacaatatgtagaatataaaataggtaatattgaagaaatatttaatttataaaattcataaacattatcaccattactcacattaagatcaataattaggggagtatttttacttcgaaaactcaatctttaggggtgcatttttcccgaaacttcgagcattttcacgaagctcgaagcacgaagttcgaagcccaaaaaacccgaagttttcgaagctcgaagcacgaagctcgaagtttcgccc

SEQ ID NO: 25154 - DNA, 1508 bp, Heterodera glycines
ctgtctattacatgagtatgtgtgatcagagaaagagagaagcaagatatggaagggagagagggaaagagaaaggaagtgaccagaggtgcgataggacgagagaaagaatcaaaaagttgactaatcatccgtcatttatacgatcagcaatgtgtcagagagggggagggggcaatagagagagagagagaggagggaggggggggggacacgcaaaacattgatcaggcagacaaataaagtgactgatcattaacaatgtgatgagagaaagagagagagcagatagagagagcagagaggagtgagagagagagagagagaaagcagaaaatgagagagaggagagagatgacaaagaatgagtcagacacatagatattttgatcagtcgttgcacctgatcagacttgagtgggagtagcacgacaggataagagtgaccaggaacttacttttctgtttgttcagcagcagccagactcggctgtcccatcggcttggctccacctcgtcattcgcttcctgctcaatcactgggcaccaaaatcggtaaaataaggaggggctcagtcgattggacatcaatttgctgtcgtatttaataataaattaaaattgaatttgatttgcagttcggacagtgttggctccagtcattcggtggcattttcattgcctggtggtggttccagtctgcttacacagaaattgttgcgcaaaaaacagccttccggtgaatgaatgggagatgattgatccaaaaaaatgtgtctcatcagtttgtgatcgattagtcatgaatcgcttgaaggacaatttgatcggggggctaacatgatcgggagggacatgcttgagaaaatttaatccacagctatcccgaatctcccaacttttttcgatccaaccccttacaccggttgtcgacatgtccgtgactgaacttctcctaaggcacatgaaatatcctttgatcacaaaaaaaaaaaattcagaaacggaattcctaggcaccaaaaattttcgatataatgttcaaaattccgatttttcggactcggaaattccttcccctccctggcccagggttctaatacttgaaattcagtttttttttaaatttaaattagctaaattactaacttctcagatgatcattttcggagtgatgaccttgttgagctggaattcatgccacaaaaaaagcagcagcaacaatttggtggagttaatggcacaccggcagcgatgccggtgccattcttgacaaattgcacccatcattcggcacaatgtgtgccgacaacggtcaatgaggacgcactgcggagcagtccaaggtggaggaggccagcaaaaattctgatcaattggaattagagtttttgatcaaaatcgttatgtttgccaacgaaattttttcaattctcgatgggctaaattgatgattttctatagaacacttttctggagatttttttgttttgattatttctaggttt

SEQ ID NO: 25155 - DNA, 1093 bp, Heterodera glycines
agacaaaaaactgagtgattgaaaactgccgaattaaggcattcctttgtgagaccacaattgaacatgaataactacaaacaaagaaaaacctcttcgtcaagacggttgtagcgagcaatatcacgatggagagttctgaggagaatcattccaacctttaatggaaatgatagagaaaaaaaaaatgaaaaaatcaccatcccggaaaggaaaatgacgatgacgagtgagttcataatggaaaaccattgaatgtttgtatgaggcattgagtcgagaatatagtcccaacgggaagaccatttcacatcagttggttcccaaacaattgaatacgagtaaatcactttgaactccttttctcccgctccaatgggctggggagcggcttccattccgcaattcattccacctttgctttcatgtttgatgctaaaataaaaattaagaatgaaatatatccaaaaatcaggtacttaatctagccaaaattcgggagtaattctccccctccctcgcatctgtgcccctcggataaaaaaccgttaattttctagcttcatatcattcttattgttagaggtttttattgaaaaataaatttaatatttttcctagaaaaaacatctaaatgttagcttaaagttgtcaaattattttatgatcgtgtaaactgcaatagagccgataatccctcgcaatttaaaaatttccaccttcttggctgcactttgatccgaattatacggccaccaattttctcatcgaggaaatttggatcatcagacatgtctctgttcgaggaaattttatttaaagtataattgtattagacacaacctgtactcaatcttaatatctacgtggttgaacaggtaaaaactgtcctgctgtcggtaacgtccctaaaaatatgtagtcaatagaaccaaaagaatactcgaagaaatagttacatccaaaacgcaggcatctttgggcttcccctcctttgtcacataacaacccattgggaagccagtggtgcacacattcatattttgctgatttatgaagcagaaagtgacaggcatgggtgtcatgatcctga

SEQ ID NO: 25156 - DNA, 1164 bp, Heterodera glycines
taatagttaaaatataatttaagtttacctaattttatattattttttacactaattttttatttttcatataattttaaatattgaacattaaatatttttgtatagatttgattatatttgagttgttttgaaaacttagacttcaatttataattgggaaaaataagcagatagatttaaatatttactaaatcaatttatttcttttcacaattatagataaaatttaaaaaaaaaaaaatttcttattttatataaaatattctctctaacattaataacatttattatcatttaattatgtcaagcttgtaaaatttatgaaatatttttttgttattattaatttatcaataaattttcacttcatttaaatgattatttatatttttttttcattgtttattttttctttactttaaaataattaattgcttaaattttgcaaacacatattcataaaaatatgtgattgcttttattttattttaaaataatggcaattttttaaacaattagttaattaatttattaagcaattgttgaaattatgtttattttaatttttattccctgaacctaatatttacaaaatttaattaatcttaatgcatgttttaatttttattttttaaatctggtgaaatagttgattaaaattacccgttaattgtattatttaatatagatttcaaacatattaaattgaaaaattttaaattaatttgcgtttcaaaaactatagattttaaaaatttttgattcgccttaactgctgaactaggaaaaaccacttaaaaaaaacttaatttagataaccaaattaaactaatatatttatcgtagaaaattaaataatattttaacagagatattagttaaaataagttataatacttatttttcaaatgtgctaattttgaatttaagtatcattttacaaatattaaatttaaaattattttttaaacagtaattttctagtgctatttaataaattttcatttaattcagatatctttaataaatttcaataaatttagtttagaaattttttggtgttttataaaaaaaaaataaataaaaaatatttattaatttcaatttcaattttggtcttgaaattaattttatttagttggtttaaatatcttactgttt

SEQ ID NO: 25157 - DNA, 1962 bp, Heterodera glycines
tttttctatatggtcttatttgtaagaaatgttttgattggggggtagtgccttattttcatctaaaagagggaaatttctgaaaaattgctaatttctaacaaaattcatataaagtcttaaaaattttcctcttgcggcgccaatcggcacagccggcctgcaaaaatcctatttttttcttaaaaattagccaaagatcttaaacttttgttcttttttggacaaaatttgttaataaattgcattcaaattttcaaaaatttttcccggcgggacctctcctttcgcacattcaccatgttttttggaaatgtgccgcaaaaaatcttaaaaatctgatttagtgatcccgaatgctctgaaatttatgatatatataataatagaatacatttttggttgaataaaatgtaaaaatatttgaagcaattttgcaaaatgttcttatttttaaccatagtcttattttttggcctttgttattttgaaaattttgagatagaaaccctggattaattgacaaaaacacccataaaaattgactattctggcataatttataatccttaaatttggtcattctttagacaaaatctgtgtaatttatgccaaaaagaattgaatcgaggcgatacatcaactaaagtaatgtggagccaaacacatcattcatattaattaatttttttgtgagattttcacatgcttgagcatattctaataaaggcccaggggtaaaaacttttgactttttttttattaaattactatttaaaattctataaataaataattaaagcaaaagcacaaattagtaaggcgatagatagagctcaaagaataaaaaaagagaattgataagagaaaattgcaaattagaagaacaaaatgaaaatggattattttataattttatttacactttcatttttaatacaattttcatcgcattttacgtcaatcacagtacacctttgctttacttattgtacattacagtacacttttgctttacacgataaatgaaataaaaaatttaaaattcataattaaaaagtgaattaaaaaatcacattaaaaagtgaattagaaactcacctttcctttttgtgaatatgagtcattttatcgctttatcagtaaaatattcccttttgttcaatgttcgaatgcatttaactgataaaatgaaaaatggccaataaaattttgtcataaatcgcagcaaaccatagtttgcgttcataacattttgaaacgagttggaacaaagacaaaaatttttcctgctttcatttatttgcaaattatcattttggaaaatttttaataaatttaatttgctgatttcaggatttgttaagaagctgcaactgttgcccaaagggatgtcagttccatcaaatcccctgccggatcagtccgcctccattggcaatctgagcattgggccgggtgcaaaatacgcagaaattgtcgatggcagcggcggttccgcactgaatctgttgctgttgatcacactggccaagtcgatcagttccgcgggcaaagtgtcaaaactgagtgacaccgtactccgcatggactacgagcaccgtaaccgacccgtgcagctgacggtcaattgggacgcggtgacgcacgacaaattggacttttaccacttccattggacaaagccggaggacgaagtgttggatcatttggaggtcgaagcattcattttcattttgtaagaaaacaaaaaccgaaatgatgacgcatcatggagcgatttcaaaatgtttttcaattggaaaagtttttccaattgaattaggatggcataatgccaacaaagaaggtatattattctggtttcggcagagtgcttatttgatggaacactcgtggccaatcgacggtaagcatcaattgagcgagttcaattacgtccattgcgaggggggggggggg

SEQ ID NO: 25158 - DNA, 1306 bp, Heterodera glycines
tttcattaaatttttttaataattattttaaattccattttttactttctttatttttaattttattctgttttttttgtttcattaaattattattttcatttttttttttgcttcattaaattttttagaaataattattttaaatttatttattgatttttttattttagttttttttctattttaattttattttattaaaacacttaccctatccgctggtgttccttgaatccaaagtcaaatttgtggacattcctcggcccctctccactgggcattgtaacgcatgtaattttcatagtaatcggaaaagcattttcatccccgtccccgctctgccccagcttattaatctcctgcatgataacatccgcattattctgggggtacgcccgatacggcacccaaacaggggaagcaagcccagcacccgtaattgccactccaaacatccgcacttttcgcttcattttttcttccgtagtttttaaagccacctttatcatgttgtcgattgcgtccttcatcgcttcatcggggcgctccacatccgggttgacacgaaattccgtaatatttttcgtaaatccaaatttttcgcaagttgtcgattggtaatccatcaatttataattttccatttcttcagcaaaattatttctgaacaaaaaaaatttttttgaaataattcttaaagggtattatcttataattgtatttataattgtttaagaaattatttttttttatttaatttattaaaaatcacttacccgattgatcggaaatcccattttttggccaatgggacggcgggttggaaggagttcacgcgtttaaaagacattttaaacaagaaattgcagcagaagaattaaagagggtagagagattttaaaagaaaaaagacgtaagtaaatagtaatagatttaattaatgcaaataaaaatagagcggagagaaataaaattagagcgtgaagagagtttaatgaaatccaactatttagttgaatgatttgcgatttgggccgggtgtgcgaaataggcaaaaagggggaggggtctagtcacgtgactgtctggggttgccttaattttgagggtaatcaatcatttccgtagacaactgtcacattttattcaaaactgcaaaaaaaaatcgtctggatattctttatttcgaaagtcatcaatcatttttcttgacaggttgcaaaattacgggccatattgcgaaatagttggaacagaaaactaaaaataatggagacatttaaataagaaaccaatcaatcac

SEQ ID NO: 25159 - DNA, 1313 bp, Heterodera glycines
taaaaagtgatctggtagatgaagtccacagcaatggcggccatgttgccaacacagagcagcgtgatttcgggtgatccggtgaacgagccgaccgcatccgcgcaaatgtttgtcagtgccgagatcagcacggccggcccagtctcgaccagcaccttgggcacaataattaaatttattttttttatttttgttaaattaaattaaaaacgaaataaatttaaatataaatttatttaaaattgaatccgctctctcaaatgataggatagactttctatccaagagtctcgagtcgggtcataagaccaaataccggttccgagaatttctgattttttcgggactcaatccccagttttggaaccatcctgtgaccaaatattggtttcgactctcgagagtttcttattattttaggcgctcaatctcttgtcgctgtcctgggatcaaatgtcggtccatgagtctcgagaatttcgatctcgaataccctgccgcacttttgattaatcattaccaatgccaatcgttggctgagcaatgtttgctcctctcccccggctgttgatccgccgcttgctgcatctgctgatgttgccgatagcatcagtttgcgctttcgtcgcatctgatcagtgatccgttgccaagcatgcttcaaaaagtgatcgatcaatcgattaatcaacgaattttaaagcgatttgtgccaaaaacgaaaaacatgccatcatcagataggcatcgtcaacaccgatggccaacaccaaaaaaggcgtgacgcacagaacggagctgaaaaattgggccataaatgtgatgaagaagggtaatggaaaatttttgatttaaaattactctaaaattttagaaatttctcatttttgaaggccatgcacccacccagctcaaggtgccgatttatgcaaaattcggaatttacgataaattttttgattatcatccgaaaatgacgggtaaattttttagttttctattgtaatttagagcgttttttcatgggaaaaatcgaaaaaaatttataagtgaaattctctccaaaaaaattttttttataaaaaactaagaaagttataaaaggaaaaaaatcagttcagtttttttcgggggagaggaacgaactattctcgatccagtgagatgcttaagacttttgatcaaaagcacatccctccaatcattctttttgacataatatggtggcgaaaaaattttcgcaaaaaattgctttggcatttttgccatgtcttccttttttaatttttaaattttttacgaatttccta

SEQ ID NO: 25160 - DNA, 1281 bp, Heterodera glycines
tatttatcattgggcttgtcaatcaaaagggaaacaacaaagatgctgtttttaacgaataaagggcataggttattttgaagaagtgtcaaagaacatgcagcaataagcctgcaaaatttaataagtggaaaattcatggagtatagaattattttcagaaaagtgtccacatacttttggaaaaaatatatttgcaatttatcaacaattttggagaagtgagttagaaatgataaacttcacgattcaaaccaattttcgttgctctaattaaccgcgataaaaacattcgaatcaattaaatagcttctgagataataaggtttatcataaaatgtcatttaaaaataaaccctcaattattggtgtgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatgcacgcgttttgcgctcgagctatttatcatcgggcttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatccacaattttgagaagtgaggttagaaatgataaacttcacgattccaaccaatttttcgtgctctaattaaccgcgataaaaacattcgaatcaattaaatagcttctgagataataagggttattcataaaatttcattttaaaaataaaccctcaattattggtatgaacgaatattttcaaaacatgcaccccgttttgcgcttcaagctatttactctcgggcttggtaatccaaaaccgaaacaacaaa

SEQ ID NO: 25161 - DNA, 1224 bp, Heterodera glycines
cccgatgctaatctgttccgcagagcctcttcaaaatttttttcccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaattttctatctcgtaaccccgatgctaatctgttccgcagagcctcttcaaaattttttccattaccgcaagagctgcggaaattgtgaattaattctcagaaaaatggctatctctttttaggacaatattctatctcgtaaccccgatgctaatctgttccgcagagcctcttcaaaattttttccattaccgcaagagctgcggaaattgtgaattaattctcagaaaaatggctatccccttttaggacaattttctatctcgtaaccccgatgctaatctgttccgcgcctcttcaaaatttttccattaccgtagagctgcggccccccccctttcactgttttgcattttatttatatttgtgcaatttggtgggacatcgccgccgtttcaattcgtctccaaaaatggaggggttgtgggaagaaggaagtttggagcaataaaaggacaaagatgaggacgaaagtgtggggccaaagtgaagggggggggggagggaagagaatgcaaattgacattgggggggaaacagcggagaatcattcgttcattcattcagtcctttcgttttgtcctttcgtcgtttcgtccgttttccctttccctgcgaatggccaccaccgaatgaatcacttcttcttctactgttgtcccctccctttgctcattttctgtccgttcaagggggaaatttgcattaaattctcaaaacttcccaaaaa

SEQ ID NO: 25162 - DNA, 1555 bp, Heterodera glycines
cccccattcttcgggattgccgaaaatgtttcaacaattttaaaacccccatttcgtaggaccatttgaatgaatttctcttcggcgttttggacggcaacggcggcgacggcggcgacaaaccctgtgaagatgaggcggagcttatgcgtcaaattgagcaattagaggaggaaatcatccgtctgagggctactcttgagacttagcagcgtcgatcattggaaaattttgacgatttatttattgtattgacccatcttgaaaattgtcccggtaatactactgacgatgatccccctatttgaaaaaattaaaaaaaaaaaatttttctagaactaaattgttttaggggttaccagggtcggagtatccgattctgacatcaattttcgatcaatttcgaaccacagaaccggattcgaacaagattcaaattcacaaatttttttattcaaaaaagggagggggtaccctcgacagtattaccatggtctcagttcaaaaatattgccgcttttgtaatttttatttcatttttcttttccgattgcatcataattgtctcctttccctccgagtgccaccgatatcttcagttcttctggatgccattgacaaattaataaaacatttaaagcgaacccaatttatttaatttgtgttgcattcatctcttaattatctacaagcaaaatttaagaaatttttttccccataactttttttagtctattactttttgaaattttgtatatggatagagaataattggggctattgaataataccaagaacgttcataaaaaactggttggttgcccttcctaaaatgctattaaaaatattttttcatagagcaacgaatacataaatacatcagttcgatgtctacaaatgatgttacgaaaggaaaagtatcgacgaaaattcgttgagtatgacggcgttaaaagcattcttttggcattgaatggtcgtgccaattttcaacttcaataccaactcattttttgcctttggtcggttgggttttttcgcacttttaactcaaaaataatcctggaaaaagtttgttaatttaatttccccatttccttccgaaatttgttggagaaaattgacaacagagagatggtgcgcgaatcggcactgcaaatggtccaatgcaaaacgctgaaaacccttgaattgatggacgccaaaaagtttgacgacccggacttggtgagagactgcataacttttggcaattttggatgggaaattaaatcaaattcaggtggacgacattgaatgataaagtggattattactttttataaagcttataaataacaaacaaattctcagaatactcatcaaaattctcgagaccagcagcgacccattgccgctcagtgttgctgctcatgacattggcgaatacgtccggcattaccatcgcggaaaaacgtttatcctaccgcaaaatttcagaataacaaaacaatttcattttatttataattgtcgaacaatacccaagcaaacaaacaatgatgaagatgttgag

SEQ ID NO: 25163 - DNA, 1933 bp, Heterodera glycines
ctttgcctattttagacttttggtgcttaatgcctattttcctatttttatgcatatttcgccatttttggcgcctttttcagaattttcggaaaaatccttaaccaaaataaataaaaacgaaaaatacacccctaagaatcgaccccaaaaaatttcagaaaatacatccataggattgaaaaaaaattttcacaaataaatttttgctttgcaaaattttttggtttaaaaatttgtccttattcgaaaagaactttaaaatatttaatttaattcatttacaattgaaatataaccagaataactttttaaattaagttttacgtgttttgctacctaaaaaagagtttaaaaaattttacttgcctattttagtgcctatttaatggctattgcgatttttttgccttttaagtgcctatttcgctatttttagtgcctaaaaaacgaatccttattaattgctaattgcatgtgcaggtatttattggctatgtgaagaaaagtgcaacttacgaaggatgcgttgcgataaaaatattcaatcaaaatttttacaatgtttatgagaattcaaaaaattttatgcaaaagattcaaagcattcttccgcctgacgagagaaagcatttgatcacaatggttgacgcgtaagaaatttataaaaaattattttaaaaaatattatttttaaattaatatttggaatttaatatttaaaaaataaatagcggaaaactgaagaaacagaataaaggattagtcataatggaattaggcttacaaagccttgaaaaaagtatatatgaaaaaagaaaaacatttgaaagtgatccgaacttatttgaggatttgaagaaaattgttgagccaattttggaactgcacaaaggcaatttttataattttttaaattcaattagtaaattttttttaatttactggtaataaatacctatttcatgtttttagtcgcaatccatggcgacataaaaccggataactttatgtatgtcaaaaaagtgggcgaaaacgaaactctgaaactgatcgattatgacggtgccactttcataccagttgggctatttgaaaacccgagaagactggcaaataaagttgtgccacgtgagttttatgtggccaccccaacttatgcagcaatcgaatattatgaggagaatatgatggtaaaaatgaattataaacaattaaaatgccttttcaaataaacattgattaaaccattaaagctcacaactaaaatggacatgtgggcacttggaataataatttacgaactcatattagtacaagcgaccttcaatgagcgaattagcatggtaggttttaaaatgctaattagtaaacaattaaaattaaaattaatgggatcaagggaaaaatcacgcaaatactgctgggaattggcaacatttacttgggcatgcaaagaaacagcagaggaataaaactaacggaagaaagtttatttgaaaatgactcgtgggcgaaaaataattgcgcaagtttattgaccattttgaatgtgtggcaaaagtacccgaaaactgcccttataataacggtaagttattaaaattttaaaaattaaattcgaaaatttactaaaattatgcaatggaaattggtttctaatagagaccggatgggatcaggaaaaataaaattttctcaatcgagcgatcaattataaatactagatagcatttgaataaaccttggcacaaacgcaaaaaaatggattgaccgggatcgggatgtcgagatcccgacccggtatacgtgtcgatcgtttttccaaaatattcgggattgaccgggtggattcggtcggatccttccgatctcagttgtccggtctctagattctaaatagttaaatttcagaaccttttgcacccggaca

SEQ ID NO: 25164 - DNA, 1120 bp, Heterodera glycines
ttttaaaaattttttaattgctttttaatatgccccttaagtaggcttaacttttttagtgaaaattcgatcactctattttttgctaattgagcagaagcgtaccaaactttgcagggatactccccggtaaaggactaacttacactccaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaaatcgattttttttgttttcgggggagtcccccccgaaccgatgcgccccaaatttatggggagaccgaatccttcgggaataacttccctaaaagcctgaactttaattctggcgttggatttttggttcccctaaaattggttgaggaacccccaaacggaaaacttgaaaaaaatcaatttttttttttttttcggggccagccccccccaaaccccacgccccccagaatttttgggggaaaacccaaacccttctcgaaaaaagtttccccaaaaaacc

SEQ ID NO: 25165 - DNA, 966 bp, Heterodera glycines
  misc_feature (912)..(912): n is a, c, g, or t
  misc_feature (919)..(919): n is a, c, g, or t
aagtgcaaagtggtgggtgtctgcaaaaaattttcaccagggtttaataaatctaggaaaattagtaagcatttgtagtgttccgatacgtatccctgcaaaatttggtgagccgctgatcaattacaaattatttatggacgatcaaattttttgaaatttttttaagtgaaaaagtggtgggtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgaaaaagtggtgggtgtctgcaaaaaattttcaccgggtttaataaatctaggaaaattagtaagcttttgtagtgttccgatacgtatctctgcaaaatttggtgagcccctgatcaattacaaattatttatggacgatcaaattttttgaaattttttaagtgcaaaagtggtgggtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaacaaggcccaattaagattatttccagaaaatctcgcatgaattctcatttttaaattttttacagatttttaaatatttggatatttttttggcttaccaaaacttcatcgaacctggctctttctattctcattcaaatcgctccaaattttttttacagcttaactaggcccaattaagcttatttccagaaaatctcgcatgaattctcattnttaattntttatagattttaatggtttggaatttttttttggcttaacaaaact

SEQ ID NO: 25166 - DNA, 501 bp, Heterodera glycines
tatagtctggccggtatagtctgagccaagtttagagcatcataacttttttatttgtgaaccaaatccaataaacttggtatcattcgaatgctcttaacaagctctattggctttccaaaaaatacaaagatataccgacatataaaaaagttctaagcaaaaattctgaccttttggtagtcttcatgtttcaacttttttataagctgttaaatcgcttagaaatgcttatcaaaagcttctaaacatgtagagctttcgaaggtttctaaattcataaaatttggccagctgagaaaaaaaaagttatgatgctttaaacttggctcagactataccggccagactatggtgtcccccacccaataattttaactaaaattaataattgaactactcttgggacaattggctctttgaactttttctttttaaactttatttaaatgtcggagaggtcggtcggataaattaagcgaattgggggggggggggggg

SEQ ID NO: 25167 - DNA, 160 bp, Heterodera glycines
cacgatgttggcaaagatgtcgcggaacagctctggtgcagtttcccacagctttttaatcgcgttgtatgcaccaacgaaggttccgatgaacttgttagcgttgttcgcaaggaatcctccaactgcatccagcacgctcttgaagtcagttgcccaa

SEQ ID NO: 25168 - DNA, 1282 bp, Heterodera glycines
ccttgctgttgaccaactcgcccattcattcagatttggatttaatttttggcataatcaaaaattttttcctaagggatttcaaatcggaaaatatttgaccaaaaacggcaaaatatgcaaaaaatctgaaaatatgtacaaaaaatggcaaaatatgcatgaaaatacagaaaaccccgaaatatgcataaaggcccaaaatatgcaaaaatatgtaaataaaagtcccgatttttatatgcaaacacaaaaaagaaagttttttcctactatttagagcatggagaagccaggaaaaaatgcatttgcatattttttgcagccctggtcataatggcttagaaatataaaacagtctatcctaatcaagtacaaaaaggcgttaaattacgttaaattattgttaaggctagaatggaaacaaatgaccaagagcgatccagatttgttttctcaaacaatcctacagaagaaccggaattacttatgcgaactgaatttttgatagaaaaagcgagaaatgatgttaagcagtggttgactcttcccaaaaacaaagaaggcgcagatatggtaataaatttagatcttaaaacaaggacaattttaatttagtgcataaatgaccttgaaagaaaaaaaacctttggacaagaagatttgtatagatatgacacttaaatgaagttccctttagttttttttagaatccttggagacccagcgagcaaaggaccgtaagaaaagttgaaaatgcaccctcccttccaccacccttcccttttgttaattgatttctttatttggcccgcttagggagtactgtaattatttgagttgatgatgagaaaagttctttaaaaataaataaattaaaatcacaggcacctatattttcttttatcaaaaattttaaattttttatcaaccccctcgctgagaatcagcacgaacggattccaaaggccacacagcgagaacctttgtgacggtcgttccagaaagcaagtcgattccagctgccgattgttcattgagtctctcaattgctgcagcaagtgctgccgcgttgttttgttcaggaggtcgaagtcgaatcacgtaagggacgatcaaatccaggcggttggagctgcagtccaactaacattggactcgagtgcccctctaagacacggtcgaaaagatgttgaatgaggctctccatcacaaggtcgggacgctcattgtcctccaaaggcaaaatcaaggatcgcacacctcccactcgtgtttctca

SEQ ID NO: 25169 - DNA, 849 bp, Heterodera glycines
taccgtgtttgctctaattatcgccccggggggattattgttcaacctcttcagaaagggggggattattagatacggggggaaaatggagaaggggggattatttttcgacagatttattttgtgtaaaatttttgaaattttttgaacatgccgccaaaaaatgtcatcgcgtcaaaaaaataataattttttattgcattttttaaagaatttgtgaatttaacatgaaaaattcgaaaaatgctaaaatatttttaaaaatattgaaaatccaaacccaaacatattttttccgatattttttggaaaatttctcaacaaaaattcaagaaaatcaaaaatacacccctaagaatcgacctaaaaattttcaaaaaatacactcataagaaattgaacaaaaatttaaaaaaacttaaaaattggggcaatggtaagtaaagttttgtggtttcttcgaaaaattatttaaaaatttaagaaacacattttctaggctggaaaaatgtgctgatcacgaatctgagctcggattttgcaaaataattgattttatctatgatttttatcaagtactagattttttccaaaattttaagaaattagtcgggcgtaaaaaaacacacaggatgttgtagagctcaaaaagagctttcgaatgagctattgaatgtatggagaagtcatgtttttagttatttacgattttttgaaatttaattactagcccttaatggtcatatgagacggggtttcttttgattttgtttttttttgtctggggttcgagcccgcttggctgtgtttattaaatttttaaacttattttttgaagaaaccacaaaa

SEQ ID NO: 25170 - DNA, 1236 bp, Heterodera glycines
tttgtcaaaaatcccggtcccgtgcaactctatttaacatttttaaacatattttatgtacattagtcgcaaattttcttccataaaattagcagcgctactgatgaaagataagaaacttaaccattagggcatttgcatatttataatgcgacaccctatataaattaaaaattaatttattcatttaaaaaaacttaaacttagtttaaaaattttattttaaatcacaaatttaatttttttttataaaacttattcaatttgtaaacagaatgctttgcaggctcaccatgcataaacaaatttgtggcgggagcgggggggggggggagcaaaatgcgcattcacccgtcgcatcagctattagcagcgccacaatgtggtgccatacttatatctatgcatgtggcatcatcagcattatcattgtcgttgtcattgccgtgttgacgtgccatcaccatcgccatttagggcgcaataatccgatgatccccccgtcccaggtcgatgagtgacctgtgcaagcacacgccgattcgcgcacgatcttcgtccatccaaaaagagtcgtcgtgatcgccaatatatttttgcccccccccccgccctcgcccaacgacgcggggagtacagcttaaaagcgcaccaaatttgagtgtatgagtgcgtgagtgtatgtgtgcattgatgatgatgtgggaagagatgagatgatgcttcactcattgcactaagtgccgaaaatgtgttccacccaaacaaagtgccgcccgcaccctccctcactaatgatgatgatggacaaagcatgagactgaccaccactcactgactcaatttacgctagttgcgtttgtgcaacaaaacacagagcactcaacaaacttatctcccaagagcagatgatgggacgtgataatttttgagaaatttctaagaaattgcaaaaaaaaagccataactttttttatcgtactatgggacggttaccccacatttgcgccctggacatttcttcaaggtccaaaatcgtgttcaaacttaagtcttttcaatccctgatcgcttaaacagcataacaaatgatagaaagtgattggacccgataattgatcgtcagcaaatttttgaaaaaataataaatctttcaaacaacagaattattattcctgataaaccaaaggaccatgttttcttaactttaatgctgtttaggctattagggcttga

SEQ ID NO: 25171 - DNA, 1008 bp, Heterodera glycines
acattgcaatcagcatgactcaaccctccaacattcaattattgggactccacccaccagcattccaatctctgggactcaacccacagcatttcaatcactctgcgactcaatccacagcatttcaatcgccgggactcatgcaaccagcattccaatcactgggactcaacccaccagcattccaatcactgggactcaacccaccaacattccaatcaacaggactcaaccctccagcattcaatcaacaggactcaacccaccatcgttccaatcaccgggactcaacccaccagcattccaatcactgggactcaatccatcatcgttccaatcgccgggactcaacccaccagcattccaatcactgggactcaacccatagcatttcaatcgccaggactcaagcaaccatcgttccaatcgccgggactcaacccaccagcattccaatcactgggactcaaccctccagcattccaatcgccgggactcaacccaccagcattcaaatcactgggactcaacccacagcatttcaatcaaaaggactcaatccaccgcattcaatcactgggactcaacccaccaacattccaatcactgggacccaatccaccaacattccaatcagtgggactcaacccaccaacattccaatcaacaggactcaaccctccagcattcaatcactgggactcaacccaccaacattccaatcaacaggactcaactctccagcatttcaatcagtgggactcaatccaccaacattccaatcaacaggactcaaccctccagcattcaatcactgggactcaacccaccaacattccaatcaacaggactcaaccctccagcatttcaatcagtgggactcaatccaccaacattccaatcaacgggactcaatccaccagcatttcaatcagtgggactcaatccaccaacattccaatcaacgggactcaatccaccaacattccaatcgccgggactcaaccc

SEQ ID NO: 25172 - DNA, 1348 bp, Heterodera glycines
tattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaacaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctgttagtatcaaaaaggaagatggagaaaaaattttttgggaaggttttccttatattttggttatatcgttttgcttttggt

SEQ ID NO: 25173 - DNA, 1227 bp, Heterodera glycines
cccgaacattccgcaagaagaacgaatgcaaaatgggacacactgaatttgtgttgaagcaataattaaaacctgattaaacaaccattggcatgcagcagggacaacatccggcaccgatcaaaggcaaagggaggggaggcggaagaaaaggcatcggaggggggaggacgggcaaaagctggtgggcacaacactgccaaggaggggattatatggttaaagagggagtgaggggagggggggaggtagcggcgttactggagaaatgccaataggagcagcagagcaacacaatgggaagttgacaggtccaatgccgccgaagggacagcaaccgccgaagccgaactggcgtttggaacgaatcaatctggcgggagtctcgagagaagaattaagcgacgaggacgaagaagaaagagaagccaaagggaggggacaaagttggaggaggaaaagcagggacaaaagcagcaggggacagccgggggacggaagcagggagcagggccgagttggggcggacaaaggcattgccagaggcagcgaatgatgggatgaatgctgcgcgacccctgggaggagggcatccgcaaaccctgggaaagttccactcaattgtacatccttttgtgtatgggttgcggcgggcgacaaacacttagctgcccctcatccggcactgtttgcccttctcgccaaattcgccgactgaacttgaaaagactccgatcgctccctcctcgacgaactttcattttctgcctttaaatgtctgatcactcactgcttttatttgttacaatgtatttttattaaagaatgagttaaattgaattcgtttctttctcttccattcttttcttaggaaacatcggatggatgggatgggaagggatttaccattgttacaaagtctaatctctgtttctcattactctctctctttcacacactctctttctctctcaaattatctgacgaaacgaaatgtgcttacaaagggagtgataatctctttaaactggtctaagagaaaatgaaaaagcaaaaatgcggcgtaagagaggcgtagccaatcaaatcggagtaagcgaaggcgagagagggagagagagagaagagagagagagaaagagagagggatagagagggagagagagagtgatatagagagagaagagagagagagaaagagatagggatagagagggagagagagag

SEQ ID NO: 25174 - DNA, 947 bp, Heterodera glycines
  misc_feature (935)..(935): n is a, c, g, or t
tttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaagaatattttcgacaaaacataaccaattccgagtttcatgaggcatcaacttcattcttttcttgtcctgcccaattgtctcaaatgtatacctaaaaatgcgctaaaaatgatcaaacccgtttttagccgaatattctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgccccaattgtctcaaantgtatacctaaa

SEQ ID NO: 25175 - DNA, 2610 bp, Heterodera glycines
tatagtatgtttctaaattgtttataattaaaaagttttattgttgacaaataaaataaaattaatactttggggaaaatgcttcttttcaaatgccgttgcgcagcttcaagaaaaaaaactgtggatggaagggccaaaaaagagagtaaacatttgagatggcgggggaggaggaaaaacatagagagcagtgctgaaattatctatgcttactagtgatgctcgagagtatcggtctcaagtctcgggaaatttttggtctcgaacatcactaatgcttaaattagatgacgagcattggaaaagccccgaggaaaggggcgataaatagcgtttaaagccaaaaaatgcattaagcctagcaaactgaaaaagactaatataacaacatttttgtaaataggaaataaaatgtaaaaaaagactgggtttcaagatgacctgctggtcctggatttcctagacaaaaattcaggtccaggaaaaacccaggttgccgaaaaggacctagacctgtatccaggaataatccaggcctggatccaggtccaggtcgaactttatttaaaatattacaaaaaataaattaaatattaaaaatttcataaattttattcaatgtacaaaaataaatcttacataaaataaataaattcaaaaataaataattaaataaataatgggaaaagcaaaaaaggtgatgaattattgccgtgaggtgggaaagttcgagagtctcggcggaaaatgagccacaaagaaagaagaacattcccacgcatgaagaccaaaagcagcaaagattgtgcatggatattagccaattcaaaagaacaaatttgttttgaaaaatggctttatccatggacaagtaaatccccgctgctgatgcgtttgcattgctcgaggcttaaaggattttgacacgagaaattttcgcttttcaattaatccatagaaaatttgttttcgagagccggaaaaagatttccatgtcgagatttgtgctaaacttcgatgtcatgactactcgtacaaaaggcaactcgtacaatggcttagactaggcaaaagctttaggcttagacctaaacttttttaggccaggcttaggtttgcttgggcccaggcttaggcttagctgaggctttaatttgtaaaaatttgtacctttttacgagttgccattgacccccaaatttcagccttaagcaataacacaacattcgaaggagacccgggatggcacttcttccgacggcatttcccttccgacgcgacgccacccctcaggcgccggccggccgtggcacttccccggtcttcacgtagtagcgcagctcctcctccgagttgaccaccacaagtcggcgccgcacaatcgtatcaccaccaagcacgatccgctgttgttggagtgctaaaaaggggaaaacaatgaaaaaaataattttaaatatttttgagtatttaatttgagtctaacttcaaaaagtgtcgaaaaattttaaagaaaattattagaaattggacccaattaaaagacaaatcaatttgacaactccaaattataatgcgggaaatgtaaagttaatggaaaatgaagaatcaagacaatatcaaaactactttaaaattacttcggagttaattaacataattaacaccgaatgctgtaattttacccaaaattttgaatttatcgagggtctaaattcggtgcttcggttgaaaatttgtcgcataaaaaccacaaattttttttagaagtgtatgtgccacaccggtgttcatgcgcagcgtcggtgctgcgctgaccaccggcgcgtccggcagccgtcgatggggcgactgggccatctgctggtgcgcgtgcggctgcgtcggcggggtcgtcgccgggcgggtttgcgccaccggcgccaagcgacgactgctgcgacaaaaggccgccgagctgtcgctgcagctgtgggttggcaatcagtgcggcacggatttgctccagggtcagctcggcgggtgccggagtgccgtcggcggtgccacgccgggcgcggctgctaaggccaagcgtgcgcgacataatgtcgtcaccagggcaaccgtccactggcggacaggtggtctgaagaagtgcaataaattacccatctaattggcaattaattaattagtttggggtaatgaatagaactcgcctgagggcatggtgcaaatgggcaaatgcgcaccagacaggtgtactgtatttgggtggtggtctggtaacggaatgactccacggtgacgcgaataccgtagtcggtcttctggggcgggcacaccagcccaacatggtcagcttggcagccgtcctaaaatggtagaaaagcattagacaaaaatgtgcgatagtgtattagggcaaggtatatatggcctaagcggtagtcaaaaaaatccatatacctatctcacggatcaataaatggaaatggcatattttaaaaagtgagtaaaatattatttaaataaaaagtaagttatatatagtattttaatattttccacaaagtttattttagggtttctttttcagaataatgctttcctacgggaaaggtg

SEQ ID NO: 25176 - DNA, 1665 bp, Heterodera glycines
tctcaacagcacgccttttggtggctgtcgtgattttttgcgcaatgacgcgacttggatcccgttcatatgtgcgttatgtcgccatgcggatgaattcatctcgaagtaaagtccaaatccgtcctttgcatttgtcgacactgctgttcttgaattccaatcgccaaaatttagttgttccatcggcacttgtcttggtaatgtgtagagatggctaccatgctgtagctttgggctattcttttgtgttaatttgctgttgcatactgtaagaatgatattattatctttaaaaacgttaaaacataaaattttgataacaaaatttgattcaattataactaatttgtttttttaatattgataatatttttgaaaattttattagtttcaataaagaattttttgtaattttgaaaaaatttattggggcccaaacgtgagggcccaactgacgtgccgtgggaaaacttgaaaattctggccggttattcaaaaaagttacttcgaaagttcaatgatcacatttaaagtataaatgatgtctcaccgttgaggtccattttgtccttgaatttgaaaaacgccggtgtccgccaatagaaattgttcctcatcaatctcagtgcgcttgtaaattagcatacccttgcattggtctgacgggccatgaaactcacaccgccaaaatttcttaagtccatcgttactgaatttgtaaaacacataaagtgcaccatcatgcaccaatttatcattatttcgttttgttttaattacttgctgctggttcattttgtagttaataaaagcttaaattgtcaaaacattaaaaataattttacttaaagattaacaaaattatttgaatgcaattttttccatactcactcgtacgaaaacggcggtacgaaaatgtctccggtacgaaaacggcggtacgaaaacgtcccccgtacgaaaacggcggtacgaaaacgtcctggcccgagttaaacaaacttggtatcatttgaaagttcgtgaagaggagaaacttttcaaaataaattcttggcatttcgctgaagtccaacacattgacaccagcagaggataaaagtcgctgatgtacgcggtgaagcgttgggagactgaattggtgcgacatttgctgatcattggcgcgaaaactgttgtttccgactgatcagaaaatttcattttcatgcagcaaaacgacgaccaacagcagatgtgatggtggcaatgagagggaatcgcaattcacaaacaatcggacggatgtgcttattagtgcatagaattatatggaaattcatatttgtgccatttatgccatatttcgcgattttatatccatatttttctatgtatgtcctagtgattatattcgatcacttttatgtatgtacgtcagggctgggcgcaattacggattgcggattacggaaattgcggggtttttggagttacggattgcgggtcgcggatttttgggatttatccgcaattttgatccgcaatttgacttttattatttttcgagacgatttcttgcaagattttttataaaatgaattttttttcaatttttattaaaaggctacccatatttcaatttcatctgacttattcttggtaatttttagtattattaat

SEQ ID NO: 25177 - DNA, 2050 bp, Heterodera glycines
  misc_feature (94)..(94): n is a, c, g, or t
  misc_feature (112)..(112): n is a, c, g, or t
  misc_feature (129)..(129): n is a, c, g, or t
aaaaagtaaaatttttcaagaaaatcaaaatttcagagttaagctgagagaaaagaaattagctctgtaaatcattaaaatgtcattaataatnttgagtgaatgaattcanagggggaattgtcttanatattcatatacgacaaaacaattccactttccatcattttaccactcataatttatgacaaaagaaagatggatgttagcaaccagaggccatatgtttcatgtttttagtttaaaaagaatgatcaaattatttatttcttctcaaaaatttttcatttttcacaattcaaaaaaatattattttctctgtgaaggttttttatgaaattcttttcaattttccatttggagcaggcttgccgcgggatgggaaggaaccgggattcgttcgggtcggcttttcacgccgagaatcgggacggactcgggcgacaaccctgagaagaagcactggaagaagcatttctcgtttaactctgccaaagaaaaaactgcatttaattaattaatacgaattattataattaatcacgatcatttattatttatgtatctttttctttgattgattatacattcaaaaattaaatgcttttcccgccgaaaacaaattttgccgcccgttggtctttgatgttttggcgttgtgtgcgatattattgcgaaattcccccttctctcttttccattcattcattcgtataaaatcgctttccgttggctctgtgctcaatttggcgagccaaaggcgcgctgttttggcggttggcgtaaacaaaaacaaaaaatacgaaagtgtcgagaatcgagaatgaatgaatttgcttaccttcccatttatttgctccatttattctccgcgcaaatgggccacaccttaagaaatttaaaattccttatctaattcgtcattaatttagcaaaattatgagattttacatattcaaaaatagttctcgatatttttcaaattgaaaaatcggaaattctgtaaaatttctccattagctttttgggattttcccattttttgaattgtcacattggacttttttttgtttttggttttctctgttggctttcggcattcgtttgttttttgtttcgttgtggtgaaattttgtaaaaaaataatcttctttacctgattaattttttttaattaaattaaaatataccaacaatataaacacgcaaaaatattttttaatggattttaacttttgagcttttctttatataaatctgagttgtgttgtgttgtgtttgttctttaatttaattggaaaattcttttaaagaaattcaatattcccttttttcaaatgaaaaaatgagtccattttatttttagagaaaaattatttatttatttattttcaattggcccaaaaagctttttcttaactgttttaaagccaaaagatgcaaaaaatcttttttgtttgatttgtaatttgagttgaatgagtgggcgaattttgtacaacaaaaagtcacaaaaccatcgcaattgtttcaacaatttgggcaattttcttttgccatttgtccaatttttgtcggtataaattaatttttaatgctaatttaatcttcagacagtcataaaaatgcttttctacccaatttctgtttctttgattttgttcaccttttttgccggaagcgctgaagcgcaggtaaattcaacaaaatattaatgttattatttttggtatatttcctcaattatattaataaaaaatatatatgcataaaaatgaaatttatgccaaaagtaaatccaaaaataaattttcggttttttcttgttttgtatttttttctgaaatggttttttcataccatatttagctatttttgagattttagcttaaattaaggaattagaagaaattttgagaaattatacccttatttggaaaattatctgcatgttttacagtttttatatgcatattttgcgatttttcgtgcttataaattaaagtcactaattattttattattttttaaaattaataacttttgttta

SEQ ID NO: 25178 - DNA, 1284 bp, Heterodera glycines
  misc_feature (10)..(10): n is a, c, g, or t
  misc_feature (76)..(76): n is a, c, g, or t
atacataaantatgcattaattagtaaatgaattaatttaaaatatacaaaattaattaattaaattaacatactntaaaaaaataaaaataattaaccatgagctaaattaactaaaaaacgtaaaataaaaaataatccatttattattatgatttttccaaaaaaaaaagttggcactttttgtgtccgacttcgaactgcgcactgtgcagctgccctcctaccaacagttgtcccaccgtgccgcgcttgaggccgaaccgttgctgaacgcgtactgctcgcacatcagtgggcacccgaccattgtcacattgaccgcaaaaggtgcgaaaaaacgatttaaatttaaatttaaaaataaatttattgaaattaaaatatgcaatatttattgttcttcattgaatttattattaactgtaaaaatgtaaacacatttatttttaatgctcagcatttgaaaaataattaatttcttttatattttttcattttttaataatttatgaatttaaatattttttattttttcttaatttacggttttattaaatttgattttttcactgaataaaattttctttttattcatcagcataaagttaactaatttttataaacatttataatgtttatttctcaaatctttaaagtcatttcttttaaacgatttgcaaaaaaataaattaattaattttaaaataaaaaatgtttttattttttctccccattttaggcaatttgctggtgctcagtttgccttcatttcgtattttgctgcacgttccactgattggccaaagcattgacatggacagcagcttgtaaagcttgaaaaatttttaaaaaaattaaaaaatttttagtgttttcaaccgtttcgacatttctgagcatggcctcggcttttatgccgtttcccattcggaggtcccatccaatgagaaaattttgcaaattttactttattacatttaaggttcaaaaattcacagtcagcgccgaaataaccaaccaagtgtgcattttaattaaaaaaatttaaaatttttcctttcgaggcgtgccatggggagccttgaaatccgaaaaatgaaattttagcatattttttttttagaaaaatttaccccttttcgcaacaatttcaaaaaagtcaatccccggcggagcctgcatcaaattttttgttagatttcacttttttcggcagcttttttttaattacgcctcaattttcaaaaattcctatggcgctgctttaataattatttctgc

SEQ ID NO: 25179 - DNA, 996 bp, Heterodera glycines
ccattttcccctcaaattcaaatcccccattggattttctctctccgcttccaatttatccatccccgggggataatttcagcaaacttttgcttaatgtaattgtgcaaattccaacaataatattaataattattatttaatgttgccgtcaaaatcttctcattgacagtcattttttcttttccttttttctattatttttgcctttctctccatgccaatttaagtatttcaaattcaaaaattcactctcctaaagcattttcgctcttttgctttttgatcaccacctttttgattaaccgtcgtttaaaaccccaaataaatttcccattaccaagtaaataattccccccccccccccctctcatcaatgcttttaatatggaaatgcatgccaaatggagggggaggggggataaacgaagacgaatcgaagaacggatgagagaagggaggacgacggacgagaagggggctttaacgggagaatggttgggctgaatggctgggaatgaatgctttattcattggacgaggaatgatggggtgaataatgcaaatcggattgggggtagggagaggaggaaaatgggacggaaagaaacgcgaacagacagaagagagaaagagacgaagaatttgggcgagggggggtcagcaaattcgacaaaatttaaatcgaaaaaacccaaattaagtgccattgggtcgtcggcgagattgaattttcaggttcgagaatcccgggccaaaaaactcgaccgcacacatattcgattggaacagagaaagtctcaaaaggtttttctgatcaccgctgtgtagtcgcgaaattggagtgctcgtaaaccatcagcaatctttcccgaatgattggaaatttgccatttaattagccgattaattattagcccccccctctctcccatcctccccttttcttccctttcaagacaattattcccccccccattttatttcccaatcaat

SEQ ID NO: 25180 - DNA, 1067 bp, Heterodera glycines
gacagggcgataagcgattttgagaaagggccaacccctgggggatgccacggaatgacgacgaacacttaggaacagttcgagcgagagaaggagcaggcgttggagaagctccggcaagaccatcagcgggagattcaggcattggagcagcgattctcccagtcgcagctgttgaacctcgagaaaaagtgccgaaatcaatttgaaacgaatggaaaatggagcaattaatcctacagatacatcatggaaatacaaaagttggaggaggaaaggaatgggctcagaacggagagagaaaggcttggcgaggagttcaaagggaaactgtgccgagcggagagtttattcgaaatggaactgacggcggcgaaaatgctttacatgcgcgaactgcaagcacttcgagaacacgaagaagcattaaaggacgaattggcagcaaggtaagagaagggatgaaagaagagagaaaaaggcagggaaaatgccgaaaaaatgggagaaaatggcaaaagaaatggcaaaggcataggaagaaaaacaatgagaggggggggggggagggaaattgaacaaattaaaaacaacggcagaatttgaggcaggaggaatttcacgacagagttgtcgagatgcaattccagtcgagacagtccaaagatgagattatccactgcagagaagagattactcagctggagaaagcacttggacaaaaagcggaagagatacaaaggctatccaaagaagtgagagacaatttgaaaaggaggaaatttaataattatttggaaatgagctttaaacttaaaaagttggcaatcgcacgccgaaaaaccgaagaaacgatttaccaacttgtccaagtcaagtcggaggcggaagaagcggcacgagaactgtcggcacagagagaaagagcgaaacggctcaatggggcagaggaggcgagagagcgtttggaggagacagtcagagagttgcgcaaggaactgattgggctgagaagcaaagcggaattgttggaggaggagagggacggactgaaggcacaatgcgaa

SEQ ID NO: 25181 - DNA, 982 bp, Heterodera glycines
  misc_feature (16)..(16): n is a, c, g, or t
cgcaagtgaccgcctnggaagcagtcagtaaacggagggcggggaaatgatccgaaatgcattggcccttaaacgattgtgccgtgccattgcccccctcccttcccgtgccatttgtttaccccccccccccattcccctcctctgtcagatgttacagtcagtgaccagtgagaaagagggctgtgagcagcggtgccaagagttggtggacagagagagggcggacgcggaagagcgcgaattgaccctaaggcgagaattttcagcgaaattgggcgaacttgaggagcagtacaacggactgagacagcacgtggaaagggagaacactgaacactttgtgccagaaaatgtggtcaaattgggggagggaatggactgaggggaaaatggaaaatttcagaagctttgggaagaaatcgaaagtctgagggcagaaaagggcgaattggagaaggaactgacacaggcaattagagaaaagtggtagtttaattgggctaatttgaatagcaaaacaaacggacggatggcatggcgaaattggcagaagaaatccaaaaattggaaaagagcacaatgggcgagaaacggacaacgacagcagaagaaggagaagaggaggagggggaaaaaggaggcgacgaagtgccctcagtggaagtactgctagaaaaggtcggtttgaaggcaatcgaacggaaaacccagcgaggctctgcttccatttcagttggaacagttggagaaaagtgttgagggaatagtgcgtgaaaaaaagaggatggagaacagattggaacaaattggggagggagagactgtgtggatgaagagactgacagagacggagagggaattggaggggcagaaagagcacaatgaaaaggaggaagagaaacacagacatgagagagaacgtatgagagagcaggtagagaggaagaggaaggaagggaaatcagtaaaataatggcaa

SEQ ID NO: 25182 - DNA, 1550 bp, Heterodera glycines
  misc_feature (1434)..(1434): n is a, c, g, or t
gagatgtgatgagtgcatggtgtgaatgtcatcagaatttgtgttttcattccccttttttctttcaggtctggtcttcgcccattggtgaatgatccgaacaaaaaggacacaaaatcattggcccgaaaccacatcattgaagtgtccaagtccaatcttattacaattgcgggtggcaaatggaccacctaccgacacatggccgaggaagcagtggacgcgtgtgtgaaggcgtgcaatttgaagccaaaaaatgggtgcatgacgcccggattaatgttggaaggtgagggtgaggcgtaagcatggaaataatatgggggggaaggcgggactaatactattcagtaatgaaataaatccgagcggctctcaactttgtttaccaataaaaacccaattcgtacttgggcacgttatgccaaagccatctaaatctcaacgcggcacaaataaccgacaaattggctaaaaaaaaattcagcgggtaccccgtccaaaaaaatctttaaattcttgaaccatcgctggcgctttcccgctttccgcttcccttaataattaggtaattagtatgctttaggtgcccacgattggtacccattgttgtacatcaatttggtgcaagactacggcattgaggtggacgtggcgcagcatttggccaacacatacggagaccgagcatttgtggtggcgcggatgtgcaaaatgaccggcaaacgatgttaagaatagttttaattctcttaaaaatgcattatttgcattcagggccaattgttggcaaccgattgcacgaagaattcccttatttggatgctgaggtgctctttttaaagtttcacattattgccactttatttggttaataagttcgcgaacattggaataaattaggcccacatccagcgaaaatttctattttccagaatttgatattttaattcggttaaccggcacaatttacggttcccctttttcgtcaaggtcagctacgcgatcaaagagtacgcgtgcactgccgtagatgtaatcgcgcgacggcttcggctcagttttttgaacacttacgcagcacacgaagtgctgaaccaagtggtgatgatcatggccagggagttggcatggtcacgccaggaaacggaggtgggaataaaccccaaactcaaaggaacagttgggcaaaaattgaatgttcagaaacagctgaaagttgccagggattttatcaacaacgaaatgggccaagaggcgcgaatgcaatgggtttcagatgttccgctgaatctgaccaaggaggtggacgagtttcttctcacattttcattaaatgaaatggttcaggaaatgcaaatggccaaagaacggtaagcggcgaagggaaagggaggaaaaagtgacaaattggaggaattgcaaaaatgaggngagaaatgatcagtcaattccttttgttaatttagttttaaccagttggacaaggacaaaaagggacacattacggtcaatgacatccgccgacactttcgggtttggtgtcatct

SEQ ID NO: 25183 - DNA, 949 bp, Heterodera glycines
tcactccgtccaaataaaagtcacccctgtggcttaatgtttccctcgtttcttcccccccccctcccctcccctctctctctctctctctgctctttttctcccattattcgcttttcctccgtccccttttttctgttcctgtctctccctcttctctctcgtctgcttctttttcgccttctcttctctctcactttctctgtctctcactctctctgatccttttttcccactgaattcgcctgtcccctcttttttctgtccctgtctctcccttttctctctctctcgtctgcttcttttttgccttctcctttctctagctaatccttctttctccattaagcagtcttttttgttcccctgtctcccttttcctctattttcctttttgccccttttttctcttccatttctattccctcttttccctctccccttctatttctattttcctctctccccatggctttttttctcactttgctaccatttgttcctctctgtccttccctcacacagcaaatcgcccccaacgccaagcccacaccctttcccgcgcctccgaatggctctctgtcgccctcccccccgactttcctcttatttccccccccccactcctgaaagaggaattggttaagaatagcgaagaaactaatgctgtgtacctgtctgtagcaacagaagcacaccattttagcttacaaattagcgtatagaaattgcactcagttcaactagttttttctgggtattttcctgttttggggccgcaagccaaaaattaaagaaacaaaaattcgcgcaaattcactcacaaagcgcataatgtatgcaacaattgttaataaaagctcgtcaaaagaatcatcaagagaaaatttctgaatttgcgcgatttttgtcgattttttaaaatttggataagaaaagtaccgttttt

SEQ ID NO: 25184 - DNA, 1274 bp, Heterodera glycines
  misc_feature (168)..(169): n is a, c, g, or t
aaaaaaaagttcgaaccaaaaaaagtggcaaaatctggttttttgaattcttctggtcatagcttttttgaaccttaacgaaatttttccaaattttgcaggctaatagaggatacatagggctatcgaatgacactatcaatgttggatttggtagacaaataaggnngttatagccaaaaacttgtgctcgtacgaaaacggccccgtacgaaaaacgacccttgccccttgtttatgtactatttgaaaaacatttggtcgattattcagcgcatcattttcttgaccattgctcatttcaaaaaacaaataggcgctctcttgtttttttcatcattcatttttgcgattgttgcgaaaaaagagtatcgttttctttccctttacccgtaggtttgaatttacagatttaaacagtctagcaattgctttacattgatcttaatcttttttttatgcatctgttccttgttcagcgatcccttgataatattcaactgttaatttgaaaatgagcaccgacaacggagcagcagcaaatgttcagccggaacaggacgagaagctcattgcccagcccgaacagacggctgggaagacagcgtcgccggtgaaaaaggcgacggagagcgatttggggacaggcgagtggagaggggagaaacatttcaaaaaaagggttgggtgagcgaaaaaggggaaagaaagccttgaaagtcggcggttttgaaggccaacggaggggctaacaacaacaaacccaaaacaacaatcaatttgcatatgtgtcaggtgaggaatcgcgcgactctgtccaatccgtgggccaagagagtgcggaaggggacgaagaggaggacgaagcgggcgacgaggaggagacggacgaggagcacccggcccagcagacggaagagaagggcatcaacggacacgaaaaggcggagaagagcgtaaacggacacgagaaagtgggggagaagacggccgtcaacggagttgagaaggcggaggagaaaggagtcaacggacacgagaaggccgaggtgagagggaggggggcaagggacagaggaccaaagggtcggaacggaatgcaatttgaaatgtttttagccgcgaaagcgcatcaacaacgaaggcccagaagaagcggacactgaaagttcccagcagaagaagcagcgaatggacggcgtaagtgttttcttttaacatatggctttaagagaaaaatgacacactgaaaatcagattctttgattaggtta

SEQ ID NO: 25185 - DNA, 1262 bp, Heterodera glycines
  misc_feature (24)..(24): n is a, c, g, or t
gatcaacaaaaagtgaataaattnggcacaattttagcatcttcaaatccatagaacaaaaaaaacaaatcctggtcaggttcatacaccaccagcagtttgatacgttttctcagtttaaaaaagtagatatatttaatcggataaaaactccgcaaaaatgaatctgactagtgtcataatttggcatcataaattgtcggaataaagtcactgatcaatgatctatcataaataaaactgtcagtcaaaatttgtcacttgccttccggcaacgaatccatttggacgatgaattggccttcctgttgctgttcctcctcatcttcattcctcttcagctgctgctgttcgtgccgttctagttgttgttgtgttccaattgagggggcacatggcgttgttgttattgttgctgtttgtgctgctgcggtcgagtgacggccccgtttcaaatgccgcaaatcaaccaccactttggcatgccgtccggaacgttcggctctgcgcagaacctgccaaaaatttacaatttcaaattaacccttaaatcatttaaatttacatttttgatgtgctcctgctgttcctggctcagtgctgctggcaatgaactgttgccatggcttggtgttatgctatcctcctgtccataatcgagtttttgttgtgaagcagctgatgctaaacatgacgacaaagtgtcgacagattgtcctgtccttggcaaaatgtcatcttccgttggtccaatttgatcaacaacgtcggcttcagaagttgaaggcaattcatcaccaataattgagcttctaaattatttaattaattttaaaatatatatgaaaatattttaaagaaataaagcctaccgaatgtatgaaaaccaggaagacatttaaaaaagcattttttaaaattaattattaaaatatatcaataatcctgaaaacaatttaacatatgaaagaattatttttcattttttgtcaaatgatcaatgttttttattgaattgtgcgatttcttccgctggataaaaaattgaggaattgaagaattatttttctaaaaacaaaaaattcctaaattgaaatatttataattaacaaaattaaaaacacgtttcttcacatagtattgcccgatttgtctgtctgtctggccaccattttgtgtttggtgcatgcgccgtgcggtgtcttttcaccgtggcatttcaagaacaaatcagcttcaacttcttcttttcttcttcatct

SEQ ID NO: 25186 - DNA, 1820 bp, Heterodera glycines
aatggctcaaaacatggattgtcatcaaaattccagaagaaaatcattttgtcataagtcatcacataaaaattttttggagaacaagaatgacaaaattttaagccgtcacgccactagctgaaagccttgaaccccaccattcggatgccgaattcgccatttactcaaagacgaggggaccgtctttcttaaaggccggggatgtggtattagtgactgtttgaccttttatttgattgtttgaatttgtttggcataatgtttaatttgaattcgacccaaatattttggttttctagagtgaagttggtggattagttggtcgttggggataatttttaggcgttttgttgattggtcgtcgatggatttttgttttaatttattttgttgttgacttattttaatttaatttggattgtctttttaattatttattggataaatttattttgttttggtgtttgattttaaaagcaggtgttgcctaatttcacagacaattgtccctttgttcgcaaaatttggaagtgcaaaagaagaaaaccccggctcaattccttttcttttccaacagtttgatgttcatatagtaaatgatacggaaaaatagccataaaatactcatatgtctatataataccgttggttgagcctgaagatgacaaacagtagacaattgtacgagaataattaaaattataattattatatatataaattctatatttatgcataatatgacattacatcctataagctatagactttaccactgtaagtcgaaatgttattcagtcttcggtattagaatcgcagctctacatattctctacaacttataatttttaaaaaattagtaaaagtttacaaaaagttgtgaccaaaaacttgcaaaaaaaatatagactcaacaattttgaccatactttttgaaattcaataaaatttttcgaaatttaactgaataatagagaaatctttgggctatcttttcatatcaaatgtagtgtgattaactgaatgtttgaacgattttcatgcatttaaacgaccttacattttttggatgaccataaaaacataaccttattaattccttctttactttttttcagaaagaaccaattttaatattatttatataattagatagcccaaagatttctctattctacaattaaatttcaaaattgaatttcaaaaaagttagggtcaaaattgttgagtctaaattttttggaaatttttggtcacaacttttgtaaatttttgctaattttttaaaaattataaaaatagtagagaatatatatatttttttttgaatttagctacattctaataccaagatgaataaatttgattaagtttaagctaagttatgctttattatttagcaaataaaatttaaataataattaaatttaattattacgaacactgatatttttgtcacctcgtcctagcaccgaattacaaatatattttactgacccaacatccaaattttcctcatcgacgtaaatgtcaattaggtttcgatttcgctggcccatgcggtgctcccatccctctgcttccttctcccatttggcccatttgttctcatcgcggcacatcggacaacgaatcatcacaaatttcgtaacatattcgggtgccccgtagttgcattctgtctttgtcataaccattcgctctccagtcaaatcatttgtcaaatcgtagggcaaaatcgaagtgtaagtagatgaatggaaccaaatgttaatgatgtaatttgcaggggaagaagcatccaaaaaggcctgaaa

SEQ ID NO: 25187 - DNA, 2137 bp, Heterodera glycines
  misc_feature (1861)..(1861): n is a, c, g, or t
  misc_feature (1873)..(1873): n is a, c, g, or t
  misc_feature (1911)..(1911): n is a, c, g, or t
atttgggtatttatttgtccaaagatatatcctcacctgggagtcatcaacaatcacactgaattcataagaatccttagtgagcacaaatgaggaaaaagtcctttaagatctgtttctcttcccaagctaaaataattatatctatttcaaaaaataaagatttttaaccttttatttttgtctaattttgaggattaaaattaaatttttaatttttttttgtttgattgaaatccccaaatgtcgggaccctaaatgtcgggttgccaaatgtccgcggttttcttaagtgtcttttgctcaatgtcgttcggtccccaaatgtcaggtccccaaatgtcgggatccccaaaagtcggatccccaaaagtctggtccccaaatgtcgggatccccaaatgtcgggatccccaaaagtcgggtccccaaatgtcgggaaagtcgggtccccaaatttcgctttcaataaatatgagtttattaaatttattaaaatattataggaatttctgatcattttaaatttaaaaaataaatatgcattaaagaacatttaaaaatgtgtttttaaaaaaatttatttatattttaaatgaatagtttcaaatagggttaagccccgaccccgagccccccgacccgacccgagacgttttttggacctatgccccgacccgacgaacaccaaggccgaaaaataagattttagggacaaaaataataacattagcaacattttttcaaatcagtaaatttttacaatttatttgatcaaaatgctatcaaattttatatttttagtctcccattataaactaagaacaaaacgaggttaaaacgaagatttggccacaaaaataagataaaaaacggctttttacattgtaaaaacagggatgctaactgaaaattttcaaaaccagcatttagccaacaagaatcatcatttggagtcaaaatcagcactttggaaattttagtcaaaaaggaaaaaacatgcttttttgtgacgcactttttccgaaaaaaatttttgtacacaggtgccggcgggagaattttttgaaaatttgagttcattttgctcacagattttcaccaaaaatgaccaatttttgcgcgattttgagaaaatttttaagaacaattttcgtcgctaccccaaaatcagaacattcttataaataacgcactcttgttggcgctaacgaaatcagataattaaagtgaaaaaaggaagaaacataaaaaataaatctcacacaaaaagagctaaattatcaaaacttggtgttgataaactataattgtattaattttttgaaacttttttttagattttttggtaattaatttaaatttaaaaataaatatacgtgaaaatttgaaaaaaatgcataaaataattgaacctcttttgaatatactaaatatcattaaaataaaaaatatttctgattaaatatgatctttacaacaaaaattatataaagaattaaatatcaatataaaaaaactttaaatattaaatgaaggaattataaaattcgccagcaatgaggacacaagaagatgatactctggcaaacaggagaagttaaattcaaacactaattgaatggacctattaaaattaattataattgttataaaaaatattataaataaattcaaccaaaaattatgttacaattaatagacgttcgaatcgaaattaattcaaataataatcagcacattattttgtttatatatttacagaaccataaaatttcaataaaaacaagctatataaagaatcaatgcaccatataattgaatgaatttacaattttatcttcgctatcattttatttanaatagttaatanacgataaaaatttttttgtatatattagagtgaagcgngaccggaccgggccaggaattctcgttattcgaggtcccggttcccggtcctgaaaagctcaggtcccggtcccggtagggcaaccgtgaaccgggaaaaacagcactggtaagaatggaggtctgagtgaaaaattagagatgaaaatttcgagtaaaggaaaaaatttaaaaaacacatatatatttttcaattgacacatattttatcatttttaaatgaaat

SEQ ID NO: 25188 - DNA, 2547 bp, Heterodera glycines
  misc_feature (19)..(19): n is a, c, g, or t
  misc_feature (95)..(95): n is a, c, g, or t
  misc_feature (101)..(101): n is a, c, g, or t
  misc_feature (185)..(185): n is a, c, g, or t
ggttagtaagttagaatgngtatatgtaggttcgtgatcaaggaccaaaaaaacttcgtgaacaattttcattactagacaaaccaaaatggtancccttnggttttaataaatttcaaaatcggtagacttttataatagtgccacattttcccataatgcaaaatttgaatgaaattaaactntaaaaagctagtaaaaattgaacattgtatttttgtgccacaccaaccaacacctttaaactgtctaaaaattacaataataaataaaaaaataaagtttttggtttaattttgcaagattaaaccgaaaattatttgaatattcggaaaataaactattataataattaaatttatctagttgatacttttgtaatttcggcttaccacggaataccatatggttcaattgttttttgggtatattttcatttgggaagcggcggtacaaaaaggcgccgccaggtgaatttggaattttgtatcaatttgtgtagagtttgaaccaaaaagccgaattttcgagcaatatagaaattcttgaaaatttcttttggaaatattaaaatattaagtttttgagtaaaatcatttataaattgcactaaattaaaaaaatatgtatggcgcctaaccttatcttacttaatatatgtgtgtatacgagaaaataaatgccatgtgctgttcatgtgaatcgtttaggaaattggctctaacaaatcaattatattcaatgacaacaaataaatattgatgaattttaattttttcagacatttattgaaaaatttatttaatataatataaattatctttttgaaaagtttcgcaaatttggaaaattcttttagtttaatggcccctttttgtgtattattattgtttttattgtcagtttacctaaaagaagcagaatttgacgtaattacatgcttaaaacaaaataagttggccaaaggaaatgtgtcctttgccacttcactttctgaaggaattaaacacacatttaaaaacggtgagtttaaactaattagtttaattgaccgtttatttgatcggttgagttaattaagaattggccaatttttaattaaaattttattaattgaatttctcatttaataaagaaagcaaaaatcacattgaagaagaagcgcaattggccaatatcatctgcgaaattaacaaaaattatctcattttggaaacatttttgaccgaagtaataaatatttataaatataattaaatattttgcttctttaaagaaccctttaaatcattcaaatggacatttttctgtggatgaatacaattccctccaaaagcgtatcacattaattaatctcaatgatccgcctttgagccaagtgatgggcactttaattgttacactaatgagccttaaaaaggcaatggaatcgggtaaaaagcgaaaaaggaaaatatttattttaaacaaaaaattcctattattttgataaatttctatataaactttaatttaaaatatttttttattataaaaaccaatttaaattaaaaaaaaattttttacataaatataattaattccctcatattaaaatttaggaaattttggcgattctctgattaaaatgggcaatcagcgtttaaaatttgcactaaaatttgttgcaaaacgtcatggaattgaatttgatgaacgaaacaattttagtttatggccaaaaaatagtcaaaagctttatttttcgaaatgggttatattatattaaataaattagttttactttttagacataattttaaataaattaaatataaattcagacgaaaatatttggtaaaaatggcaaaaaattctggcaaaataattcaaataatgaacatcaaaatgaaagtgatcaaaataaaacaaaaaatttcttacaatttgtggtaaaaactatacaaatttgcgaagatggcacggcaaagaggcgaaaaagtgcaattaattaaaatgaaaaataacaattttttaataaataatataaattaataatattcaaatttgaaaggttgtaaaattaatgaatcattttttaaaaatcatttaagacgcaaaacgacgccgaaaacggaccatattttcaaatataacaattgttttggtgttaatgttagggttaattttcgctattaccaattcccatcaattgctgtggacaatgaatcggattgcgcgaaattaattattatttttaatcatttaagacgcaaaacaacgccgaaaagggaccatattttcaaacataacaattgttttggtgttaatgttagggttaattttcgcgattataacacttagtttttgccgagttatatgtgaagatgtgatcaattttattaatctgacaagagagacactgaacaattttcaaattcaacgaaatgataattcaagtacagtgttatttgtatttgaattatttatttaaattttaaaaaaatttaataaatttgagtgtaggaagatgcttttgaccaattcccatcaatttctgtggacaat

SEQ ID NO: 25189 - DNA, 1905 bp, Heterodera glycines
agtagaatatattcatacttaaattatcgatttttcccaatcaatcatttgattgattgagtccaagccaaaaggtactggcttgggcccaaacctattgcccccccccccccattccggttggatttttttcgttattccattcttttattgaactttgcgcgagaattttttttcatgaattaagcgtcttattttttatattttaaaatatttgaaatttaaacatctttaaatttaaaaatcttcgaattttaaaaattcttcaaaaatacagccgtgtcgaaaggcctcaagcccctggtgaacatgcaaatcagctactctaaccttggctatgtagccattgatgtgtgcatgttaatgattgatttaatatgagaaattataagatgatcgagagggggagggagtacataaacatttttcgggatgaagagggggaggggattcgcgaaatgaacacattacaaaaaaaacaaaaaaaaaaacaaaaaacgaaaatgtcacaaaaatattgtttatacgatgagtgaattttttggtaggcatttttatcattattattaggcaatacacaaaacattttctgcttcgttaattaattaatgatttaatattttaaattaaataaatgctgttaataattatttttattattattttataattaaaaaaattcctttgttgggaatttgtcattttgatgtttttaaatttcaatgctcatggcgccaatcacaaaatgttttttgcttaattaattaattaatgctttaatattttaaatgtattaattaatgaaaataaatgttttaattaaaataaaattgttttaattaaataaatgtttaaaaaaattcctttgttggagttcttatttaaatgtttaaattttaatgttgatgaataaattaaaaaaaaattaatagaattaatgtcaattatttttttaaatttatttaaaattttaaattatccccccccccccccccgctcatccaattgtttatcgtttttaaaattttttctccatgttttaaagaatgccttggtattggcatagtgatttgccaagatgcgtgagcagaaggatggcacaacaggtaaaaaataattaaatttttaaaataagagccttaatggttggggccgggggataaattcttttaaaaatttctttaaattggtcaatctcagtattaaaatttttaaaatatgaattatggtaattaatttcttaatcgaattttttctgtggaataaaaattattttatttgcttatctgtcagctaatatgtcttgatttttttagcgccacccctatcaacagccaaacctgcatgtgcctatgcattatggttataacgaagcgtattttccgggtaattttgtgcatagtcgggctactgacttcccctgagaatggtaaaactgagcgcaggagaccaattattctctggcgcgaatcgccgggggaggggtgggggggattccagcactggttgaaaacaattaaaaaacagttactgggggatttttctcataaaaaaaaaagaaaataaaataaatttaagtgcatttgccattagcacagcagcgttatgtccagacaatgcatcatcatcctcctcctcttccgcatggcacccattttggtcatgatcagcccgggtaaaatagcgaattgattttattggtctcttcatatatttttttaaagacttttttataaaataattctgacgttaaaatgtaagattaaaattaaaaaaaggaattctcgacggcgcacacgccggcgcaggaatggattgggtttgcaaatgccacggcggcagcagcagccgatgaggcaaatgccagggcagcagcagcggcagttgtcgatgccagtgtcacaa

SEQ ID NO: 25190 - DNA, 886 bp, Heterodera glycines
aacgccatgttcccatcagaatcgaagacttcgatgtccgctttgccctcctcaacgagcaatttgactgaaaaaatagaaatgaattgtcattgattaaggggcgcttttgggtcaaattttgaaaactttagggtaattttgggtcgagaggtctcggaaggaataaaaaatacaaaaccaatattcaaaatattaaattgcaaatgtcatttctattaattaaaagctgctcgtcccgttacgtataattttcaattaaaatgttttaaaaacccaaattttttatcgtaaattttcttaacgctcttaaatttttttatagtttacaaaaaataaagaccgaacttttcaaaaactgaccaactggcaaatggccatcgccacacgtgaactgaattgtaacggaattggtgtcatcggttggagcaacggcgccgttttcaatctgaaaatgtaaaaaacaaatgataatcaatgagaaggacaaaaaataatattaaaggtcaccgccggagaaaaaaattttttgtttctaagatttttttgttgaaaaattgctgtgtttaaaaaaaccaataggccttaattatcaaaggtttttggtatcgtctaaacggaaaaagttgtggtaatacggaaatggtttttcattttgataaaattacgaaaaaaaagaattttttttttcttttttttcctaccaaaagtttgatcacatccgctttgtcattttgtgccgctacgtgcagcaaagtcgcgccattctgctcagctcccagcaaacgcttcaattcgtcggcatcgcacgcgctgaaaatggcacgcatccgcgcgacgccgccatctttggccaaggtgaacagcaatttgacctggaaaacga

SEQ ID NO: 25191 - DNA, 1007 bp, Heterodera glycines
attaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcataattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaa

SEQ ID NO: 25192 - DNA, 2247 bp, Heterodera glycines
taacttttcttttttaattatttaaaaatattactaattgggcacaattaagcgattatttcaattgttttttctcacctcatacagttcttggaccacatcaatttgggttagcaaatatgccacgtcaatttggcagaattcgttgatcagtcgcagcatttgaccatccaacaaacgaattcgttccaacaaaatgccgtgcttaattgctctggtcaatgtgtcaaaaaagatgccaagaaggtgcgcttcctctgtgttcatttgttgccgtccaaattcatatgcccgtttcgcctcagcgatggcataacggaaggtgccgatcagaaagaaattgacctattcgatggggatgatcagatttttaaactcgaagacaaaataaattttgcattttgtaaattttaaaagaataatttacgaacgcttttatacttaaatcatcatcaaactggcaatttttgtaatcaaaagtcaacaaatttgttttaatttaccaagctttttaaaacctaatttttttttaattttacagaataatcaagaatgagttctcaaataccaagaatatttaacgcttagcatggtccgtttactcagatcaatgtctataaaatttgattgtcctaaagctcctcaaaattcattgtattaggatattaactttgaaaaaagtaaaatttggcaaattaggaaaaatcttgacccgctaaatttgttgagattgtaagggaaagacctaaaaaatgagcgaaccctcttcggttctgcgtattatgccaaagtctgctcggacaaagtcatttgagtcgggctgccacacaaagtatgacgaggtcgaaaaaatgaaaaataaagttataattagagaccgaatttgaggcatatcccaatttctgcgcattagttccgatatattgagcatacgaatcacactctgccttcgttcgtaacctgtagtctcactccacctactgtccgccgtagtcgagtgtgcggcggttttttagcgcaatactcgatattcaaggctacacgattttcgtgcattatataagaaaaaaacttttttattttttggtactgaaatgtcggttttcactgggactcagttgtcccagtgcttagacggcatcggttcgagtttataccttgttttttagacttagctgatcaagagctttcaaatgatactaaatttgtccgaatttgaccattttaaagggtcataagcccctctattcactcaatttttcgagttttaaaccggttcaaaaaccggttttttggcatttccgcaactggagacctattttttcgtgcatagctcgtcgagacgaatcgattggtatatcatttgtgccattattttctggggggttgactaaagtatatccgaaaattccaaatttcttacgaattaaaaatattttttagtgcattttgacttggttaattttatatatttttatgatggatgaatttcgttttagcgcgtgttttttgatgaatgatagaatatattcataactttgccttatttgactttatctccatcatcatccattctttctttgtgtgtattttgcctgtctcttttttctccattttccctccttttttgccttcggcaaatccaaaaaatatttctatgcaaaaagaaattgtacagattccccccccccctcacaaggcaaatatttgaccttttgttcaattttaattagataaataatttcttttggaaatttggaattttatttaattatttaaaaaaatattgtcaaagacaaaggtgcgaatgtcaaaactcaaaaacgcggcagctttttttttaccaaattttcaatttaaaaacataaaaaaatgtaaaaataattgtgagcattggtatatatcagacattttttgcggcacattttccaaaaaaacttggtgaatgtgcgaggttcgagggtccggcgggagtcacccccaactcatccatagacccaactcatccataacgctgcgagtcatcgtcgtggcatggcattttctgctcatgtggtcatggccgtggacatttttgattatgcggtctcggtcgtggcattttttggttgtacggtcttagtcgtggcattaaatgccacggcgacgactcgtatcgtgctatggatgagttgggtatatggatgagttgggcatggatgagttgggtatggatgaattgggtttggatgagttgggtttaccccg

SEQ ID NO: 25193 - DNA, 953 bp, Heterodera glycines
  misc_feature (13)..(13): n is a, c, g, or t
  misc_feature (64)..(64): n is a, c, g, or t
gaaaagcgctcgnaaaaaagtgatgtgaaaatcaaatctgaatttctattaatattcgatgatntagtccaaaaatgattaattgttgaaaataattgaagaaaatttgtttgaaaattttcattaatttaatttattataaaaaaccaaataattttgtattattttcacttgatatacctaaattaaaatttgaatttttttttaaatttttttgaattttaaaatttcccggttggtcccggttcccggtttttcttgcggtcccggtcccggtcccgaaaaaaaatcgaggtcccggtcccggcttctcaggtcacggcaagtcccggtcccggtttttgcattaattgcctgtgtcggcagagtgaatgccatcacgctttccacgatgtcttgcgtcatcacccaatcaatgcgtgcatcgttaatgaattcgccgtcgtcctggtcaccgaacattcgttggaaggagtgccgaccctcaaaaagaatggcacaaattgttggcacttttcccggaatttgcattttgctatttatgaatcgctttctcttctcacatccatcgtcgtccaattggcaaataatccgttggtcacaaagcccgcttcgtccggttcacggcagtaacaaacagtggcgagcagcggttgacgttgtcgaagcacgattaattaataaatgtgtgaactgctaatgaatgtgggattgattgatgaaaatgcacaattaaatattgaagcttctaacttgcatttttgttatttgactttttttattggtgatttttatgaattttttcactttaaagctaaacacagaaagagaacgcatttggggaatccgattctgatatttttgacctattaaaccccggaccaacaaaaaggttttcggggtcgctgatcactaatccggcatctatttggaccaatttcgaaccccggacc

SEQ ID NO: 25194 - DNA, 2112 bp, Heterodera glycines
  misc_feature (67)..(68): n is a, c, g, or t
  misc_feature (82)..(82): n is a, c, g, or t
aattttcattttgatatttccaaatggcacaagttttagcactggactgatgaaacaactttttatnntaatgagattcatntaatgcactgaagaaaaacattctggttaatttaaaaaataaaattcaaaaaagcaatctcgaaaattcaaatttaaatattatcgatttaatatttaatttcaaaccgaaagtattcatgaaacacacctctaaactgatcacttatttgaatttcaaaatcaaaagccgaaatttgtctggattggattgatcagttaaatgttattgcctttaaacaaattgtctattttgatcgctttttttccgacattctgatcagtggggtaagaagcggcgtcgctgatccgttgttcctccgatcggtggaaaatttggcagtatgaagaagcagctgtcacggacgcgtcccgccgagaatgaagccggcagctgcctttatggccaattgatccgttcacttttgaaaacacgaacatttgtgggggtggggaggagcatatcccacccagcaaagcttcaaaatttgatgataagcccatctgtttatgaaaaaatcgacaaaatgtccacaaaattaaatcgaaatccacctaaaattggaaaaaaaactaaaataaattaggcacttacttttctttgagaaaatgtaagttaaaataagaaaatttctgcctttatttgatacgggagtacaggacaaaatgtcgcagaccgaagaatagccgcaatttttttttaattttgaaaaattttgaaaaaatcaaaaattttagctacctagcctaattcggaaaaaaaaatttattttttgttggaattcagcaaattttgttttactaaaacttcagttttcaaaataaaaactaaaattttttaatgttttttgaaatttttaaaaactttcctcagagaacttaacaaaaattaattaatttttttgaataaaatgtaaattaataaattaaataacagaattgctgctttggcttgtgagtgttatttgataaacccattctgttataggaatttgaaaaaataatgaaaaaaataaatttaaataaatttaaataattattccttacaaaatcaacggcttctaaagccctaaaatcggtgcagaataatctccgaaaaaattactttaaaaagagtacaataattagtgacaacaatagtgatcaaaaatgatttaaagaatcattaaaataagatccgcagcaaagagaaaaattgacaggaaaataagggacagtccttgaaaaatgagaaatttggcaggaaaataaaggacagtccttgaaaatgagaagtttgactggaaaattgaaaatgggtaattttatgtgaacgggtcattgagtaaaattaattccattttagctaattttgtttggcaaaaaatggcattagcattgattaatagcaaaacatatttttccattcttgctatcattcgataggccaggtttttctctattagcttgcaacattaaaaaaaaaattgattaatttttgaaaaagttgtacaaaaacaaatgcctatttctgccataacttatttaaaatttggttctaattttgcaggctaatagagaaaaaaccgggcaatcgaataataccaagaaaatgtaaaattttgtttacttttaagcaaaattcgaatcatatttctcgaaaaataaaccgaggctttttcttcaaaaatattttgtctcgaaaatggaaaatagaattttcagagaacgaaaatccgagaccgacacgagacttgaaacacaaagaccaagaaacttcttttttgcaactcgagaccgagactgtcgagaagcattggtttgtgtggagtgttggttttttttttgatattatttttataatttttaaattttaccagcaattttatatctatcatattggtttagagcatcctgcaagttttttcagtgtctttgttcaatggtttatttacaataaacttgacatatgcagattgaacgcttccaaaaaaaagtgccgatgagaaaatgaaaaataaaacggtgatgagaagcattttttgcgagccatttggcccattctgacctgca

SEQ ID NO: 25195 - DNA, 1591 bp, Heterodera glycines
gccatcagcgggttgtttcgtgacaaaaacaaaccagtttgatgttattgaatgagctagacgcgctctacattgtcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaagaaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtgtgtaaaaaattttcagtaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatat

SEQ ID NO: 25196 - DNA, 1452 bp, Heterodera glycines
  misc_feature (116)..(116): n is a, c, g, or t
  misc_feature (1356)..(1356): n is a, c, g, or t
  misc_feature (1405)..(1405): n is a, c, g, or t
cagataattttttaaaaattcaaaatctccacaaccatagcttatctaggtagcgaagctcccaaagcgcgaagcgctttttcccagctaaatagccgacggttcacgcacccgcntagtattatatatgttatattgacaaggagtttcgttgctaaaaccattttctcccggccgaaggccggggagcggccctgaaagtagtggaagggtcttacaactttttgaggcgcatccgggaaaactatagaaaaaaattcagcgcggacgactgagtccccgggacggatttctcactttttcttgcagtttttcttctacgaaattttttctttggaccgggatcgcttagctcttgctggtaggattttaagtcagactatccccgacaactttgccagcaaaacctaagccctacgttaagttatattacaatcacaagggttttttatagagatggccttctcctttgcgtagtcgcccacgacaaagcgactgaatcgcaactcttacccagctgacgccattgcaaggctctcacctaaattagactattttttgcaaaaaataagaaaaattatatatatatatatattttttttaattttggattcgaagttatttagtttgatattaagttttttaatataattaaattattaatattaccatacttatatcacgttgattatgcgtacaattgcaattcattttgtttttaaatttgaattgaatatagtcttttaaattcgttttagttaaaaaatagaggaggattttaatgactgtgtcaaaagccaccaggacagtccacatgaggccatccatgtatgcctaattagggataattaacattaattattttacattgaaaaatttaaattatcatcatcaaattaaaggttttgttcaaatccaactaatgtagtcgcgagtttgactgcacttatgagatcattgcagatgagcgtgtcaaacgacaaagttttgggtaaaaatacttaaaatcattaattatttatttatttaattaatttttagtcattatgagtctgtttcggaaccgatcacaattggaaactgttgcaacgaaatgcacagctatgaacacattcagcgcatttttgcggccatgtgggacaaggacaagttccaggcccattacaacaactgccgaaattggagtgacggattttggtggaaagtgtaagaaaattaattgtaaaaaaataataacaaattttattgatacgggaaataattttaaaaaacgttttctctaaaactaattaattcacagtttttttgtgaaaattaaagaaaattaattaaataacattttcagtgggtttttanatagcaaaaaaattcactgattttttaattaatatatgctaattttctnaaaatgtaactgagttttgggttggaaaatctaagttttaatatgaa

SEQ ID NO: 25197 - DNA, 1506 bp, Heterodera glycines
ccccccccccgcccttcaaattttgaaaaaaaataacctttaggagactcagaattttgaaaattttttataaaaactgatgacaagctaatgtgataaaacaggttaattcttttcctttcagtatccctgcaaagtttggggcgcttctgataagtttctgaaaaaaaagttaagcctacattttttggcatatttaaaaagcaattaaaaaatttttaaaatttaataattttcctgcaccgaaggtactcactcggcctcttcgcggcctcgtggtgggccttcgcccccccccccccagtattatcttacaaaaatatttatgaattaattatgcaaaaataaataaaaatttctaaaaatttgatcgtccataaataatttgtaattgatcaggggctcaccaaattttgcaggaatacgtatcgtgaacactacaaatgcttactaattttcctagattttttaaacccggtgaaaattttttgcagacaccaccacttttgcacttaaaaaaatttcaaaaaactttaaaaattcataaaaaatattaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagagcattttctgaaaaaatatttatgaaataaaaaaaatcgatttattcaagtgtccgttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctaatcccgaaggattcggtctccccataaatctgggcgcattggttcggggggactgccccgaaaacaaaaaaatcgattttttcaagtgtccgtttggggtactcaaacaattatggggagcaaaaatccaacgcagaatcaaagtacaggctatagggaagctattcccgaaggattcggtctccacataaatctgggcgcatcggttcggggggactgccccgaaaacaaaaaaatcgattttttcaagtgtccgtttggggtactcaaacatttatggggagcaaaactccaacgcagaattaaagtacagactatagggaagctattcccgaaggattcggtctccccataaatctgggcgcatcggttcagggggactgccccgaaaacccaaaaaaa

SEQ ID NO: 25198 - DNA, 1391 bp, Heterodera glycines
catcatcgaatctaacaccccttaaacagggtagccagatctgaggctttagcctcattttatgggtttttgataggtcaatgaggctaactaaattttcaaaatgaggctttgaggctttttatagttttttgagaaattttgaggcttttggggaaaatcgtcagaatctgttaaattttatgattaattttgataaataggcataatgtttgacaataatttaataatttgggtttttaaaaagttcaccgctaaatgatcaatgattattccaaattgaaaaaaaaaaccaaaacattttgcaaaatgacagagcgcggacgtcaagctgtgatgagcacaacaacaacagtcagcaacaccaccactgccagcagcagttggccacgttgcaccaactgcatcaggcgaagagcacgccgctgaccacgagccggacaagcgccagcattggagccgcgtttgaccgcagcgttggcactggcggaagccggcaccaatcgcaccagcaacagccgcaacaacaacaacaacggcatcaccatcgggcatggaccggcatgaccgttgcagaccaacatacagccgaaagagctggcacaaatgccactcgctggacatcacaggtgaaatttgttgacgaaatgtctctttaagttagatggtggggataaaatgacgactaggtttaggggcaatttgtctacccaatatgggacaaaatgccgacacagcaaaggttttatacaagttgtcctcgagatatgacaaagtgccgacacacataggattcgggcaatatttccccaacactaaaatggacaaaccatctaaataatagccaaccaaccgaattacattcaaagattttattggcactttatcaaatttcaaatatttaaaatgtacaggaccattttccgacaatttgtcaacaaccgcaacaacaacaacaaaagttgcgcccctccgagtcattcattcgctccatacagcagcagcaacaggagttgaagcagcaacagcagaagaacacctccaacaccatccccagcaacagtcgaatgcatagacggcaaaaaaagaggtcgaaatggcatactctcgacaaatgtgtttcactagtctcgattcttgaggccaattaaaaaaatctttgcataattctttcaagaaaaacataaaagaaattttttgaaggaagaattgcaagaattgaaaaaaaatttaaatttttttcaatttcataaattttttaaatgtattttttgagacttttttcttttaaaatttaattttttttgttttttgttttttacatgttattttggaaactggatgacccttggattttttcctttaatttttcccatctattttttcaagga

SEQ ID NO: 25199 - DNA, 1836 bp, Heterodera glycines
  misc_feature (21)..(22): n is a, c, g, or t
aaattaaattatatttacgcnnattaaggatgggtactcacgcaacaaattcctccaggagacggcgttatgcccacaattggtaagtttttacttaaatttttatggatttaccctttctttaaatctttaattttctttcactgatttgtgattttgaaaattttttcgttttaaaaatgattttaaaattaatttactttttaaaattttttttgagaattttatagcttaattttacaacaaaataaattttgttgccttaattaattaaaaaattttttatttggttttatttccaaaggtgttattcacatttggaatgtctcgttaacaatggtcgctttgatcttccattgcattatgcttctaatgaacaaaattctgccaccagatttaaaatttctccccgacaatgtttgttgtaaatcatttaaataattaaaaatattagtagaattaaacatttatttatttagttttccaaattttcttcaattctgaatcgttacaagcttttcaagactgagtgcctctcaattgatccgcaacagtgcttataataaaatattttattcgattttaatttgaatatttaaataatattaatctcataacttaagtaatgctttttaacttttagaatgggttttgatctgttggttgaaaataacgctgacctttctgcttccggtgatcaacgaattgcaagaaatggcggtgatgtgttgttcgaatttgatcagtccccgataattccgcccactcaacaaaatgtggataatacaacaatcattcaaatggacccaattgtgcatgaaagcggctatgaaaataaaattggcatttcaccaaccacaacggcagagcaatttgaatccgttcaattggagggtctgtttttttaaatggccaattgtggattttaagctaaatttcaaacaatatttatgtgcattttgtggtccggcagtgccattagggcaccgccagcgaaaattttgaaattttaacgaaattttttcatttttcggttatgctatgcttttccgttccataaaaatataaaaaaccaaaacatttaaggagatcgatttatacagtgcagaaacaaagaaataaattcaaggagataaaaacaatttaaataattaaacatagaatcaatcaatggttgttccattttctaattgttttcttttaaatcaagctcatgaccaagcctcgtcttcagctgctgaacagctttcaactgtgccaacaacgtccaaaaaagcattctcattaaatttgccattgttcagcggcaaaaatggaaggacaaaaaagggcataaaaactcccttttcaacgggagcagaattatttggcggcagcaacgaaattgtaaaaattaaatatttaaattaataaaaatacatttttctattctaaatttaattaaattcgctaagacactttcgaaaacaataatttgtcataggtctattgtaattataatgctttttcacaaaaattttacaaaaatttattttagctttcaagcaatgatcaattagaaagtacgaatttaaatgcgcaattggttataaaacaaatggaaggagacaatcgacccaaagaatctgtcggcggcggtgtctctgatgagaaaaacggttacaaataaaaatttaattaattaaatttatttaaataaaattaataaatttcaagacacaacgaatgcgaaaaagttcaaaatggcgactgtaaaacgttcgccattggaggaagaatttggctttgttcatacggttgatgttcacactgtactgcttggtctcggccattctt

SEQ ID NO: 25200 - DNA, 1609 bp, Heterodera glycines
gattttccccgctccgtctgaattttgcaattcacttcttataaataaatttgaatgcgcagtgaattttatccctttttaccaatgattcgccgcttttcttcagcaccaaatcggacgtgtgggctttcggagtgcttttgtgggagattttcacctacggaatggccccttaccccggcgtggagctgaacaacgtttacgttctgttggagcgcggctttcgcatggatccgccgccggagtgtccggactgtgtctatcggctgatgcttcagtgttggaattggtccccatctgaccggcctcgctttaaggatttactgctcagtctgttctctcaacagccttcggaaagcgtcgactcggaacggctccgatcggcgagctctttggcatttgcggccgcttcagcggcacaaaaaagggaagaacggaagcgcactgagcgagaagggacggagatgagctcgaaacggtgggaaatgccaaaaaaggctaacggtgaagttgccatcaaaggagtgccgaaggcggtggtgccaccggagcggtccttttgctgaacaatgcccggctgtcatactcgggatgtgctgccagccgagcaaatgtcctcagggaaagggcactttcgtcgggcgaatcgcgtgccttccctccccgcgtccgtccgccgtcccccgacgcgccgcctccgcccccgcggcccaatcgcagtcaacagaagagggacacgcgtcagcagcaaccgcagcagcagttcgcctccacttttcgaccggcagaacccgcacaaatggtcggaggagtgcaaatactccgcgaaaacagtccagcaggaggcattggcggcagaagtccctctgaacgatattcgccttttggcacgcgcaaaactccgcagcaaaattctccgtgcggtgccattcaaatgaaaaatccgcaaaaaacattttgggtgccaaaagcgcaattggcagagaaaagtataaaaggtcaaaggattgatgaaggggtagactgaatatgccatttaagcagaaacaatggacgaatgttccgacaaagcgacgatggtaagggaattagaaacaaagagggaaaaaaagcaatgggacaccaaatttagggggaggaggaagaggaggaggaaagaggaagagaaaacggaggaggaggaaatggaggggaagaggaggagcagcaacagtgggagaggagacagaagagcaggtggaggaaaagcggggcaatcagtggaagcagcaaaacatttaggaccaggggccgtaggacggacgaaacaaacgacgaattgccgggggcactgccattggaccatttgaaattgcggctgaaaaagaccgtctccgaaaatagcacaatgagcagccctcgaagtgaggcggagacggggaacgacccgctgttgaagaggccggagccaaagccaaggcgatccatcgaggggaagacgaaatcgacgagcatggagacgagggacacgccaagttcaagcagttcaagagggaacagacggaacagcacaacacgaaccattctcagtgagaattcagaccaagcgaaaacggcacggatcagaaca

SEQ ID NO: 25201 - DNA, 1642 bp, Heterodera glycines
atttttttttcattttttggcgtagtgttccagctgttgaggtatttttgttatcaatgcttctggattaataatcttttgataaaaagccccagttttaagctaaagctaccggctcaaatagttcttgggataaaaaagttctgcagcatttaattattaataaaatgaatatttaaaatacttatttattacaacaaaaaaaaattaaaataataatcaaatttttttattctattttgaatattttttcatattttacggtggcttttaaaaattgacaatataattggacaataactaattgctgattatttaaatattttcatttcaggtaaataaatggaataagattaactttttttagttgtaatttgtttaattgcctttatatattgcaagaattagtagatttattttagggatttggccaaatttcaaatttcttgaacctttagaaaacttaattgaaaaaaaacacagaacgaggttttatacaattttggcctcttgtaatacaatacttaatgatatagtactttattcagaaatataatcaatattactagagttgaccgggaccggggcgggaattccgggtcctccgaggtcccggttcccggtcccggattttgaaaatttatttcccggtcccggtatggcaaccgggaaaaacaagcactggtaagaatgggggtcaagtgaaggttttttgatggagaaaatgaaaaaaagattcatatttgaacttatgaacatttcgccaattttctttatctttcacacatttttacatttcacttaaatcaaatgtatatttttttcctggcttctccatgctctaaatagcagaaaaaacactttcttttttgtgcttgcgtataaaaatcaggacttttatttgcatatttgatgcatatttcacgattttatttgcatatttatgcgcatattttggccatttttcgtgcatattttttgcagccctgactattatttataaaaaacgacaatttcttcttatttagtttatcaataacagaaaatgtctgaaatctgtaagtttttcaattttctcaactcaaaaacaaggaaaatctgagccaaaaggacggggaaaaggtgtaattaatttaaaaaaattttgtttttttatctattttagaaataaaaacaaattgacaattttatggtaatatcaatagggatgtcaaaaatatgtacaaaaattggtaaaaatatgtacataatttgtacttggagcccaaaattgaatcgccgtgtgtatttacataaaattgacatccctagtgatcaaaaaaagtgcattggaagaggccgaaaagaatgtataacacgaataatgcttcgccagaacaattctttttattttttcgatgacgcggacttaaaggattgtgcaagaaggcctatcccagtcttgaatttaatacaaaggcatttcttaattttgcattttagaaatttgaatttgtatttaaaaaaattaaatttttaaaaatttttttgaatttttaaaaattcccggttggtcccggtccaagtcccgaaaaaaatcgaggtcccggtctcggcttctcacgtccccggcaagtcccggtcccggttttgcccaaaattc

SEQ ID NO: 25202 - DNA, 1756 bp, Heterodera glycines
aaataaaaaaaggcattaatgagggatatctaacagttacgtgccatctgttcacagtgctcgtcgccgaaacgccattcccttcggcgtcgaggacagaaacgtgcgaagtgccgtggtcctccttctgaagacattcgatggtttgctcattcccttcgctttcgatctgtcttccccctccccccttctgtccacctgtgccacaaatggctcttcggcataatacgcggaaaacatcgcttttggtggcacgcgcttcagaatctcgcgatggaagcgcgtgctggtcatatttctgtgcacaaatgggcattattctccaagggctctcctttttggccaaatgccgctttttctgtttacctggccaattccattgcctccggcacaaaatcgacgtccccaagttttgttcgctgggcatatgcaaatttctgcgcttcgatcagccaatggtaaaattcggtgtcgtccaaaacgccgtcggtagggtttccgaagcgcgtgtaattagtgaatttggctgaattgaagtcgaaaatttggcacaacaaatgccaattactgaccgaccatcaccgccacaatggcctgagtgacggcgaacgacgacggcggcggagggccgcacattcgcaaggcgccgcggaagccacccgaaatgagcggcgagtcgtaaacctttggtctgtagttggccaaatcgtctttggagagcagaccgcctgatcagagaaggccatttgatcagaaatgtaaggaactatcgattgattgccaatcaatcgattatcgagcaaaatgccatataatgcttttaacacattccttttttgccatttaccatttttctgaatttccgcaacgattgtttccgccatttgtcccctgtagaacaattcgaccggattctgcgcattcgccagcctttccattgtatccgccaattcgggccttcgaataacgtcgccaaattcataaacacttaaaaaatgcgggaattaaaacgtttgccactcttttgatcttttgaccactcaccgatttgtggcggggtttatccaactcctaaaacaaatttaattggccaattaaggcaatgaattaattagtgcaaatgcaaaaggcatttgtccactgacttcatcgatgggagtgttcggaaatgcttctctttgacccccaaaacgtaggccaaatactccgaaatgggcacccccgtcctggccaaccgaacggcaggcgaaatctgatcaaaaggaaagggcgaatgattacgagtgattaattggttgattgatcggcttatccccccccccactcactaagtctgtccaattcactcgtccgctgccgtactctttgaatgccaaccaatagcccgcgagttcgccaggggtcgcaattgcgcgatagcctaaggcatcattaattaccatgggtaattagtgtattcatttggttgatcactcatttaagaaaggtaattagcgtaatacagtcggatgatcacgcatttaacaaagcactattttgtgcctttttctcaccatatttcgatgcccattcgtccgttccgtacatttcccgagaactcgccgccggcgctgtctctcgcgcatccaaaactttgcaactgcgcgatttggcatcgtaaaaagtcattatgaatccaccgcctaaagcaaatggaaaaataacatcacattatgcatatttatttaataattaggcttatctaatccgctgctct

SEQ ID NO: 25203 - DNA, 1630 bp, Heterodera glycines
  misc_feature (76)..(76): n is a, c, g, or t
atttttctcttttattttcataaaaatttgctcaaaatcacaaatttgggacatttttgtggacaaatctgttacnaatcgcataaaaattacaaaaaatttcccgccggcgcctatcggcaccgcgggcccctattcccgaagttttagtgccgcaaaaaatcactttcgattttcgtgctcagaatcccaaatgctttatttccaataaaaaaatgatcaaattgatcatggaaaatctaaaatataacatttgagcattttaaacgtgttttgaataaattttgtaaaaatgaggctttttgacccaaaatgaggcttttttgtctgccaaatgaggcctttgaaaattttagtctggctaccctgtatacaaaagtgaataatgtgagggatggtggaccttcttttttaaatcaattttttaccatcaaaaaaacgatagattgcaattgattggtatctcataatgaaaaagttttatttcttcatacattatatttaaaatataacaaatataagctgaaaaaacaaaattcatttaaatttctctgattcaaaaaaatgaaaattaattttgtaattatttttttcttatttgtaatcgtcgtaattgatggaaccgatgaagatttatttgatgatttgtggaaaaacgttaagctatcaaactcaaaaaacattaataaacctatatttggggaaattaatgccataaaagaagaaagaattgttaaaaatgaaaatgatgaacaaaaaaatgccaataaactccaaatggaaaacacaaagccaaacttatttcaaaaaattaaaaagaaaccattggaagaacaaaataatcatttaaaactaaaaatgccaaaaattgaaatggacaaattgagcgaagaatcatttgaaattgagtttgatgagaaagctgatcagaatgtttcgtcgactgatcatagcaattcttcagatgatgaggattacaataatatggtaacaaaaaaaacagtatcattctaggaaaaaaagtattttttgaaaattcgcttgtttctaaaaatttatattaaaaataaataaattattttttagaatgctgaaacaagaaaggaaattaaaattttaaacgagtttaatttgatgaaaaaggaattgcggtgcaattataaaacaatgccaattgttcaatttgaacgtgaaattgcaaaaaaagttgggcacatatcgtaccaaaatttataaaatgaagagaaaattagaacaaacacggaagtacacagtaaataaggacataaataaggacacaatgattcgaatgatcagaaaatttgatgaaatgaaaaaggaaaaaatttatggatttaaatatgtatgataagaacaaaatatgcaaaattgaatgtgaaattgcgaatgaattgggaattactcggcaaaaaatttatcaatggaagaagaaaattggtaagaacaaatggaataagcgaattttaataattgtctcattttaagatttatctaaaaaattttcaacgccacaaaatattgaaaaaatagagcaatttgaaaaaatcaaacaagaatttaccaaaaaattcaatttgaaaccaaattgggaaattgaaataaaaatcgc

SEQ ID NO: 25204 - DNA, 779 bp, Heterodera glycines
  misc_feature (758)..(758): n is a, c, g, or t
tttaatttcaggataaaaaatcatgataaaaaatctcaggatttcataaaataaaaccgccaaaaggtttgcgtgcgagcaaaaagatttggaattaatttgcaagaattgaatttcctccacctgtcactttggtgacagacggatgattgatgaccttccgcggcactgcgcggcgcgggcaggggaaatgaaaaaacatccgcgaggatttggggaaattaaaatccacaaagcggcagacttcaaagaacaccctcccatataggctcgggattgtgatcgggcggcaacttcaaagggttgcacccctcaaataggttcgagaaaacccgcggcggtaacttcaaagggttgcacacctcccataggcatgggtttgtgcggtaaacacccgctcggaacccgctcgcttttgacgccatatactactacaaaagacaaataagtgattttttattaattaatattaattttaaaataattctcttaattaaattaacattaaatttgtattgttttcatcgattccaaaaaaaagcaacttttctgttaatgaacttttgctcaatttaaatgagattttttccattcaaggtcacaaatgacgaaaaaaaatttattcatatataattgcttcgcaactaaataatctatgaaaaaatcttcattttaatttttttatgtggaaaagaaattattttattcaaaaaattttttgaatctgaagccctggaaggtctaggaatttctcactnattttgtgcaccaatttattt

SEQ ID NO: 25205 - DNA, 1897 bp, Heterodera glycines
gagagaggagataagggtaaatcaaagaagcaaaaagaagagaagaaagaagagtaagaggaaagcgggagagagagagagagaaagtaggaaagagaaaagggaaagagaaaggaacagagagagagaaaaaggggaagggaaaactgaaaggaagaggaagaggaacagagaaaagggaaagaggaaaaggaaaagctacaaaagggaaaggccaaatgaaaggggaggggagaaaagagaaaaggaagcgaaaattagagcaagaggaagcccgttttggttggagcaaaaacagcaaaaggcggggagggaaagaaagtggtcgcgcaaaaacaaacacttttgctcacgctttcagcagcaattaacaattaatgggaatttaattttgaaatgcaaatattttaattgtttaattactaaagtttcacttcaagatcatgaattgcataattaggaatcaaattctaaaccatttctttttcagttcctcaattagtaattctaattagttaattaattcgttaattgccttccgtccggaccccctcttccctccctatgttttttggaaaaagcgcgccgaaaaaaagtgctgttaaaagcaaatctgaatttctattaatattcgatcatttggtccaaaaatgattaattgtttgaaataattgaagtaaattcgatttgaaaattttcattaatttaatttatctttaacctttggattttataaataaaaaacaaaataaaaatttaattttgtattattttcagttgaaaaaaaatttaaatttaaatttttttaaaaatttttgaatttttttgaatttttaaaaattcccggttggtcccggttcccggtcccggtcccgaagaaaaatcgaggtcccgatcccggtcccggcttctcaggtcccggcaagtcccggtcccggtttttgcaaaaattcccggtcccgtggcactctactttttatgtgcatatttcgcgatttttggtgcatattttatgcgcatattttacgattttatatgcatataattttacaccctagtcattatttttcaagaaatttaatgatctgccgcaaatttttttttgatcttttaatcccgaatttactgaaatttataattttgcattttcctccccaaaattatcaaaattgataataggagactaaaaaaataaaatttgatcgaataaattggaaaaataactgattagaaaaatttttgatactaaaatcttattttgggcttggtgttttattttgaaaaattttcgatggaagccctggtttaaaaatacgtgaaaaggtgtggggtttaaccgaaatttttgcgaacccaccttaacatcgaatttgacggtgctaggtcaggttgtttcgtaaaatccgccaccttgagcttttcgtaaaatccgccattttaaacatggtataactttgcttaaaatcaaccaaattttaccttcttggtaccattcgatagccattttgtttctctactctcagattaattgccattgattaatctgtccattgatattcgttgtgttaatttgagtggcttaatgccctcctctgccagtgaatgtgaacggacggcattttctttgctcgcacaacgacattttgggaaaagcaaactaatcctcaaccaaaaatgaaaaagcaaaatgaattgattgatttatgctcctctgaaggccaaagtgatcacaatcaactaaaagcttataaaatcttttgagaaattattttttttatggtttaaaaatggtaaattccaggctaaaaaatctgctaataaaatcccaaaatttcttctccaattttattttccttttttttttaaacacttttttcacaattaaatcggaaaattt

SEQ ID NO: 25206 - DNA, 2164 bp, Heterodera glycines
aatttgtaggcctcggcggcccgtcaatcccaatattccgttttcgaattttgcccttcccaaatgcttcttttttgtttttgcatcaaattttaaaatttccaataatgccatttcttccaatttatgcttcagccagcagcggcgccactacgccagcggtgccatgccaaaatacacttacaacaacaggaaagctgacgcccttctgccggacaaatggggcgccattttgttttttggcgtgttctcaatcccgatgatctacataatctttggccgcaccgacgccacagtgtggtggaagctggaggatgacgacaaatgagaaagtggactgatcgatatacatacaaatgatccaactcttcatttacaatttggaaaaattttcttgtaaaaattatagggaaatataaatgaataatgacttttcttttctttgtgctatggtattcaacatgtttttttgagtctttccaggaacaaaattttgtttcgaaaagctcaagtctgaaaacatttcagccaatttcgagcacgggaccccaacttcaacaacaagccgaaaataaaatcctgccttttttcgaaatttttaccggaatcccggtaccatcttttggtacttgtgcagtttacggtaatagtgtagtttgtcccccccccctttttggaaaaaaaaatttaaaatttttttcttcattgaaacatgtttttgggggttttcgaggtcgctgatcacgaatctgacctccattgcaaccaatttcgaaccccggacccaaattcgaacaaaagtcgaaaattcattttttcaaaaattctcatttattgtccaaaatcgattacgatgcacgaaagaacaaatttgcagaagaacaaagctttgaattcattcacatgggtatagttcagtgacatgagaccaaaaattataaaaaacatcaacggtatcgccaaaatgcttgcgccacataaactcggggaagtaactttcaaatgtgtttgcagtgtttccgctacgtggtcggaattgcttataatgatgccacattgcctcaacattttgggtataagaaccagtaagaggggacaaactacactattaccgcttaagtgcttcgaaattatttcgaaaaccataggaaaacaacaaaccattttttgccagactttcatagccgctgctttctcagttttagtgctgaaaacttttggtcgcatgtttaactggtcccaaattccagcagaagcaagtcgattgaactctcggtaatattcggcatgtccttcgctgaaaaggcaaaacagtaaagaatcaatcataatttcaaaaacctaatgcttgatgcgaatctcttggagatagtagttgaaaaaccatgcattccgcgggaaattacaggagaattcattcgtaatttgctgattttgatttaattaaagtctacttataaaaaattctatgctataattgtttaaaattgaataaataaatgttggaaatgaatttttgagaaatttttcatttcctaggggtgcattttcctttttattgcattttgttaaaaaggcaaaacgccaaaaatagttggaaatatttttttcaaaaatgaaaccaggtgaaatccaaaagaaaaaaaaagatacttgtgtgttatctgtgggcagattttcaaaaatttttatgtttttcgctataacttttttctttggcatccaaatccatgattgttggtatcattataaagctcttcatatgctctattagtcttactgaaaattgactatttctaggataaattttctaaaaattaataattgctctgacaaaaggccaaaaaatttaattttttttttcataaaatctacatttttacttcatacgcaaaaatgcgatttccaagtacaatcttggaaaaaagtacagttaaacttttccaagcacaaaagccgaaatccaagtatgtacttggcattcaagtaccaatccgagccctgaactattataatgcgataaatactaatattttaataataaatttaataaatcacatttaagcaattgtttaattcatattcattcattaaggattcctataatcgctgattaattttaataaattttttcccaattaataattaaaagaattggccatcc

SEQ ID NO: 25207 - DNA, 1520 bp, Heterodera glycines
agctcattgtattttagtaaaaaattaacattaatattttttacccttataaattctacactataattatggtaaatagcaagaaatcacaaaattaaaaaaaattcctttagtgaatttttgcaagcaaaaggtttcccttttgtttaatataaattccaagggggagtgaaaatttgttacaaacatatatttttgtttattgtgaattacaatacaatacaaaccatgtagtttgatcctaccaaattcatattaaatcaataaatctttcgcatatattgttaataaatcaaaatttttgaagaatggtttaaattatttttcttatttttaaatataaatgactttttatattaaaagcaagtttattttttactataaatttttttattaatatataatacgagaatataacctaaatacaataaaatttaagaaatagaaactactatgtttttttctcagatttgtatttggcgcattagtgtattttacattttgataaatccgcaagacattttttaggtggggggttttaaatttaataaatatgcatgaaaaaatacaaattaatttaataaaatggatctgaataaatatatagacgataaaaatgcaattaacgataaatcttcgacgaaaagtgccgagttattgtaaggattattagacgcatttccctcatttaattatttcccattggccattatcaattcaattacatttatccttttctcacctttttccttttctcattgtaatgtttctccgcccattctcttcgcattttctccttccccagtgatcagtcagtcagtagtggtgatggaacagacttcaattatttattccgatttctcgcttcgtataaatccaacaacgaatgaataaagacatctttaacagtcaatgagtcgtttgggggttcggggcttggtcaaagggcccttggcttttccccattccctcccaaactccatccgggataaacggtgcatagttggtctgggggcacagtgcgcatccctcactggtagcaccggatggttcccattttgggaaacgacccatcattgacgacgaagcagagaattggataagccggcagaagtttgtgggagatctccctggcctgagggctagaaaaaaaagacgtgtacacgcaagtaaagaagtctgagattctaaagttgtccgggctagtcgaagactaaagggactttaaaaaaagagaaaatttgtccgggctagttggaaactaaagggacattaaaaacgaagagaaaaggaggccaaaaattcgtcagggctagttaaagctaaagggacttcaaaaatgcaaaaaagaggacaaaatttgcccgggctagtctaaatgctaaaggggctgattgctcagaaaattgacaaatttgacgagagagacagagaataagaagagagtgaaataagccaaaaataaccaaaaaaggggcctggcaaatagccgaaaaattaactaattttaaaacctgttt

SEQ ID NO: 25208 - DNA, 1598 bp, Heterodera glycines
aattgttatagactttaatttcgcgcaatttttgtcatgattttttttttgaaattaaagcatccttgatactttcatctagtaattactttcagggttttcctgaatctcaataggaatttgcgaaagtctccagactcagattgggaaaatttatggctatgttgcttctcgattctcggaaattttcaatcaaatgagcgggattttggatgttggtctgatcaaaagcctagtcatatttcgattttagttaaactccattttcagcgctccgatcattgaatggtcagcaggtgaattaataagagaacgcaaaacatttttatggccatggccaatttggaaaaaaatgtttttattttaatctttttttttataaaattgcaaaatgaattttaatatttaattttgactgcttataaaatgaattcggcaaaatacgatcgttttgatgaatatgaaaattcaacaaaatgaaagttctgaaatgcgcaatttttatatttttagcacaaataaaattccaactaggacaaacgaagaaaaatttagtaacgaaaaaaaaatccaccaattagcgacgaaatattgcaaagaaattgggaattggaagtcgaaccctttcacaccttggaaatttttacattttttgtcaaaaataattgttcaccaaatccaatctccattttttggctggatttgttcgaaatttttccacttaatgactaaaaataacattaaataatctgaaaataacgaattttcaaccattgtccccctttcctcccattttttgtcaaaaaattttcaaaaagcgtaaaatattttctttctttcaataccacacatactttgttgaaatttgatcaatctcataatgcccctcttttttctcatttcacaatgaatgccaataataattcattcattttttgtctttctgctgcctgcgcgaacgaatatttattgcgtttgtccgtcggtcgtcgccgccaccgccgtgtccgtccgtccgtggtgcctgccttcctctcattctctccaatcacatttttgcgatcattgggggaggtggggggaggggatgatttgatgtgatcagcagcagccgcaggtcgatctgatttgtcggttcagcacaaagtgtggtgaaagaagaattttgttttgttttgttttgaccatccggcggataaaatgtgccaccagtcgatttggggtggttctgccgtttttttgtttgtgcgtccgtcgatcataggtttttttaatcattgttttgggttaaaattttcgttttttgtttgtggtttttagtttgattagcattgcttttttttaatattcctttggctcttttttgtgcatttttcttttattgacaatctttttcttgcatttattaggcacttaatttagtgaaattagcacccattttaaattttttaatcttctacttttattcggattaaaaataaaattttggaatttgggtgaatgtttaccatccatctttgtcactgctgcgtgttgtcaagtggcgagttcaacgcctccactttaagctgacgatgttctctcatggaaaactttca

SEQ ID NO: 25209 - DNA, 780 bp, Heterodera glycines
aaaatggggccccataatttaggtcaaagtggggcgggggcatgtgccgtggatgagcaggaggcgcgcggcaccgttcgctgccgctccttcttcccggtggtgaacccgggcgaccgatggtgcctggcgcgcgccatcgtcctcgggctggccgaccgccgcgcccagctgcagtacggggccggaagcatacaggcggcggcccaattccgcgccttctggctggcacagcatgggcctggcggtgcgcaggcggcccggcagctgctccacatggccacactgccgctcgacaaaccagactacggcgttgctgatgctcagcgtctacaacaggcgctggacacgcggctgggcgcgcagcaggtgcgcctcgtgatcttcgagcgggagcacggctgccgcgtgctgtggaaaggtgtgcagcgtgcgcacttcaacatctgcgtgttgctgcagcagggcgcacactacggctacattcaacggcctgcgcaactgtttcgggtgagaaaatttatccatttaacgcaaagaaaagaaaagcaaaaaaaaaacaaaagcaaaagagaatatgaagtgaaaaaaaatgtgccaagtgaaagaaaattaagaaaagtaaaacaaacttcaaaagaaaaattcaaggaaaaatgtaaataataaagaaaagccgcaaagtcaacaaaaaaaacaaactcctagaaaaatatataaagatttatggaaattcatttaaaaaatttattcatttaaagaaaagcaaaaaaaagaaaa

SEQ ID NO: 25210 - DNA, 1837 bp, Heterodera glycines
  misc_feature (294)..(294): n is a, c, g, or t
  misc_feature (362)..(362): n is a, c, g, or t
gaaaacaaaaaaatcgattttttcaagtgtccgtttggggtactcaatcaattatggggagcaaaaatccaacgcagaattaaagtacaggctatagggaagctattcccgaaggattcggtctccccataaatctgggcgcatcggttcggggggactgccccgaaaacaaaaataaatcgattgtttcaagtgtgggtttggggtaatcaagcaattatggggagataaaaatataatgtagaattaaagtgcaggatatagggaagttattttggaaggattaggtgtggncataaatttgggagtattggttaggggggagttattagaaaacaaaaaaatagattttttgaagtgtnggtttggggtaattaaaaaaccctgagacccccgcccccatgttccacatttttttgggaaaagcacgccgcgaaaaaagctgttttaaaaataaaaaaggtcggcaatttacatacccgggacccctttacaaatgattcccaaaatgaaccccaaaaatttaaaaagaatggattttacgtcacaaattataattttttcctttcggaaccgccaaaccaagacaatctttttaattttttttaaatgggtttcttaaaggatgagattattgaaatttaatttgaaaattttgaaaattttcgaccagagttcagaatctgccatttttcctatttttgctatttttctcccgcggcccatattttgggattttttgcctcaaaaaacatgcaaagcttttattctgatcataaattactcttaaccaatttttagattggatttttttaaataaaaattttcaaaattaaaaaaaaaatttttttttgaatacggattgcggattacgggaaattgcggggttttttgacccccgcaattgcggattgcggatttccgcaactgagaaaatcgccgcaattgcggatggcggatttccgtaattgaaaatccagttgcgcccagccctgctctaaatggcatataacacacattcatggaaacactaatatttcttgaacatttttgttttatttttaataatgaaatttcaactcaaaccacagtaaaacagtcgttaaaaagaaatttaattaatttttattatgtcacaaaagcaaataatttaattgtaaacaaatttcaagcaaaaaacggataattaaattgcaacttcattaagtgaaacgtactgaaaccaaagtaaaaattagattattaatagaaagagacagttaaactaattctgcaaattgaatttcgaacgttctttcggtagcgtttaaagtaaaaaaaaaaaaaaattccaatcagaaattgtgaattcattttaaaattattggcacaaacaatggcaacaaagaatggcctcaattaacaccagttcaaatgatccggtattaaactttagtaataattattttatttaattaattaattatttatttaattgtttcgcccagctttatttggcctaccgtttcgccggtccatccgccgatttgattgtgccggctgttgcactcaatttggttgcgttggttggcattgtgttgaacggcacagttttggtggtcactgtcaaatccaagtaaatcattttttaattaatttaaatttattttcagttccctccgcggctccgccaattttctgatggcattgatttgtatttgtgaattggtccaccaaattgggcactctttttttctggttgttgtcatttcgggcaaggattttgtcagtttgctcactgctgacttaattatgataggaaatttaattttaaatatttttttaattttgatttaat

SEQ ID NO: 25211 - DNA, 1495 bp, Heterodera glycines
ttcatgtcaatttatgtcatataattttcatgataaagcaaaaataaaatcaaattaaagatcgcaggaatttataaataaatacaagaaaagagcaaatattattctgcaggctttttacattattaattggccaaaaaaagcaaatccgacaaatcaatacatataattaatcatcaatgaaagcgatagaaaatgtttattccaaatattttgcatttgcgtcgtcgtccaccaaaaccaaataaggaaatgccaaaattgggggcccatcctttgacagcccccggggggagggaaaatagcgaacggaggcgccgaaattgtgctgttttccatcgcggcgccgtttaatgtccaacagagagaacataaggaaaacgttgtaactgaagggagcaaaatttgtaattatttgatgaaaaatggtcaatttgtaatttttatggaaaaaaacgaataaaaatggcaaatttatatgaaatataaaaaatatcccaaatatgtacaaaatatgcaaatatatctagacataaattcgtagaaaagcataaaatacagtcaggtgcaaaagtatatgaacaaaaaaaaatttttttttaaacccggttttccatgagatgcgtgattggatggaaatctttatctatgccaaaacaaacccccaatattactcgtaaaaaacggcaaaagacattccgatcagtcaatccatcaaaaatttacgagtgcccaacaaattgacccaatttttggcggtgcaaaagtatatgaacaaaatagttaatcgccaaaaattcaattccaattcggcagaaaattctgaaaaaattcctgctaagctaacttttgatactgatcaaaagagtcttttcgccaacttgatcagatcactccttcatggtgatctgaaaagccaaaaatggcttgaaatcgggaaattttcgaaaaaaatccctagggggttaggaaaatttttctggaaaatttaagtaagcctgtcaaatagaggacaaaattctctaccgaaatgcttttggaatggtgggcctaggactaattaatacccgtggagaaagagagcgtgaaaaattgaacaattcaaaaataactgatttctaccgtatttcaagggaaaattatcaaaaattgatcatttttgaagtgtccaatttataaaccaagtataactttttatatacaagtcatagccacatcattcaaaaggcaattcggtagagaattttgtgctctttccaatggccttactcattctcactagaaaaattttcccaaccccctagtaatttttttctaaaatttccctgattttcagtgtattttagggtgtcccgatctatgaaggagtgatctgatcaagttggtgtaagagactttttttgatcagtatcaaaagttatataaataggaattttttcagatttttgggtaaactattaaatagtttttcaagtttgaggcaagacttttttcc

SEQ ID NO: 25212 - DNA, 832 bp, Heterodera glycines
aaaaaaaaaaaatcttttttttcaagtgtccgttgggggttctcaaacaattgtggggaacaaaaatccaccgcagaattaaagtgcaggctatagggaagctattccggaaagattcggtctccccataaatctgggcgcatcggtgcggggggaaatgcaccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaa

SEQ ID NO: 25213 - DNA, 1474 bp, Heterodera glycines
catggatgaaattgatcgaaactcaaatttaaaaaaacgcattttcacaattcgagaccgatactctcgagcatggggaactcttacaaagccaaagggaagaagtttgtcgaaaaaatgaagatatctttttaaataatttaaaaacataataaaaagagattaattaaacacctaatttgtaagcagtgattaaatattaattgcctttttattttaaaaaggattttaatttttcataatttgccatgtaggcttgatggctcagttggctatttgttcgccctttcatcaaaattcccgggttcaattcccctcggcgcatcagttgatttccaattgtccaaccaattaaaatggcttttggaattgcagaaatgcgctaaaatgacccgaaaaatgggcaaggaactccgtgaatggtgacaatggcattttgcctgtctcactgttctccgtgttcctctcacaacaatcttttgttttttttaattaaatttaacatttaaaatttgcttcgagtcggtcaccggtttccgtggggttgtgcgagaatctcggttcccgagtcgagaattttctcgagtcttttggctttttattccttttggtcttccccccccccattttcccccattttcgtctgtctgtctctctcataaacccacttcattgcgatgttgctgccgtccaccacaattgaccgtaactgtgccgttgtcgtgttcttcagctgctgcggttgtgccgtcgtcgctcgttgcgttttgccaccggacgacgacggcaaagactgacggcgctggtcgcggtccaatttgatcagctcacttagcaccagatcctgctgggacaaaaaagtgattgggtgatcagcagcaaagctagaagaagtgatttgctgggaccctgggattatggtttacccattaggacgataattagcggtaattagtcttaatgagttttggccgacgcgatcaagcacattttttcaagtgcaaattggccaattgtccacctgctgttgctctttgccattgcccaaatgtcgcagcaccgttcgcaagtcgttttccgtgtagccaagtcgcgtggcgaactccaacagttgcgagtcgatcgccggtggtgcttcgccggcggcgtcagcgagtgtgccagtgccaccggcggatgagctgccgcagtcgctgctcgtctcgcgcgacagcagcaaatgctgttgctcaccttaagaaggcagggaaatgtcaacaacattgggtctttggtactaatcagccagtgatcagtgccaaaatatactgccagtcctccgatctgttatttctcattatcacttggcactgatcacaaaaaagagaccaatgccaagacaagccttgtcccgatcatgccatcccgtcaataaaccaagctactcaccctctgaacagcttgagtagcacgagtcggtcaacgagctggcact

SEQ ID NO: 25214 - DNA, 1795 bp, Heterodera glycines
cgatgagcttccgacaagcaagtcgaagaacctctccatattgagctgtcgttgcagtgtgtctgcgaaaaaaagaacccccccccccacctcccacccaggagggacccttccagtatccgccacaccgacctgacagtttcagtcccgatgtggcggagcacctgcccgtgccgctcagggcgccttctgcgccatcagcttctccaacagctccacatcctcatccgacacgtccccagacggtcccatctcctcaaacatctccgcctgcgcggccgccagctcctcttcactcatcaaaccctccatcacttccgtctccaactcctcccccacggcggccgcagcctcctccaacgcctcttcaatccccaccagcggctcaaacgtccctcccggggccttcgccacctggccctgcggattaagtaaggaatcgatgtaaacatgctgttggacctggtgcaacgggccaccatcctgtggcaccaccacatcttccagctgcctccccgccggcggttgcccgccagccgacgttgccgagcagctcggcccttctttgttccgaatcaccaccttaatgggtggccccccgccctttaccaccccgccctcatcccgcacctgacaaatcaggcgctgagccttcttcttaatgctctccaggctgcgtggggaccaccccttcttcttgccttcggcaacgaacacggccgccagcttggccagccgggccttatcctggccgaactgcccgccaatgaaaaattttttgtttaagttattatacatgtatatattttcatttttatttattctttacttcaggtgttgtatgcggttgcatttccgttttatatgcattttcagtatacaaacgatagcattgtccaggttgggtccgcccagcacgacctgctctttgcattgctgaggcttgtgaaattggcgtaaccagaaggctctgtgttataaaaaattaatatacaaccaaattcatgtatacaaacacaccaaacaacctacttacatcaacacgaatttgtggattgtaaattttttgtttgcaaaatccagtgtcaacgacaaaggcaataccatcaatagtaattgatgtttcggcaacattggttgcgacaatgcatttacgatctaataaaaaaaagttgtgaacattttatttaagactatttattgcttattactgatcaatgtgcattttttgtttggaatgcattgttggaaaacacgttgttgtttgtccaatggcattgaggcatacaaaggaaaacaatactgtaattaaacaaaagggaaaataaataaattatatatatatatgatatttaaaactatttattactaattgtccaaattgtgaaaccatatcatcgttcatttccagcgaattagccgacaaaccttttcagtctccttaaaattctaattaaatattctattcaactttcaggtataaaatgattattactttttgaccagtcacaaaaattaaaagatccccaggacgctttgcagtcaaatggatttgcaatgctgtttcgaccgcagcatgtgtgtagctaattactggtgtcggagaatactgaattaaaatgcttttattgtgtgaaattgttgttgaagaattttacacgcaaacaaatttaccaaaatgtcaactggaaatgtgcgtcctcgaattatcagcatttcacaataatttaaataattttggaatcgggcagaatccaacgtggcactcatttaaatcagcttaagctttggacat

SEQ ID NO: 25215 - DNA, 1638 bp, Heterodera glycines
cttctaaatctaaatcatgggtgctccaaaaacttcagcaaaatttgaaaaaaattttattgcaaaattttatatttatcctaacttaaaaaatattgataatactgtttaattatagattttaaagctagaataaaatatttttaaacaaaaaccatttagaaatgcttctcctcacaaatttttcgacgaagaggtagattgcatcaattatcatattacaatcgaaacaaaaactgataaaggaaaaccgttaatatgtcaaatatattataaaataaatattctagtaaattaacaattaaaacatttgcaatattttcaaaaactttaaatataagagaaataactgaatattaaatgaaaaaacaccgaggatttgccatgcttttttaaaaataaacattaatattttttgatgttaattcatagaataatgaataaattattgaacttggtactgaaagaatttaaataaattcataataaaataaaaattttccaaatataaaacaaaaattagacaataaactaactaaagctagaaattttaaataaaaatttaaaaaaatttgaaaaaatacattggcctgccttatactatgcatgaaaattataaataaaacaaataaaaagtgaacaaatgttgaaaaagaggccaataaacaaaaaaatttaaacaaatttacactaaatcaaatgtttctttgaataaaagcaaaaaataatgtaaataaatatgaaatttattttaaggttttcatttaagaattttaattgtttactgatctgcttcctgtttattttaattttaccataaaaagaatttttggataataaaatataaaataaaacaaaatattaaggaaatgttttaaagaatgtatagaactaaataatatttttaaaaattaaattgataaaaaaagaaaacaatttttaaaaaattatttagcaattgagatcgattaattaaatgtggaattaacaaaacaattacaaatttttgtgatgggacacgagttgaatagaacacaggcccataataacgaaaaaacagaataatttgactatggttaataattagatgtgttataccagcgctaatattaaagaataaaaatcaatgtaagttcaaaatttctaattaaacttccaaggtgtcggtgactgtgccttcagtaacaagcgaactggaataacctacacaaaggttcgaaatctattgtatacaacaaacagcaaatgtttgccaagcttgtaacgaaagttggatcgcgaaataaataaaaaataataggctaaaaaaacagccataataaatttgaatattaacgaattaatatttatataaaattatctatctaaaaaattttattttatttttaatttataaataactatatttttaaactaaatacataatattgtttagaatactagccaatgtaaatttagcgattcataataactacaaaaaaatctgatcaataaaatcattgcattaaatttaatttttgaaatatttaacaaaaatttctttcacaaattaaactcgattttcattttttgtgaatcgaccaaccacaatttatacaacaaagtaatcaatttatgtcctttacacaaagggttgat

SEQ ID NO: 25216 - DNA, 1822 bp, Heterodera glycines
gccggtcggacaacagttggcgcataaacttgctgctgactgccaattgtttttttcagtgaatcgtcggcagtgccatcgcacgcgttgcaaccgctggcggacgaatttgtgacggcggccgtcgccttttcaatgagtgccgcttccacgccatgttgactccgccggaatttgccacgaacggcgtccattgatatgcaaccggacgatttttgactaacagaagtcttaaatgattttaatggataaagaaaagggagacaaatggagtcgaaagaatacccaaagttggaaataaacgcggaaccatttggcaccttcgtacagaacggccatcataaacaccaaaatcagcgagaaaaacagccctaaaaagaaaaataaatgtaccaatagaaggtggcaatatttatttcccccgtaagcctaccataaaatgtttcggtcctccaaaagtcgaaaagaatcacttcccgaaagcctccgtggaaaaacattttcatggcgtggccatggtcgtggtggtgatggccatgagaatggactgaaatggacgctgtaaattaaaacaatacgaattcaagtagagtgattatgatttaatgtaccaaatatattaaagttgagtgtttgtatgtatgtgtccgtggtttgaattggtgtggcgttttgtttgaattttgcgttaaaaatgaatttgaaaaaaagtagagggagggaaaggtgggaaatagtgcactgtctgactgtctttctacgagggcagcggcgggtgggaggggcatacagtgaacagacgcgtgctgctgtgcagcagcagtctgctggatgcgtgcgtgtgtctgggagagggagggagtgggaaaaaagagagagtaagtggaaaagtaaaagaaataagagaaaagaaatggaagggagagacaatagtgaatttgtctcgcaccccttccttatttatatcccatcttttattttataaaatatttaataaaagaaagaggacactccttagtttattcagtaagaaaatcctataatattaacattgtgttgtgttgtataaatgctttgaaaaatgaaatgtttttgttttacagttttcttttgtcagttagtgtaaaaaacagtcttaaaaatgtatcttttctttctttgttgtttgtgtttaaattgatttgattttgatatgaaaggtattgttttgcttatgtttttaaatgaatgaatgagattttgtttgaaaaatttgtatagaagaaaaatgttgtgtcgtaagaaaatgtcaagaaacaaggaagaactgttatgccataagaaaatgccaaaagaagagtgcgaggccgctaagcggtcgagccgctgtcggttttatcattcatttccggttattgggtttcgaagaattggtgagattgaattctggagtgattgaaatgcttgtgggttgagtcccagtgattggaatgctggtgggttgagtgccagtgattgaaatgcagaattgagtcccagtgattgaaatgctggtgggttgagtgccagtgattgaaatgctgttgtgttgagtgccagtgattggaatgttggtgggttgagtgccagtgattgaaatgaattaagtcccagtgattgaaatgctggtgggttgagtgccagtgattggaatgctgttgggttgagtaccagtgattgaaatgttggtaggttgagtgccagtgattgaaatgcagaattgagtcccagtgattgaaatgctggtgggttgagtcccagtgattgaaattctggtggattgagtcccagtgattgaaatgct

SEQ ID NO: 25217 - DNA, 2134 bp, Heterodera glycines
  misc_feature (10)..(10): n is a, c, g, or t
gcaaattttntgggaaaaaaagtgtttacattaaactgcggaaatgaatggccccggcaatggatcgaatccacgagcgcaacgagtggaacgattacccggacgagtaatttcggcctaagaaaataatgggtcaacgaaatatggtggaaatctacggtattttgcaacggtgacgggtaaggcatttgtaaatgccagacgagacggtcaaaacaacgccaaaacaaaatccgccaataaaagcagcaaggaaaagccaaaagaaagaaatggcatgcaacgaaatgtagttttcaaaagtgtgtgggttggcaccaggaggaaggcaaatgttgggactcgtataaaggacgggctcccaacaaacatttggcaattcacagagcacagcacagtttgccttcgtttcccaggcagtttcggccatttcaaaattttgcttttaataaaaagaaataaaagaaagaaattacagaacgaaatgattggccggatgaagtgcgacaaattgacgctgtttaccgttaaatcaatgcccccacccccttgtccattcaaattcactctttttgaacaattatttaaatttttattcccttctcaccccgccccgacttcttttcaaattcaaaaaaatagttaattctccgaacacatctgttcatcttttaattgctccgatcgcagaagtggcgagcaaaggccgaaaagcggctgacggcaaacgataaaggcgcctattgttggccgaaggggctgcttggataaaccaatgacaaaaatgttgatgtttaatgttgaaataaaagaaaaatcacgagaaattccgatggaaaattgagctcaatgaataaataattaatggccaaaagtaattaacgaaaaattaaaggaacagaagcgaaaaagcaaaggccaattgtttaacaaaaataaagataatgagaattggcaaatgttgccaaaaataagatgatcgggaagaaattaattggcaattacgagagtcagcagttgatggaacaaaagagtcatttggcaaatcctaggcattttgcttaaaacaatcgcgatcggacgcatcgtcactttttttgttattcattttttctctcgagcaattaccaacggcttttagtttttcctatcaaaagggattttcccatttaagccaaataattttaaaacgactaaaccaaaacaccgaagttgtcaaatcatcaatttttgatcgaacggaacatcacgcagtcgaaagtgggcgagatcggtactgatcagtgatcacagcggaacatttgcggtgcggacgtgacttttcgaagaaggcaattacggacggcgtgttcaactacgaagtggaccaaattgaagcagtcgctcgaacggacaaaaaggtgaattcagtttttgaaaaaagggttttaaataaagggccattcgtttaaaatacaaaaattgcctgtaatttggaaagagtgaaaattaataaaattgaggagtaatttgaaggagtgtaaattaacgacagtaaggtgaaggatttgaaatactgtcgaattgtgcgatttgtgcaaaaagaccaaaagtgattaaaaagtaaagtttgaatcttgaacgacggcagaaaaaaataaattattaaaaacgaaatcctctgaagtgcctgattatttacagaggggatttaaggacaaagttaagagcaattcagaaagagacaaaaggacaaaggagagagatattaaaaaaggacaaaatcaaggggaagaaaaaatgacggacaataatgatttggaactgaaataccaagttttaaaattaaaagtggatgaattggaaggcaaattggctaataaaatatcaacaaatttaccatcgggcgtcaaaatacccaaatatagcgccatgggcgattttcacaaattttaaaagaatttaatattttggctacggcgtccaactggcaccccagcgactgtgttcgcatgttacccttatttttagagggggaggcaaaagaaatttttatgaatatacccgcggataaaaagaaaacttggcgggaattaacggaagcattggcggaccatactaaaaaggtggatggaccgatgtgggcaaagaaagt

SEQ ID NO: 25218 - DNA, 1516 bp, Heterodera glycines
  misc_feature (1459)..(1459): n is a, c, g, or t
tttttatgtttagaaaatacatcaattttctgatgttgataaaaagaataggaagggaaaggtagcaaaatgttgtataagaaatgtcatttttaaattttaatttaggctattgctaaaatgataatgtcacccaaattttcgacaattttaaggccggaaagaaaaacatatcgaaccacaaacaaaagatgttgatgaacaaaatgatcaaatgagtaaaaatattttagcattaataactaattttcaaaattaatttcaccgaggcaacaaattaatcttataaaattttttttagacagaattaaacagaatattcaccaaaaaaaattttttaaataatttttaaatttaggaaactttaaaaaaaattattccacaatttaatatttttatacggaatagaaaacatagcgattttcgtgagaagaataaagggaaaaacttaagaagagtaattaaaaatatagttattaatgcgaattttaccaatgaatttaataaaaatgttgcaaaatttaaattaattttatttataattaattaagaattttaagagaaaaatattttatctttttaagataaagcaaaagtgcccgatgataaagattttggtattgaggagcctgaacatttcgatgaaaatggtaaattaataaataaaaaagtaaaatttattttaaataaaaaagaaaatgcggctgctgaaagtacggaatgtccaatatgttgtgattatgtaacatatgatcagctctgtttctgtgatcatttaattggtgacgcaatttttggtagcagttcaaacaatgcacaaaaaggcatagcaattaaaacgaaaaatgccatttaattaataaatttaagaatcgcatgccttctgccgcgagtgccttaaaggctacacaaaagcggcactcgaaacgaaaccatttgcaagcggttggctggacactgaaatgcatgccggaaaaatgcgaaaatcctcttccatggtgtaacttttaatatatatattattaaatttttaaatcgattcattatctaataccaatatgatgtttcttacgtcacattatattaataaaaaatttgtatgaataatataatttatgaaaaatgaaaaatgattattttagtattatacaaaacgcgaattataggattacaatttttcttgataatttgcattaaatcattttcataaatttatttcccattaatttatttcgtatagaaaatgaaaacgaaaattttctatatttttttgtcattgcttttgctattctctctgatacaacgaaatgagtcggcaaacacaaacacaaagcatttgaaatttgttggaagaaatgggaaatcagccgaaaatgggcatgaacagaaaaaacaaagtcaacaaattggtaattaattatgggtaattagcgggtggaaggaattcaaattttattanaaacccacaagaaaaatgaataaatttaataaaaaaattttataaaaagttaaaaca

SEQ ID NO: 25219 - DNA, 1529 bp, Heterodera glycines
  misc_feature (1361)..(1361): n is a, c, g, or t
  misc_feature (1488)..(1488): n is a, c, g, or t
cctattttttttttacgttttgaataaattttgatttttttcacccataatggacatatctacaaattggtcatgagagatttctaaaaatccatgagacacttaccgaaaaaaggcgcttgtggtacgcctaaagtgcaatagagtcaaaaaaatttttcattttttaaaattactttagcaattatcacagttatcttcacttttcttactgctttacttcacacatgtgctttaccactttcaactggtcctaaatttatcatttggtagtatattttagtacttatagttatttaacctaaatgtgaataaaatcaataaaaatagcaaatagatgtcacctagttgtatcgcaacatatcacgaacgttggtctgggagactcatgattaagttttgcaaagttttggcgttctgattactaaatcgtaataaacttatttgtacttggagcccaaaattgaatcgccgtgttaagacagaaatttaattgttttgatttttctcattaaaattattcaaaaaattcccgaatgccgaaatgggaggagacaaatttagcactgaacacatttaccacaaatcgtctccaaaacaacaacaagccaacattatgcggacgagcagcatcagaattgaccgaattggcactgttgagcaaccgggccctaaaaacaggcaaaaaatcggctaaaaattagaatttctgcatttttaattcaatattttttggaaatttttaaatcatagaatttagcttttctgaacagtcaaaagttgaccaatgtgcagcaacaccttctgctgcgagcaatgagaagcaacaaattgaatcgccaaaaagctttttcatacaggtgggcaaaatgtatatggtcattgttgggtactttaggtttttgtcaccccctgaaattttttttctaagaattttttctaggctcatttttgatgctgatgacgaatctgactttttgtttttaaccatgacgtgtttccagtgagttaagtgaaattttacgtgaaaaatttaaaaagataacagtgccgattttaacccccccccccctttagaaaaaaatttcaaaattttttttctcgaagttaagtcattttaggtgttttcacggtcggagaatccggttcctacatccatttcgacacaattcgaaccttgaacccgaattcgaacaaaaagtcgaaactttcaatttttctagtttcgcttttcacgtaactcacgtacaaaacactttatgcctaaaaataaacgtcagattcgtggtcagcatattattagaaaaaaaatttcaggggggtgacaaaacttagaagtacccattgatggatggcacggngatgggaccaaaatttaaaaatcggaaccggaaaatcaggatttcaatgcttgaagtgatggtttttaattttttttattcttttaattcttgcatttttatattaattttatcaaaattaaatgangttaaaaacaagtttggcatttaatcttgttttggatacgt

SEQ ID NO: 25220 - DNA, 1208 bp, Heterodera glycines
agttcttctacaatccacttttgtaagcaaaatttaaggttaaaataattaaatcatatggcaattccatttaataaaaaaaatacatcaaaagacaaagtagccattaatttttggaagcgtttggacgcatgtattttcgcctatgtggtaactactttgaacttatgatgtaatttctagtaactaacttcctattgaatgatattgctatgaatttgctgttttctttttgttttgagctttaatttttaatggaaaaacagattgcataactttggccgcattctgtatatgctttttaacgtacagaaacatccatttcctctgcaacacggttggccacgcacatcgcagccagccttcgtggctgcgtgcaaataactttttgtgctgtgccgtgaacaaaatccattgcccattgtggaatttgagtggctttgccactgccagtttctccaacaattaaaaggcattgtttttgtgattgtagatgttggacaaattgatgttgatatttaactacaggaagtcgccttcgggtttcaagcagttcaaaatatttgctggagtatggacggttatttaagggattaatgtgggacatttttgctaaattttttaaaaatcgttaaattcgatattaagttatttagaataagaaattgtttactctattctacgggccgttagcttctccaataaatgcatacttgatatgtatttattgggtactggacttgcacaccgcgatgaggtggcccttttgtgcaagacctacctacctacatatctattgttaacaacagtatatatttatgttaacttttcagaaatgatttttttaaaagaatttattaaaacacaacactggggagtaaagactccgaccaagtgttgtgtacaaaaaacaaaccacacaattaaataataaaattaaaatttgaaagaaaaacactacatgtataattaactattttctaaaaagtacggtcctgattcttcttttttttctttgtgcaagcgttttcaaattccgcttacgatgttgttcctcaagacgcgcctttttggcttcttcgggcaattctaaattatgttgttgaatgtataaagatgtatgtttgatgatatatatattttaatcttaaccataatggtccaaaaattctttttgcttctgtatttgttgttgtggctgtgactgc

SEQ ID NO: 25221 - DNA, 1282 bp, Heterodera glycines
  misc_feature (217)..(217): n is a, c, g, or t
gttatgtttacatgtaacatgtacaaaataattatttttgactttaatgaacaaaaatgaaattatatctattcataggaaattctgttgacatctaatatgtaaacaaattagacttgaatgaacaaaggaaaaaatattatatggattataatttacatgtgacatgtaacatgtaacaattgtaggattgaatgaacaaaaaatgaaagtttcncagtatatttatagtggtggacccaaggaaattatgtttacatgtaacatgtaacaaataattaattttgactttaatgaacaaaaatgaaattataatctattcatatggaatttctgttgatatgtattatgtagcaaattagacttgaatgaacaaaattggaaaaaatattatatggattttaatttacatgtgacatgtaacatataacaattgtaggattgaatgaacaaaaaatgaaagtttccagtatatttatagtggtggacccaaggaagttatgtttacatgtaacatgtaacaaataattaattttgactttaatgaacaaaaatgaaattataatctattcatagggaatttctgttgacatctaatatgtaaacaaattagacttgaatgaacaaaggaaaaaatattatatggattataatttacatgtgacatgtaacatgtaacaattgtaggattgaatgaacaaaaaatgaaagtttccagtatatttatagtggtggacccaaggaagttatgtttacatgtaacatgtaacaaataattaattttgactttaatgaacaaaaatgaaattataatctattcatatggaatttctgttgatatgtattatgtagcaaattagacttgaatgaacaaaattggaaaaaatattatatggattttaatttacatgtgacatgtaacatgtaacaattgtaggattgaatgaacaaaaaatgaaagtttccagtatatttatagtggtggacccaaggaagttatgtttacatgtaacatgtaacaaataattaattttgactttaatgaacaaaaatgaaattataatctattcatagggaatttctgttgacatctaatatgtaaacaaattagacttgaatgaacaaaggaaaaaatattatatggattataatttacatgtgacatgtaacatgtaacaattgtaggattgaatgaacaaaaaatgaaaagttccagtatatttatagtgggtggacccaaggaagttatgtttacatgtaacatgtaacaataattattttt

SEQ ID NO: 25222 - DNA, 2093 bp, Heterodera glycines
  misc_feature (21)..(21): n is a, c, g, or t
cgaaataagcggtgattttcncaagaaaaattttgccgatttcaccgggtgccattgttttcaaatatcattttgccactttttcggaacagaattggtcaccatactgaatcccgccggtccgaacatactatcaaaacacgacaaccctttatggcacaatgactgacacgtttctaaattggcgttttaaattaagccaattttgtaatttggcacattcgtcacccatccggcactttgagatttttaccatataccccttttgactatttgataatttgataagggccccttaacactctaccgttttgccaaaagttaatcgttttgtgctttctgctggtgctgttgtaccagaggctcgccactttaataagataagaaaattggtatttaaattaatttgtttcgttaattttacatttagtgctaattaatgggaacaaacagtttaattacactaattagttagttttgggccaaacataaccacgaaaaattaaaactatgaaaaggcataacacaattcaagatttaaataaaaaataaaaatggttcataaaacctctattaccagaaaactttttgcgaggttcaaatttttttcatattaaaatataattttcattcactcaaattggccagcccaaatgactaatgcaattaatggcattaattgccgtcgcaatttccgtggcttacgctttgtgattttggcgttgatgtgcttgcttaaccttcggcatgtgcggcaccgttgtgcttcatatgaccgtaatttgcatgagagaggagacgacgacaaatggtgccgaacaatttaattaaattaaaaacaaaaataatgaatgcattaattaattggcttttcccgcaaccgaaattccctcattagcaaagagagatggactctgaaatcagaatttattaaaattttacataaagtatttggtttatcggaacaaaatatttatttaaatttattttttaatttaataaagttaaatttttcataaaaaattgaaaaataataaaaacttttacaaaaaccataaaattaaaaaaaatagaattgtcactataatatttatatattctattgtagaaaaaatgacaaaataaaaaccaatgtagaaataaattttgtgaatccattgaaatttttctccctttaatttattcaaaatttattattattttaattgttttttaaatccttttttgaattacgttttcattttgcctcagcaacttccttttcggccccgatgttctctttcgttgaagagggttggctgttctcggcactttccctcggcactctgttgggcaccattctaattggccatctgtgcactttggtcggttttcgtcgcacattcactgcctacggtattctgaacggactgggtacggtggcggtgccattggctgtcaaatttctcacaaagccattccattttgtggccatatttggcgcccgattcttccaagtgaacgttttatatttaaatttaaattttttaataaattttttaagggaattttcctttcgatgtcattggtggccattggtaatatgatgtgctgattaagtgtgataatgagcgtaataaaatggggcacatttcgaaattatgcttaagccacaaaaaaatcgttaggggggcaacgaaaaaattataatttaaatgtcccttttcattaattgtttataaatttaagaaacaattagcaaacattggagcacgttgaaggagatgactttgttcataagcattctctccattcattttcaggtgtttttttgaaaaaaatgtttttttaaattaaaatgagtaaaattaaattttgcaaaatttacaatttttgggcaataatattaaaaagggcttacaattagttgaccttttttagcttggccgtatcatcacaatgcctttgtccggctttttgtgcgactcttcgcttggctggccaggccgtttattatttccttggcattccgacgcttttcacattttcacttttttgtttgttttatcgggaaacgccatcacagcacaggtgcgatcaccaccatcagaagc

SEQ ID NO: 25223 - DNA, 1243 bp, Heterodera glycines
actagagttgagcgggaccgggaccggcgggaaatcccggttttttcaggtcccggtccctatcccggtttttggaaaaacagaaatcccggtcccggtttagccagtcccggtcccggtgggactaaataagcactggtaagaatggggatctgggtgagaaaagagaagggaattaattggtgagggatcaaaaatttttgataaaaataaattaaattatttattttcatttatagcatgtgttcgtatgcataagtggtcaagtggctaaacctttttactttcattatttgtctcttcggttcaattccctgatggaacagaaaatttttttatattttctttaccattatttaattgaatttaattaataaaaaatattttaatttaaaattattattttttcatttttaatagcctaaaaacccataaattaaccaagtatttggtcattttttgacaaattctgttaacaaatctcgctcaaaatttcaaaatttttccggcggcgcctatcggcaccgccggaccccgccccctcccaatgttccaaaaaagtttttcgaaaaaacattgccacaaaaacagcgatttaaaagcaaaaatttaaaagattttcaatttttttcaaaaaaaattttcacttgggaaaagtcccggttggtcccggtcccgggttttttcgcggtcccggtcgaaaaaacttgggtcccggtcccggtcccgacttttctggtcccggtaagtcccggtcccggtttttgtcaaatttcccggtcccgctcaactctacttagcacaaagaaataaatgcttggcaataatccaattattttataattttacaattaacgatttttaattgctttttttgcaatattttatttatatctatttaaaatatatattaaatttctttcagcagaagcaatttatatgaatatatgcatatattagcactttcttttattatatagaaataaaatttttatttttatttaattgcaacaaattttttatctaaaattgagatggatttcttttacggaattctgtccttctgctgtttggcactaatgccatcgacaaactttgccgatttcatatgcattaatccgtcgttggtaaatgaggaatttgctatgccttctgatcaaaacagtggggcgtcgaaactgtacaaaaaggttcttgatctaaagggtgggaatagcaaagatgaaagcattgtgataatgat

SEQ ID NO: 25224 - DNA, 1811 bp, Heterodera glycines
ttgtgatgcggctcaattccctcatgttgggaatgagtctctctcttccttatctatggaattgagaggagtgtagaatgtgtccgtgtagctcagttggttagagcattccacggaaaggaagggtcgtgggttcgagtcccaccgcggattaacgttttacacttcgccatccaccaaaatctccacatggcgctcctgggtggattcatgtccgtgtgttagatgttgatcttattctaacactctctccgctcttacgtgctggcggccgacagcatataaaagagcccggggaccggtcttctcagaggccggggatgtgatgcggctcaattccctcatgttgggaatgagtctctctcttccttatctatggaattgagaggagtgtagaatgtgtccgtgtagctcagttggttagagcattccacggaaaggaagggtcgtgggttcgagtcccaccgcggattaacgttttacacttcgccatccaccaaaatcgccacagatttcgacagtagatgatttcgacagtgattgatttcgacagtgattgatttcgacagtgaactatttcgcttactctttgtgcctaattgtgatttcgacagtaaattgaattcgaaagaagtgatttcgacagtaaaggcaaatttttaaaatcgcggaaaattaattaagttcacacaaaattaacgcggaaacaacgattcattttgtcagtagcactaaattttaaaaaaaggttgagagatgaataaaaattgctgaatttcaattctacaaaataattgatacagtatttgattagaaaaattatattctccttaggattccatttttgtctgtacaatgtggcttaaaagggcacaaaagcaaattatgagtgattgacctttctcataagtaaagataagaggagagcaatggtcattttatctcgagtgttttgcatgcgttaccgctcattcccttccattaatttcttcatggctctccggcgttttttaaaggcgaaatcaaatcgtggcaaacttctcctgaccaatgacggctatgaatatacatttgaagtttgtatgcttttaaatttaaaaaatgccaaacttcaaaggcactctccaaagtcgaagatggttgcgaatattggcgctgtccaagaaggcccccgtattgcccaggtcgtgcaaccgtacttattcgttggcaagttgatgaggacggtacccaatacaaagaaggccgtgtcactgctgcacacaaccatccagcaattaggaacaaaaatggtaaaacaggaggagggggaatggcaaaacgcgtgaaattggttgttctcatctttttaaaggtccgtgatgccaatgaattacttcgacaggaggcggcaagcgattttccaacaacaagccggaacattgtaagagaaacgcggagcaatttgcctattgatgtgcgggtcggaagcgcaccttcagcatcaaatatggcttggaattacaattaccaaaaaagaaagcaccaagaagaggtgatttattaatatattacaaattaaaaattaattttaattaaaaaattcctaaaataaacataggcaggagatgttggtttggatgccctccccgccacggcaattgtcatacctgctcggttgcagaattttgtcattttggatggaaacgttgatggtggaagaataattgttttttgctcaaattttggaatgcaaacattgcgaaacttcagaaatgagatagcgatcgacggaacatttgaagtgatccaaaaaatattaaaaattttaa

SEQ ID NO: 25225 - DNA, 1706 bp, Heterodera glycines
  misc_feature (1636)..(1637): n is a, c, g, or t
  misc_feature (1664)..(1664): n is a, c, g, or t
aacgacaagtcagcttattctctgtgcactgtggcctattcagagggaaaagacaagcccatccatctttttactgggctaacaaatggacaaattgttgagccgcgagggtcgcgcgagttcggatgggacccatgcttccaagtgaattaatgcttattcaaattaatggtttttatattcatcctttagcccgatggatttcaaaaaacatttgcagaaatgaccaaggaagaaaagaatcaaatatcgcacagagcgatcgcattagggaaattgagagaatttttgcaaaatgagaaataaaataatttaaaaaattttattgtttgatatataagaacataaatattgttaagtgaaaatgctaaaaaagagaaccagtttggttcaatgcgaataatttggctaaagaacggttgtgaagggttagtctcgtcatcagagaattgatgtcctctaacttcttcgacatcgcttcgtttgaccatttttgggcgattcttgtcgtaattgataccaaagtcggaagactgaaacaggaagacccctttatcttcgatctcttgacttgtttttcgacgaataaaactgcgacctttccgattcctgtttcccatccaacagagaattaatgtagctccaaaactgttgttgctgaacattgggcgcacaatggaaaatccatgggaaaacgaaaacgccttcatcatacagtttgcacagtttcatgtaggaagaaagttgaacgaggaaaatctggagaacagggtaaatagaaagtaaataaaagcaataagatatacaacaccttgacgtcggtagttgtgacattctcaggggaacaacaaaggaagacattttcacgagttgaacacttggacaagcccatcaaaagaggatcaagcgcaagatgatctggaaaaaattaaagaattagtaattaatggtaaagttagagttacagtttagattagaagaataagcgagaataaaggccaatcgtctaagaaagtgaatgtttcgtcgaagaggccaagcattggccagcaaaaggggaaggacatcgaaacgcaattccgaaagagcaattgggtcggtagtatcaatttgaagaaaagaagtgaccgatgtgccaaattgggcacagtctttataaggcacagatgaagaataacagcggaggaaggagaggagctaaagaacggaaagaaactgaaaattaactggcaacaatattcttgagtcaatggaattcgtaccaaaactagttcgtacaataataaattcgtataaattttttaaatttaattaaaaccagtattatgtttggagaattgcattgcaaatgtttgtgaaattgacgattattatacaataaagaaaacaacaccaacgaccatgttcctgtcgcattcgtgcatttccgcctccaactgagagtccgcgtgcaaattcgttctgagcagtgtcgtcaactcagcggcacagagtgaaaggagcgcgctatccgctccatcacttcctttgaccgatttatggcatgcctatttcaatgccaaaccgtagcaaaacattgccatcgcaagcagtcggaattcgttgaaggattgctaaatatgaaataaggacagannaataaaagtgtgctacttggtaatggnagaacagagtaagaaatcagcgaaacgacaatagaaagagca

SEQ ID NO: 25226 - DNA, 1524 bp, Heterodera glycines
aaaataaacatcatattcgtactcagcaccttcttttacgccagaaaaatatttttcaccctctttttcaacccataaaaaaattttgaaaatttctagggggcctagctcgaaaatttttgaaaatttcccttcatatagtataccattagatagagcttaaaaagttctacaattttgccctaaggcattttttggctaaaaccgacccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaaatcataaaattcaaaaacccgaaaaccgttttttaggcctaactcgaaaaattttgaaaattttcgaaattttaaaatttcaaaaaatcgaactttcaaagctctacaataagttcgctggccaccccccgctcagatcaaaccctggcgcggtattcacctggtactgaagtgtactttttgagcacgcttcagttgccattttttgcaggccaggggtttgctcaaaaaaaattttaaaaaataccagcatttagaggacactttggcggagtgccctcacagcgggcactttttgattcgagttttacaaaaaaagttaggggccgtcaaacgcacgaaaaaatgagaaatcagtccctggtactcagttggcccttggaccggaaaacctatatttttcccggatgctcctcaaaaagttgtaagacccttccactactttcagggcactcccggccttcggccgggagaaaatggttttagcaacgaaactccttgtcaatataacatataggggaaaatgtccatccaaacgtcgttgtacaccaaactgaaaaaagaacgaatagcaagataaaaatattgtttatggaagaaaaacaaaaataacacagagaaatataataatatgctccccttatagttgtaaagaatattttcaaataattttttcgaaatacctaagttgtttactaactgagtctaacttagaattttgtagcgcttagcatcaaaaactcattaatttttgccattttgggattaaatcttcaataaaatttccttgaaaattttttttaatttagtcccccctgaaaaatctttttatgagttatttaagaaatcagaacaaatttagtcgctaccccaaaatcagagcatttctgagaacattcagtcaaccatcaaaaacggcagcgattcgagtggaaattgacaatttcagtttcttttttaccattctctccgcgtttggttaggatcactgtatatcccaatgcccatttgcgagttttgaagtgttcatcggcgaaatagtcaaatcggtggctgatcagtgcgatgcaaaggccaagttgaaaaggcgtaagcaaacggaacaccgacagccaacagtcgccggaaatgaagctgaaaaagggaaaa

SEQ ID NO: 25227 - DNA, 2233 bp, Heterodera glycines
gctgttatccatggggttttgctgtccaaaaatgcaaaatgacaaagtgggcgtgagaaaatggggaaattagtgtgggaaaaacgcccacacaaacgaggaatgaatttttggcacaaagtgccaatggaggatttagcgaacgaacaccaaaaaaataaaaattatatcctcaaatcggcttgcgaaattatcattaatggggagttttctcctagtgaatcaatccgcttctcacaataataataatactttcacatcaattaaatattaattgtttttattttggtcggtcataatcacgcacttgtgcgtttatttcttaacgcgttgatgaaattctcttcaaagaaagcatttagggtctatattttattgtaatatgttttggttttttaataattaaagcagtgtttggttatattttccatgccaatttgctgccgcctccccccccccccgacagctttcacattccattaacgttaattatgcatacattcgcaggacttttaaagcccaaatatggctaatgttaataagcaggggaaagaattttcggggaagaaaatgtttgtgtaggtaatatggccaaattatggggggaggacataaaagaggagagaaaacattttaagcagaaaaagaccatttttattatttaataacaaaaaacggacagacttttaatttaattttcggtccgtaattaggaaactaatttggaacgcaaatttaacaattaaaacaactgagaaaaataaaaaaacattaaaagaacgtaagtaagtaagaaaaagagtgaaattgaaaaaaaattctcacggtgttaatttccaaaaacaaaatgcctacgataggaaaattgtctgccagaaatttcccataaaattcattttcatgacacgagtctttgaagaagcaatgcacaaacaatttgttcttattatcatcaaaagcttttaaaattatattttgttaaatttaatttaaataaaaaaaaaattaaatttaacaaaaataaaatattagagaaaaaggcatttgtttttattttggaaatgggaaattgagagatcaaatgtgtgtgagcaacagcaggtgaatgggaaagcaaaggataataaagttaattaacttttcccagcaaataaataccctattaagtattaaaattatgtttttgcctttttctcaaattaatttccgattaattaaaatatttcttgcgcttattttggccaatgcccgcggcaaagcagcaaagaatccatttttcgcgtccgtccaatttgcttttgtccgcgtgagtgctattttcagcgttattttgttgcagcgcttaaaaattgatgagttttactgaagctgaaaaattcacattcaaaaaacagcgccataaattacttttttttttgctgttggaagaagaagagatgagaaagttgcaacaaattggaaaatgaaaatttgaaaaaaatgaaatggaaatttggtaaaaccgggtccgggttttgccgggcacagagaagccgggttccgggcccaattgattattggcgctatcaactcgatatttccacaacgcctgtaaaaatttgcttaactacattataaatcagagattatttgtgtttatcaactcgtcacttccgaaacactgatacagtttattttgagggggtaatgagctgaaattttaaaaattatataaatttatgtgaatatttcggcatgggataattgttcaaaagcatcctttaaaaatcgctatgcgagcgaattggacaaagaaggaaatgaaaaacaaaaagaatataactattttggcgatagaagtataacgtaaattaatacgtaaattcaatttttaaagcatatcagtagagataaatagtggcatttaaagtaaatattttattatttttttttaaatttttctaacctccaactttggtcagcaatttgacccagatccccatttttaccgggattttttgcggaccaaccggctcggcaccgggtttggattttcaaaaattcgggcccgggtaagtgaggatgttttaaaaatgaatcccctatttttatcttttaatttattcaataaatccaaaagaggccctcccgaaattctccacccaaattttttcaagtgaccaattaattacagcaataaaagccaatcatggggaggtaaataaaatttttcttggcttatgcatttgtttat

SEQ ID NO: 25228 - DNA, 1714 bp, Heterodera glycines
  misc_feature (1623)..(1623): n is a, c, g, or t
  misc_feature (1680)..(1680): n is a, c, g, or t
atccattttaaaattaaaaaattaatatttttatttctctttaaaccttaattactttctttactttttacatttttacatatttttgaggatataaaaattgtatttatttttattttttaatcttctaatttctttcttttcctaactgatttggcgatttttaattacttttttaataaacaaatgcctatttatgttataaattgtattaattttgttgaatttttttattaattatttaatattaactgaaatttattatttttgattttataatttcaaaatattcattttaaaattaaaaatttcgacttttcattccattagaaacatttatttctttctttactttttacttttttgtattcaaggattaaaaattgtattttgtttttatttttaatcttcacatgtctttcgttcccttctttttctcgaagtgattctgagactttttgtgttaatttatgattttcattttttgcctttatttttttaattaatttttttctttttgcttaaaggttatgccttttctttaactctcttttttattttcgcttttataattatttttcagctttttatttttatataaaattgcataaataattatataaatgtatcttttattaaattctattatctattttaattaattatttatattaagttctactgaaacaatttctttaatttatttataattttatatattttcataaaatgttaatgtaattaagtgtcgaattttgttaattaatattaaagcaaataatactattatttttcattaagaatttgattaaaataatcgtttttcatgattatgattattattttcttattaaaattatttattatatgtatttttttgtgctgacttaaaattcattaatttgcaatttaattcagtttatctagcgataatttaaacttaaagattatttgtttatttttgtttctttctcactttattttaatattgtacaatatttcactgattaaaaatcatttttgtaaatatatttatttatttatattggtcgatttcttgctttttatttatttaaattcatgctatcgccgtgtttatctcggccgtatttatctgtctaatatattaattaatattaccaattgtataaatcattattttcattttttagtttattagcattcaattataatattatgtttattctttatattcattttttgattattatcatttgcttgcttttcctcatttgtacatttttatgttgttttcataaattcttaattattaatttatttgttttcggttttttaatttgtattttctgaattttgcaaaaagctattaaatttattaatgagtattaattaaatgctaattaaattaaattgctatttcattaagaatttacaataaaataatcgcaattttctgcgcttgattatattttattatttcctaaaatcattcacatgattataataatatttttctattaattttatctcttatttattttaattaaactcttgtctccctgcctcatcatgagtgaagtctttctccattttaatatgtattattttttatttgtaattatatataaatatcgtttttanaatttataattctttataattttttattttgtatcaaattttaatttattttaatanaaatcatgacacttaaatttagaggataaaacat

SEQ ID NO: 25229 - DNA, 2025 bp, Heterodera glycines
acaattaaaactttcattcttaaaagaatagccatctctctgaaggtaataaagaaacaaatgcccttcttccacggcatgttcttttcctcaccggccaactgcaagtattggtccttgaactcgtcctccacctaaagcacagttttttgcccacaaaatgcatttgcgcactttcgctcgcttttgcagctctctgctcagcttaaatgcggacagaattgggtccgaactcgtcagcgaaatccatgccggacttgccaaagccctgcaaaagtcggaagaagcattgccggggactgttttggtactgcacctgtacttgttgattcgcttcaacgaccggtgcagtccgtcgttgatccgttccgagtcgcacatttcacaagcgctaaaacaaatcggggcaatagtaagaaaggagcagcgaatgacagtctaacaccactaatgcttgtgcggcttctcaatgtttgcatcctttcggagaagcatttgcagaatttcgaattggatcaaatgggcagccataataacgggcgaaatgtcactgaaaaagaaacatatacagagagagagacagacaaagagagcgaagagagggagagagagataagtgggccaagcagtacccgcaacacaacccaacccgggcgaacccaatccgagcagaccaacctcgagtactccgaagtggccgtctccgtcggatccaaatatttggcccacccttcgccgagcatatcccctgaacgaagcttagctgtacatatgtttgtgttgggatttgcctttgtcttacttgtgatggacgggtggttgacgagtacctttttgattcgttgggttttcctttggttttgcccttttgttcccccactcacttcgaccaattcatagacaccctcgcgaatggcacactttggtgggggaaaggtaaagcattgaatggccattgctttcatttggagtgccatccatgtcactttttgaatggcaaaccaaaatttggcacccaccaaaagggcgtttccgatgcgaacgtcgggctgtagagataataattaattgtgcaattattatggaacttttgcggggaaaagtgccgtactcacctgtcgcagcaaaagttgcacaatttctgagattgtttaattaatgttcttctgcttagtgccattttttgccttcccattaagcaaaagattacccaaattttcgttgtccaccgctatttcgatcgccgtccgtcccattgtgtccaccgcattgatattcagcggcgcttttctcttgagatttattttttggcacttttttgggggggggggggtatttcctccatcgaattcgacttctcctttcccacattcctttggcattttttgttttgtttgcttctgtcccaaattcccattgccgccctttgtccccaatttatttttttgctaggctatcctttccaaaatccttttactcaatttccaatctctccgatcggttgctgtcccttggccatgcccaccaattgcttggccaaacacgcttccagcaccggccgattgcctttttcggctgcatcgaggaattgacgctccaacgggttcagcatgtcgtgggttcgaatgtgaacggccggcatcgaattggccaaagtgtgatttatgcaaaaggaggggggatttagtgccaatttggtaattagccagccattcaaattaaacaaaactccactgaccgtgaccgtgccttgcgcgagcggtgccctccgccgcctttggcccctccgccgccgggcgacgaagtcgccgattttgtgaccgcatttttcatgctggaaattagcagaggtggcctttagttttacgctttgacaaaatggtcagtttggaaaagagaaagttttgggaaagtgagcgtttttgggagggcgaaattggcggagaatcaatcggaactcaattaggtgaagaaaagcgcagtcaaagattgaattcggagacggaggcggggcaattggccggg

SEQ ID NO: 25230 - DNA, 1563 bp, Heterodera glycines
tttttcctttcatcccccaattccaatctcctttttactctcctaccttcgtcacccccccccccaagccgacatcctgggaccgtccctgcttccaggctcttttaaaaagataatttgacgctatatttaaaagtgttaatttttgaaatttattataactaaatggggaaccctatttgtttgaaaaattattatgtcataataactaaaaattattcccgagggatttcggaatcctgcacctgacatctattttgaccatttctaagccctaacccgaaccgagcataataaaattcaaatttttcgattaatgatatttttccagatttagaaggaagtcggaaaccaaaagggttccacccacctttggtttttaattaatttcaaaattaacactttgaaagtagtgccataattttcataataaatattcttatacatgttccgccagttttgttggagcatccaccaggccgtacaacatcgtccaccctgaacatgtatcgcccgcggaccatgtgcggcacgccggagcgttgtgccaaaatttttggtgaatttttgtacagttgggttgggtccacgtcaacaaatccggtatgattgccaccattgaaaagtgcctgatttttttttttttattaaaattttattaaaaaataatgcagtttttaaactacaaatggtaatgatttggctttcaaattagttgtatcatttatagttctttgtgtgcacttataaatcataaaatctctaagttttaatgttttgcaaatgagaaatttgtgccaaaaataagttcaaatccgaaaaatttcgtagatttttttactcaattttcttcaaaataaaaattttagctttaatttatattttctcataaaatgatttttcatgccatcattagccattttcgagaatttaacgaatttggagaaaattacgctcacttttggaaaattttatgcccatatttttcgctttttacgtatatattttgcatatttgtacaatttcgcgaaataggatatttatgccagaaagtccaaaaatgtaaattattcggtttttaactcaattttttcaaaattaataaaaattcgcttaatatttttcatattattttcttagctattttcgaggtttaggtttaaattttttggaatttaatttaatttaaaaaaaattattgcatttgctgctaaaatttttcgattttatgtgcatttaattacatgtcctaatggtcactctctgacatttcttacccggcatcgtccgctgcgcgagttggcacgaaaatcagcagcatcaaagcccagcttatcatagttgatgatcacgtagctcaaccttcccggctgatcagtcaaccaaatggcctggtaagtggctaattgtcctccgtccaaatccgatcgacccgacacggctgagcccgtgttgtaccatgtgaccacctataggcatcataataaaatcaataatttactaggcagtaacacaaaaaatcgatattttgaataaaaatggaaaaactcaaaaagtttggtt

SEQ ID NO: 25231 - DNA, 998 bp, Heterodera glycines
ctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtaaaataaaatggcgattgtgcacagccctccgtctcatactcaagcgcttttgtgatgtgtaaaatttctcaaaaaagagatagacatttttctgggatagagtat

SEQ ID NO: 25232 - DNA, 1096 bp, Heterodera glycines
gggttaagatttatgttatgaaaaaatagtgtgccctattctattcattttcacactttaacctgttaaaaaacggatttaagcgctttgccgcatattttttgattttacaaatctttttttaacacctaagaaaacctagaatttttggctctgggccatcaaatacaatttccgaattgggggccacagattcaaatttcgtcaaatcgtgaacactgcaaatccaaacggatccattcgatgatttttagcctaaattgttgcttttatgcctcacaaattgctgaagcgctatttttggatatttagcgaactctttattgacttttttaaagttctcgacgagctaagtctaaaaatcaaggaataagtcgaaccggcgccatttaataagcactgggacaactgagtcccagtaaaaatggaaacttcagtaccaaagaaataaaatatgaacaaaaataatttggtcaggtcaatcattttatggtacattttggtgtttttgtttcagtttatatggctaacttttcaaatcaaattgtttgaaacgacaaaactccgcgttgtgcttttgcaattcagcgaattttccctatataaatgggtaaaatgtgaaaaaatttcattgttatcaaattattatttcgttgctctgatcaaagttcaactgtcttctactgctgtacaacaaaatgccccgtcatcgtgcaaagcctcgttcttttcatgccggattgaaattccccgtcggtcgtgtccatcgcaagatgaagaagggtatgttggaatacaggacaacaccatattctgattttgtttcattcacaatcgaatcatacattccctttcctgttcacatccacaggtccgtatgccaaacgtctcgcgaacggagtgccggtctacatgactgctgtgctggaacacatcacgggcgagctgctcaagaaaattggcgagatcacgcaggccgaaggcatgaagcgtctcagtgcatttcacatccgaactgcagcgcgcgatgacgacgaggttgaggaaggtcagtgattgagtgggcagaaggtttttgcgcacaaggacagacagc

SEQ ID NO: 25233 - DNA, 1170 bp, Heterodera glycines
tcccaacagttgtctgctgctattatcaattgttgggacattatcacatgaccctccaaaataaccaccaaattaccacttcctccgacgcgaaaaacccttccgcagtgacatccaacatgttgacctcgtcgttatctttgtacccagcttggtcaaacaacaagtcatcaagggtggccacgtcggcccctttgatgtatacactctccagcacgaatgaaattgccgtttctttgttggagatgtcaccgaatttgtaaaaggttggcgggttcgacttgttgaaggtgtaagtgttctcgcaatgcttgaacattgacggctcgtagtcatccggcgtgtctaaaaaggtgcaatcattcatgcaattaataaaacggcatactctcgtaataagtgagtttcaaataaggcacggccccttttttcaacggctccagattcttagtgaccacactgagcttcttgatgatgtgcttcacttgcattcgaaaaaccttctcccctttgtagccaaatgaaacgatacgattgcctttgtcactgaaagaaaagggagtgatgtgcaaataatggaagatttctttgcgatttactccaagacagtcatcgtgtgctgttcgttgtaacaaaaaccgactgagaaaacttcagttgcgacctgaaggaatgcaagggaataagcaatcgaaatatacaacgatacgtccgggtcctctttgtcctcgttgatcatcacgaatgcttgtttgatgtacttttggtcgatggcctctctgatacctttcatcatctccgacaatttacgtccccaacgcgtgttgccatcgaaacagtaaatagccaaatctaaaaagatgtaaaaaataatgtaaaaattagaaataacatattctgagtgattcaaattactaaactattcgggcatgtaatctagctcctaaaatttaagggtgcgagtgtttacgaaatagcggaagttgatcaacgctaaaaaactgaatatagctgaatgaaggagcttatggcgctctcatttttcaaaattaatgttttttttcgatgggagttcaaacacaattttaacaattaaaatcgtaaaaatgtcatttttggacaaaatccgttaacaaattgcagtaaaattttaaaaaattttcccggcgg

SEQ ID NO: 25234 - DNA, 1628 bp, Heterodera glycines
ttttcggggcagtccccccgaaccgatgcgcccagacttttggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaat

SEQ ID NO: 25235 - DNA, 1434 bp, Heterodera glycines
aagggtcagttcaacatggacgactacgacttttgcattgcccacacggacatggccaagcacattctgccacttcgcggtgttatcaaaacgcgatttccgactaaaatcaacggtactgacaaagaaaaacaaacaaccatccgatttaaatgctttgtttcctcacaaattcaggaggaattggcgatgatctcaacgaaattttggaaagctttttgtccggaataaatttgaccgtaagaagggacccgaccaacaaggaatggggcctaagtgagcctttgatcggaagagtgagttggcattttggggaatgtcccctcaaattgattgctttcatcagttgagcatgtccgatgagcaaattgaggagaacgtggcggtcattgttgacactctgtgcaaaatgcgcaaggccgtgcttggcccgttcatcaaccgcgcctctctgatcacagcctctgccggccctcaacagtcgtttttccctgtcgacgtgagcccttgggaagcgttgccgacggaagaggaaattgagaaggtgtgccgtcgatgttgggcaaatgcatggaaaataattaatcctttttttgatgtacagcatgagaagacgaaaaagaaaaaggaccagaaaaagatgaagaagaagaaagagacggacgaattggaggaagaggaggacgaagaagaggaggcggaagaggacggacgaatattcccaaatttggacacaattgatcagaaaatactgatgaagcttatgtgatcgatcatcaatcaatcgttgaatcctactaagaatgctttgaaattatgattgattttattttgatggaaaatacaacttaaaaatttaaatgaatgaatcaccaaaaaaaaaaaaaaaaatttttccccttcacctttttaatcagtcagtcacaccattagttaatcgttaatcattggttgaacagaaaagcttttctccccttgtacattttttaattcattcccaattgggtgcgtttattttttgctttttcttgtggggttaaaaatttatttttttaatttaaattttgtttgctacatagtttttttttattaaaaaaaccaataaataaatcttttttgtgcataaacaaaacttaatccactcactaatcgctaaaagagaataataatacctaatttagtaaatccaaatggctttgtccccgtctccgaacaattcccattttgaatggtcgtacacggaggagccgcacgccacaaggtggttcaatggatgaatgagtgtttcgagaaatcgaaaacatttcccttttggactttgcgattgatttatgatttggggaaatggaatttatgattaaagggaaattgaggcgctacttgcaaagagggcctaaagaattctatcaaaaacaaaaggggggggggaccctt

SEQ ID NO: 25236 - DNA, 1292 bp, Heterodera glycines
tatacgatactcattgaattgtattattagtttactaaagttcaaaaattttatttattttttctaaaaagttcaaaccaaaaactgtaaaaattgtcatagcttttgaaaaacttaataaaattttttgaaatttagcatgctaataacgcgtttcaagggctatgttatgataccaagattgtgcaatttggttgagtctgagaaaagttatgagttgatttactcaaaaatttagctaattttgcacttttcgtcggttgacatagcaccaaatttaccatatttttcgaaaatttgaccctcatgctcagaattctgcaatactgtaaagctttaatatgttccaaaagtcccatcaataaataaaaataatttaatcattgatttttttttagacaattcaacccagaaatttggtccgcaaatgtcggggctaacatcccctccacccgccccactgtatcgttcttgaaattttttgcttttctagctttcttagatgttttttcttgaaaaaaatctctatcttttttttcacgagatgcgacgagttttgtttaaaagttgattttattaatcatgactcatcattatgtgccattaattcacataataaatttgaaaccatagtatattctcccgaagtgattaaatgtgattaataatgtaaatttaaatttgaacatttttttaacttttctaactttcttagagattatttccttaaaaaaactgaaaattttttttgaagaattctccaaataaatttaaaaatgtgaattttatttatcaaaattattaatcatttttcaagctaacttattaattacagcagcagatgaacaaacggaccaaaatgaagacaaaaattgcactgatcatttttggcactaccatttgctggctttcggtcagggtcgttttcgtaccgccgttttcgtacgggggacattttcgtacgagttcttgtacaagcgtcaaattcaaatataaaaacttaagaactaataaaaccaaaatttatcattttttgtttcccattcataaaattttgtagaaaattcataactttataataataacaaaatccaggacaaactaggtcgcatctcataatttcggaaaatttttgatttgtaacaccaataaagagcaatgaccatttttgtgcttaaaaatcgttaataaaaaattttatttacctattttggtacctattttggaatttttgtacctatttaatacctattttgagatttttttttacctatttaagtacctattctggg

SEQ ID NO: 25237 - DNA, 1328 bp, Heterodera glycines
aaaaatttttacatttcaaaaaaagaagccaaactataggttttcggggtcgctgatcgcgaatgcggcttccatttcgaccaattccaaatcccggacgcgaatttgaacaaaaaggcatttttcaaggaatgaacggctcgtcgaggttctgagccgtgcccggacctggtcacaatatggaatttgcgccaccgaagttcgtggagccaaaaaagccattaaataagaagactgcagggcggtaagttaaaaagaaatttaatttaaaatcatttgtccattatcgaattctcatccgattataatagtcttggataatagattaagctgaatttctcagattttggcacttgccctcgcggatggcacttctttgatcgactgtcttcggctttatttgcgtctcaaagacgacgtcttcggcccggaggcaaaagcaagccgttttggcggatacaagccggaatgccttgagaagtttttgcaagatcactttggcaagcagcgaaaaatgtccgacattcgatgtggaaaaatgaagtgagttttgaaagaaactgacaaaaaataattggttttaaatatattataaattcatttatatttttatcatttcgtttttattattgctatataattaatattttaatgattgtccaattattgtttttttgcaggattttcgtcactgccacaaaagcggagcaaattcccatcgaattggtgctgttgcgcaacttcaactgcccctttaacggctctgaccatcacgcgcctggcaatgtgtgcatttggcgggcggcgcgctattcgagtgctgcgcccacttactttcccagcatggacggactgatggacggaggtacgaaagcaattatcgttattataaaccattataagctaaaatggtgcttttgctcgagagtcttggcctttttggtctcttttaagcttcaattcttgtgaaactcaacaacattcacttgttaatcaattggaaaactgagctaattaaaattaatttttattacaatttaattaattatttgcgtacattgtattaatgataattaaattttgttccttcttttttgaggtttaatcgctaacaatccgagcaatgagttgttgaaggaagtttatttgtgcaatgagtcagccaaacttagcattgtatggccttgctttactctcttgttttgttaattaattttttgatcattaggaaagtgatcgtcctccaaatgactcaattgcctttcttttgtcccttggcactggcagaacgccaccagtggacgtgggaagcattgacgtggtgttgg

SEQ ID NO: 25238 - DNA, 2002 bp, Heterodera glycines
  misc_feature (1870)..(1870): n is a, c, g, or t
  misc_feature (1923)..(1923): n is a, c, g, or t
  misc_feature (1966)..(1966): n is a, c, g, or t
aaaaaatccaaaaaatccgccccttaaaaattcaacttttcttgccttttttagagggctttttccaaattttttttttttttttttcgttttccgaaattcggattctccattaattcgttactggatatcgaagtttcttgctggcacttactcaactgatggaaaaattatttttaaaaacattttatcaaaaaaggtttaattttccccccaaacacctccgtatgttttttatttgcaattgtgcgggcgaaaatgaaaagaatgagttttttggaatttttatgcaaaaataccattggtttttccaactttgagcacatattttcgcacatattttggcatttttttggcttatagcacatatttcagcattttttagcacatattttattacatatttcaggatttttagcacataaaaatcccagccctaataatgacgggttggttggtgaaggagtggaaagaaatggagaagcgattatcttatataattaatttatgcgtaaatctgaaccttaaaatgcgattattaagggattggcagcggttgatttgtatttcgttggatggatgttggaggagcaacaaaacgacaacaattagagttaattaattaagattaataaaactgaaactgttcgagggcaacgcaaaatggcaaagggaaaagcagcagaaacaatgacggaaacatagaaaacgtttatggagtattttgattaagtgaaaatgctgtatattcccaattaaaataaaactgcaattagcagaaaatttaaaaataattaatcgcggacatatttttaagagaatattagccaaatgatttgttgagtataaacaaactgaaaatatgtacaattccaattgcggaccccaaaaacacacagtttcactattaatgaattttaaataattatcaattcttcaaataaaagaattattatttttttcgtaacattaaagttatttatgcatttaaaattgaagacagatttgtaaatggattaaataaatgtaaaattttatattttcttttattcgatataaagtgtttttaggcaatttttaaatttatttcctgtaccataatatttttaattttggtaattaaggaacatcgattttttaaatcactcacctttttattaattactttggccaaaaaatttgatggaaaggcacaatctcggcggataaaaaaatgatttaattaattacaaaattgctttatttaatgacattaaaatccgattgaattctctctctccttctctgctcccccctctctctccttctctgctctccctctctctatcgctctctctctctctccttctcagcttcctctctctccttctctgctcccccctctctctctctctgcatgtctctttttgttgtatctgtcgtctctgttttttttgatcactctctttttcggcgccatttataatttcactgttgattctaaatgttaatgcattgtttgttgatacctaaattttgattattgtatgtaccaacaaagtgccgacaaaggcatcggggaagcaaaaaaaatggtcagacgggaaaaacatatcagccattgccattgtttcaagcagttcagaagcaacagtctgcaaaaacgcacagtttggaatattaaatttgtatttaattcagggctcccaagttttttcttcaaaaaaaggacaaacgatgctaaaactaagattttgactacaaaaataagattttttgaaaaaaaacaaatgattaaaaatcgccgcttttttgagtttttgaaaataagcacaaaacaaagaggtgttgccaaaaaaaaaggaaaaatcttagaaaaaaggacacttgngagccctgatttaattacatttaaattaaactaattgattgatttttcaccanagtgtccaacaaaagattcatcaataagccgaatctgatgccnaatctcgcagccattttgccattgtttgtgcggcgg

SEQ ID NO: 25239 - DNA, 1176 bp, Heterodera glycines
acacttaccgtagctcggcttgtcgaaccagcaaaatgatgatggtaacagcgatatataggcatttcaatcaacggaaagcttgggaaaattgaaattaaatgggaaacccgagacgaattaatgcggtggtggtgttggcgaaacgcccacataaaacacaattttttaaaacaattagccaagagaatgggcccaaaaaacggaacggcacgccgacggggcacggcactatgttgttaattatgttgaattggtgcagctgctgttgctgttaccataccaacacaaagtaaaagccgccccgaagcaatgtgccaaatttcagccggtcgcagccagttgaacgccgccgtttgggcgccgtataaatttgaaaagagaaagctgagttgggcggttaaaatgccgacaaatttgctggactgggtacgacccattgaagaaacaaagagttgttagtgagctttggtttttaaccttgtttgaatcaacttttgaacaataattatcgagaattagggcgaaagggctgcaatttaaggcgcccgagaaattttttcaaatttatctccactttttctccactaattattacactaacatttctgaactctttcaccaatgtactaaatatttacctgataatttacattgtttttgttattaaagggaaataagtgggactgtttaattttggccagtaattttaaaacaaaatcctagaagaaaagctgaattcaagaaaggccataacgcggttcgaatccaaaatttttatacttgcataatatgtgcttcattcatcccttgatgaaataattcatatttcgcaatataaaattctaaaaataaattattatcatttgacaaactgcagaaagttttagtgaaacgaagttgggcttttaatttcaattgtgaactgttccatttgaatgttacgtaaagattatttttattatgttctccactttttctccactaattattacactaacatttctgaactctttcaccaatgtactaaatatttacctgataatttacattgtttttgttattaaagggaaataagtgggactgtttaattttggccagtaattttaaaacaaaatcctagaagaaaagctgaattcaagaaaggccataacgcggttcgaatccaaaattttt

SEQ ID NO: 25240 - DNA, 570 bp, Heterodera glycines
aaatgaactacgaaaaattaattataattttctttaaaaattcataaataaaataaattacaaaaaaatattaattttatgaaatagtaagttatactcttggatatatgaaataatggtatgattaaagccctagatgccaatttttttcaattttagaggggaaattattaatagaatttagaaaaatggccaaattggaagaatcatttttttttgccacaaaaaatatttaattgtattcaaacaaaaacgcattcgaattgatttattgaattttctaaaatgtgtaaatgaaataaaggacggacattttgcggacaaattcaataaaaaaaattcttaaaaaattataaaaattttttttgaaaaaatggaatcaaagatttgatgtaaaaatatctggagaaaatcctattcggcaaattcaaaaaaaaacgaaaatatcataggtttttttctaaaaataaaaagaagccctctcactcgactcacagagtccgtccttaaattgcatttaatagataccatagaaaattcaataaatcaattcgaatgcgtcattgtttg

SEQ ID NO: 25241 - DNA, 2381 bp, Heterodera glycines
  misc_feature (168)..(168): n is a, c, g, or t
tatatatattcaattaatcattaagcttctaaaaaacataaaaatacctttaattttttaattgaaaaactcatgtaataatagaatataatatttataaaaaaggttcttgaatttaatttttgcctaagtttataataaataaatagttttttttttcttatattntagaatttagatatgatggagacttattcataattattacacacatatcgttacccaatttaggctttggtggttttagatttttcaaattaacgaaattttattattcttttcttattcatggactgtcaaaagaaagataacacttttgttttaatttaaataaaaatattaattatttagatataaaattatgttattcttaaatatgattaaaaggtaggtttttaaatgaagtgactataataattttgtatttatttctcgccaatactttaaaaggattatttttaattagggaatatttaagtttaaatatgtggaagatttttgtctttccaggttactgaattgaaacattaacctttctaataaagcataacaaaattaaaatgttgacgaattatattatatactataaaatctattttaataggtgtcaaatttttatttattttcctttaatagccccaaattaaaaatttaatcatatgtgattggtacaaaacaaataaaaaactgtattagtaatattgttatattgaagttatttctaaaaccgttatcatttattaattccttatattttaatatatccgttaatgtaattttatattgatcttattatttcagaatatttatttaaaagatatttagttgacaattttatgtgattaactctaaaataaaattaaaacatttaaatttattacaaaaaaggaataattctgaatttttatattaaaaattggaaaactgcaatgttcgtttatctaatgacatttcaattgctttacaattcgcgacaacttttctaatgaatatttaattaaaaagtttagacaaaaagagatgtgtccatcggtcgggtttagctttatttaaatttaaataattttttctgatttattattgtaacgagcaatgattttttgttgttttattttcccattaaatttaattatcgattgagttctcacgttaataaaaatgcaaaataataatttataaaatttgttcttcataacaaaagttaaaatagaagattaatttatttaatattatttttaagttctcctttattcgtacacaatcctaaaataagagattttaaattcaatttactacattaataattacatcaaaaataaataatttgttaagtgcatcatatacccctaataattgaaaatttttttcacaaaaactgtcccaaaagttatttatttatctttgagaaaaatttttgtgtccttattcgaaaaatcttcaaaaaatttggaaaaattgaaattttcttggagtaattcatttaatttattgctgaaattattaattatttttttaattcattaatatttttcttaacataaattctccattaaaacaattgttttcgacctattgttcgaatttgggttcggggatcggaatatgcccaaataattgtcatatttatgatcagcgaccttgaaaacccccgggaacttggttttaggactttttaaacagaaaaaaatagactaaaaaagaatttgcaaaagacccctctttgcaactacatagtgccaaatatttaataattgataaatttggtccagcttataaatctatttattacaattaatggacgaaaatcagcgcatttattaattatctctcaaacaattaattaatgttgcatttttatttttttctcaccttttgtatctaaggggtagttttcaaaattgagtctaaacctcaaaattataatattataaattgcaaaatgcttagaattggtcaaaaatagcacaaacaattaagttaatttattgactaagtattctacctaacgaattgttttatttatatctgatactaaagcaaatcaaaaaataaaaatgtcacaaaggtgacgatataaaaacaaaaatttctttttgtgagtattccacagcatctggataaatctttggctggccttgtgagccgaaagtgagtcttaaataagaaaagctcaatatcatattattttactcatattatacatgtcaatataatcgcggtaattaaataaatcttttatcataaattataattaaatacccttttaaaaatattgcataaaattgaaatcattgtatggaaattggtgataatttaaaaaaaaaaattcaagaaaatcaacacattgaacttatatttgaaggaggcctgttcataatttt

SEQ ID NO: 25242 - DNA, 1723 bp, Heterodera glycines
ggtttcattgccagtgtgagtccgccccaagaaaatcaataatagactgggtttggaaattatactcgtggggcggatgaggatcatctatattctaccccgtactttcggaatttagtagcttctgttgtttttacaatatttcaatgaaacgccatactgatggttgagagcagttaaaatacccttcgcagttgcggttgtgcagcctctgcaaaatcgttggtgggattttctcagttgattgtcatagagtagacactccataatcggggggaaaacattggtacggtaagagttccgtcagcacgcagatcacgtccagtgttagtttgtggtgatcatgcaaatgtgttgatttctatttataacgaatatacccaaatgagaattggtcgaagctatggttactgatgcatttccagtgcgagtagagcgcgtgtaagtctccgaaaactttttttgatgcttatttattcggaatccgagcccaactggagtgggaatattgtcaagatggtatagtcagtaagagaatgtatggtcggggtttttggggttggaagtgtaggggtcggggtcgtcggggttggaagtgtcggggtcggggtcggggttgaccaaatggttcggggtcggggtcggggtttttcaatttttaccttatgccaaatagtcaaaaaactttataaatttttgcttaaaaatatttaaatttcgtaataataattttatgtgctttttattattttttttatcataaatattttgtatagaattaattaaaaacacatacctaaggcatttaaaatggccaattttcagcgaaaatctgtataaatctttttttggtcttttttttgcggcgctctttttctaaagacgtttaggagaaatgggttcggcggtgccgataggcgccgccgtgaaaaattttgaaaatttggatgggcctgttaacagattttgtccaaaaaatgatagattttttcgattttgggccaaattttttttaaaaaaaataggttttttttgtggcgccggcgatgccgataggcagcgccgggtgaattttgagatttaaggtctattttgtaacatattttcaccaaaaatttatgaatttctggtaaatttttattttttttctttttttttgtaaattttcatgatttagtcaaaaaattgaatttttattcaaagaaaataaaattgttgttcaatacgtctataaattacgggacaggacggtgtcaatggttttcttttggatttgtaatccaattatttgcccatatttgtgcctattttagattacatcgatctcattgttagtcaatctgtaataaaaaaaccatgccaaaaaataattagaaaaattaaatttttaaaaatttaaaaatatttttttcaaacaataatttttaaaatccattgatgctgttgctatattgctaaggttgttactgctgttgataagtagtttaattgactccgtttcactaaaatcagtaattatttcttcttggtaacaaaaatcgctacaaaaatttaaaaaaatgaaaatttacatagttttaaagttaaaattttttaatatactgtaatccatcataatttatcttttttaattaataacaaattatttaaatttacattttagagaaaatcagtataaaatttaaaattaattaccagatgtaataaaatcaaaatttttttt

SEQ ID NO: 25243 - DNA, 1946 bp, Heterodera glycines
  misc_feature (14)..(14): n is a, c, g, or t
tttcagcggatgcnttaacctgcgcggcgatgtgttctgctcgcaccccattctgatttatgtgatgggaattgtggccacatgtaaaataatattgcaaaacaatttcttctttcttttattcgctattttattttatagccatttggatggccgaaagcactgctgatctggtaataaattaattaattagccaaatgattaatcaatcaactaatttcctgtgattgaattttttggcaaaaatggcgaaaaattttgtaaaatacaccgcataattcgggatttcaaaaaaccaaaaatacacccctaaaaagcgaaagaaaaaagaaaaatacactcctaaaaattgaattttggacttcagccccccccccaaagccaagggtctggctacgcccttgttctttggccatttttaacagattcttttcaaaaccaaggtgttggcattcaatcgctgtctcgagctcacctcgccacatttctcgcgcgttttttttgaagggtaccgtacctccctttggatcgtcggctgctccctctacgccctctattgggccatgttcatcaaaccggtgctgtacagtagcatttatttcggctggttcttctacccttttgtcggctacagtaacgatgaccatcatcaggtggaggatttagcattcgctgatcaaaaaaatgcgttttcaattttaaaatgtaccgtaaaaatattttctttgctgcagtatgaacattggctgcatgtcgttcataatatcgccgtcgcatttctgagtccggccatttaccttttctttgccagcaaattgtttttcaacgtccaaagcaatcggcgacagtttggcgttgtcgcctccgaattaaactcaatgcaaaaaagggtttggaaatttggaaattttaaagcaagcttatgtaaacaatttgcttaacaaaattggctaggacacagtttttttttcggttttcatgcaaatttttgtgcttattttgctatttggtgttttaaatgcttaataacggatttttcatgtggaaaaatccgatcccaagtaattagcaaatgggaataattgaatcattataattctctatttcaaaccgtataatcgttagtgctgtccgagaccaaaaatttcccgagactcgagaccgagactcgaccccgagactcgaccccgaaactcgagaccgagacccaaaaccccgaggccgagaccaaaaaaaccccgagacccgttttttcaaaaaatttcttattcgctttaaaatcgttaaaaaaattttttgtgtatttcctaggccaatttttgtttttttaaatattgattcaattaggtaccataatcaacccaaaaacataattttttcgcggtttttgagtcaatttaaaatttagtcaaaaaatgtccaaatttttgcggttttgagccaactttttataaaagtaaggttttgtgtgccggcggtgtcgataggcgccgccgggaaattttttttttgtaatttcgttctgatttgttaacagattttcaccaaaaaggccaatttgtttaattaaatccaatgccataaaatttcaaaattatgagtttttttttaagaaatcggaataatttcgtcgctaccccaaaatcagaacattcttataaataagaacaaatggaagccctggtttaaaggcgccagcttggactcactcttactggcgctaacgaaatcagatgattaaagtgaaaaaagggaagatttacgagtattgaaaaagaaaaaaaaaatttattttttgtgttaaaataaaatttaatcattccccgatcggggtccccgacccccgacaattgagctcctccccgccccgacccccgacatgtcgccccccgaggtcactggcccccgactttttgcccccgagggctcggggcttaaccctaaat

SEQ ID NO: 25244 - DNA, 1916 bp, Heterodera glycines
  misc_feature (1719)..(1719): n is a, c, g, or t
  misc_feature (1787)..(1787): n is a, c, g, or t
  misc_feature (1802)..(1802): n is a, c, g, or t
  misc_feature (1806)..(1807): n is a, c, g, or t
  misc_feature (1889)..(1889): n is a, c, g, or t
aaaatcgcaaaatttggaagtttttgcttaaaatttgttaacaaattgcactcaaattttttaaatttttcccatgtcagcccaaagcattagaaattttttttctgattttcgaccctaaaatctgtttttttattttaagtttctgcatattataatttttctgtatttaataaaaggattgtccttcaaatttgtgcattaaaattatttttgtgagtatttaattgaattatcgaattactcccgctcccgcccgagactcccgcgaaaaatggacgggatttcaacgggatcgggatttttacgggattcccgttccggaaaattttgaactcccgctcccggaaattttttttttaccggactacttttcgcgaaatgacctagcaccttcagaaaatagttggcattctgtcctttcaaagttcaaaaaacccaatgcggatgccggtgcgctattgggattcaaagtttttgcgggaagggatgccgctgtatttatcccgtaaatccctcattttgcaaaattacggactgggatcacgcaaatcagtgcgggattccatcccgcgcgcttcttgttttgatgaactgcagttgctgttcttcgttctgcgtccctttttcgcctttgtactccctccaccgtttcacctcattttccaccgccattaatgggcgcataggcggcgccgctcggattcgacgcagacggccaacgcggagagttggtgatagcgagccgaggaggaggacatttttgagcgtttagcgattttttaaaaatcaaaaaattgctacataaagcattttcatgattaaattacggttgatagttggagtttgaaattgggagaatagtaaaacgttcattatcattaagctaacaataagataaatcggacaattgaaattttgcttattgatagcatggttataactgttcagataacaaaaatgacatgagaaaaactcaaaagttgtgatttcgtcaaattagctgatcatttttatgctgaaagatggattaaacgaactgactgtaattgaattacttctattaaagagacggtaattgcaccattactgctttgaagaatacattcgcatttaattagtcgaaaaaatttttctattatttaaacgcatccgaagaaatctaaaatttttttcttaagtattaaacgcacgaagaagtcgaaaatttttctaaaatatttcatcgcatcagaagaagtcgaacccgattgagtgcattcgaacctacagcattttaattaaagtgcattagcaccatagtctgactctgtactaatccctacccatttctgttttctaaacctaatgatcggcaatcagggttgtatgtgatcgagggaattcttatcgtacttcgttctctaggatttttgaaggaaaatgacacttttcggctgaaaatcgatcacatacaaccccaactacggtagaatttagtaaatgccgaaacgatccaaagcaggaaaagcgcagaaaaggcgttggaggaaatggagcaattttaaaaagggtattgaagaagcccgcagaacaggtgaaacgacacccgcattggtcgctgcgcacgaagcggcacattcaatagtggtcctattgaatgaggacattgcggagagcttcatcagcaccaccatcattggccagaatggtcttgatggccaaacattgtcaacacgnaggccgaatgaagactgcacgccagcgcaattgagagcagcattaatggcaacgatggccggcaaggnccgtggaatcaattnggtnncgtgtagcactggccatgctgatgacctagccgacgctagagcagccgccagagaagtatgacttcagaaagcaaaaaatangctctattgcacttatgagtcccatca

SEQ ID NO: 25245 - DNA, 1291 bp, Heterodera glycines
  misc_feature (1273)..(1273): n is a, c, g, or t
tttttagtccatacaatttcgagccctaaatataattaataaaattgcgaagtgtttcataaaaaagcatcgtattgtgatttatataaatgattttcatcaaataggctcattactttttttgatgtattctaatgctagaaattgcttgcaattagtaaaagcttctagtatattttgctttattttccattggaatcacaattcttaagaattaacggtcggccaaatgcctttccgtttacttaccgccacttcgttcggttgttcgtcttccgaagaactgctgctgctttcccacctcttccgcgtgtttctcgtcctctttttctcccttccactttttgcttcttttgtgctcgttccgggctcttccacttcgtaggccaatggttttaaagttgcactcaaatttttcaaccgtaagttttgcaactccgactcggaaggtcccttcgtaattggcgtaacttttttggcagctaaagacgatgggtattcccgagcatttcttaaaaagaacataccggcacggggtacacgctcaagtaatttctcagcaaatgtctttaggttattcgtaggaacgacatcctgcagccgtttaagaaaatcgtcgcaatcgttggattttcttgccaatgcaatcatataggcaacagttgatgagtcactatacccaatgactttatgcagctcgtcatttacccaattattcaaggacataattcataaaagtatttgaatgtttgctaaaaattatacactattaaagtagtcgttgttttaattggaaaatgcggtgggggtcaaatagtgctttcgaattatacaatttaatttaggaatttcgtataataaccataattgcaattaaaccaaactttacgattattggggcttgacttggtttgaaacttctacgataacttttatacactatgggtacgccccactgtgcagagaaaagcctagtactatctcgtcgtttctctttttctttgtaatttctctcactttggcgtactatctcttctttttaattatgtaaaaaacaacattcacttcgctacgtttaactttttttctacacgttaaatccaccccaaattttgcatatcgatagagaaaaaaattctgcatcgattcatctgttattttttgattctatctgttagttcaaaagtaacaaaataaaacatacaagatgcatttctttttctctcgttttggcgtactatctttggtgggagctaacaccatgaaaaaccantaaattcgcaaattctaa

SEQ ID NO: 25246 - DNA, 1802 bp, Heterodera glycines
ttaagcttattccagaaaatctcgcatgaattctcatttttaaattttttatagatttttaaatgtttggatttttttggcttaccaaaacttcatcgaacctggttctttctattctctttcaaatcgccgcaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttggattttttttggcttaccaaaacttcatcgaacctggttctttctattctcttttaaatcgccccaaattttttttacagcttaactaggccctattaagcttatttccaaaaaatctcgcatgaattctaatttttaaattttttatagatttttaaatgtttggatttttttttggcttaccaaaacttcatcgaacctggctatttctattctcattcaaatcgccccaaattttttttacagcttaactaggccctattaagcttatttccagaaaatctcgcatgaattctcattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaa

SEQ ID NO: 25247 - DNA, 1159 bp, Heterodera glycines
ggaaacccacgagtatacaaaaaaaaaatgaaaatattctaatttctgtagagggattgacccaggggaaagaagaagggaaagtcaaggagactagccattaggctatttgcacacttaggtcagtgttacttttaaagaatatattaattattattttttatttttccctttgactccaattttcttcactaatttttcactcagacccccattcttaccagtgcttgtttttcccggttgccctaccgggaccgggacctgagcttttcaaaacccgggaccgggaattcccggcccggtcccgtggttctctaatttctagtgaccgatagcttgacattcacaatcgaaaaatttaaacgtagaaatgcgttttttgagctcctttcttcaaatcaattgagcaaaaaaatagttaaaacctaaaattcccagccctacttcatcattgtcattttcactttaatcgagttttgattttggtttcttttttgttatattcacaatagtcatttttttcactatcaaatttatgttcaaataaaatttaaatttatttttatttgttttagcttaatgtaaatgatttaatgtttgaacctattacaatttattgacttcgttctgctggttgtgaatccaattaaaggatattaagtgacacacatcatggtgaaagtgaatccgtgtggtgatgcagtaagttatgagttttattacaacaacattaatcaaatctaataaataattgaaaaaatcgtgatcccttctccatctgatcaatgatcagaaatctgacatatgtttagagaagatggtgctaattaattacacaccgttttctgacatttactggataagtctcgtatccatttttttctgttgttgattggctattaatcacctcttttccctcacaattcactgataatgtctcattttattgtttttactcttttatttctaagttcggttacatttaattgctttattttttattaggtattcgggtctatgtttatttcttcaaaattttcctttataatactctctctctctctctccaccaacaattgaaattattatgcctctgcttcgggtttggaatgaatgtaacgaataattacggaaccgaccgcgggggaggggggggggg

SEQ ID NO: 25248 - DNA, 2279 bp, Heterodera glycines
  misc_feature (2252)..(2252): n is a, c, g, or t
ttaattacattggctattttttcagaacttttttggatttatttagtgcttttttggcatttttcgtgactttttggcgatttttcatgactttttaagtcgacttttttgagattttttgtgatttaaattcccatccctagtaatgaatggataatttggcggcgaaattgcactgcttaaatacgcagaaaattttcataaatttttcggtcgttttcataaagtataaattgcataaatttggacttttttgtccattttttcattcgaattcactcttctcttctgcccattttcgaccttttgtccttttttaaattgttctatcagtttttttttaaagttagcgcatagaatttcattctcctctctcttttgctatcacaacacaattccaattcgtcaacagcttcttcttccctcatcgacgagatgacttcttcaagatcggtaatccctccccctccctccacattcattcttttctcctcccttcattcagcgaactcgtcgtacgacttcaactgctgttgcaggccgtagtcggagggcagcgcgccgagcgttttgcagtgaagtgcttcgtcgagtctcgcgccgtgcgtcttcttccaggaaaccgtctcgccgacgtcgccggattgtgtcgcgcagagcaacgccaaagaagcggtccaagcagcgtgggcgtggacgtccgagaaagccgcagggcctaaacagaagagttgtcatgactgaagcaatttggcatctgcccgggcatgggccaatgacggaagaacaaatgagaatgttggtgcagacagcagcgacagtgacgaatgaatgacgcgtggtcggacgagacatggtacaacaacggcatggagaaaagcgtgcatcgaaatggacgagaattttgcagaggatactaattaaatcacggatatgtgcccatcacagagagtgtggctcccctttgtatgttgtataatgaaattgatcccccgtcaaatccttccgattgtatgtatataatttacccactgatccaccatttgatattaccaatgtctgaataaatgccattgaatttactacatatatcctgttgattaggaaataaaatagacaaattatccccaatttttttccaaatcgttttagggcataaagtcgaaagtcattattttcgaacgcacttttacccgaaaactgattctgtaaaacaacaagcttaaatttgtcactgtaagtttttgaaccggcttaaaactcgaaaaattttgcatttctaacttttttaaatgaacggatcctgaatttttggcgaaaatctgaaaatccggactccaataattgcctcaaaataatcactacagcgaaaattgacaaacaactttcgtttaaccgagtatcatctttatccaaaacgccggttcccgggccgggttgaattttagaaaacgaccggtttccgggcccagtctctcaaaaaccggtcaaaccggatttttccaaaaatcaccggttccgttttccgagtccggtaaaaaccgggcccggctcggtctctactaatgatgatcaaacctaatcctgaatttaagccttaaactgcttccgttacattttttgccatatgtacaacaaaagggcaatgccgcggataatggcacgcggcgtggcggtgaagcagtgcaaattcgacattggcggaggcggtgaatataaatggggatgagggcattcattggtcattattaatagacggaatgcgaacttttcggcccgaattcctgaatttttgaaatttggatggcatccgtcccattccctttttgtacgtgccatacaaccaaccaaaattattagaaaaacaattaaattttgtgccattccccattttaacagacattcccttcgcttctcccttttcgttcccttctgagccgtcgtcgtcttcgaccagtaacagcagcagcaacgagaacaaccaaagcaacgaaatcaccgccagtggcggcgctctttccgaggctccggcgatcgatggtttttaattttcaaaaaacccccaaaattttaattaattaatttcgttcctttttttgatgagcttgactacgaaattggcaccaaagtgttagtccatcgtgcgcttggcaaagtgttatttgtccaaccggcggccgacgacattcggcaaacgacgctatggagggtcggtttggagaggatttattgacggggtccctgggtggagnaaaaaaatcttcggagggatgaacccg

SEQ ID NO: 25249 - DNA, 991 bp, Heterodera glycines
  misc_feature (40)..(40): n is a, c, g, or t
aaatagtggcaaaaatagtggcgaacaagttccaaatttnaggggtgtaattttttaaataggctgttttttaatttgaaaataatttaaaataaggcaaacaactttttcactgattgcagttacaaaatattttcttagcaaatattgaacaagaaaaaaaaatttgggggaagaatttttgtgaaaattttccaattcttagggggtgtatttttgaaaatttttaggtagattcttaggggtgtattttttgaattttttagatcgattcttggggtgtatttttcgtttttattgcattttttgggaaattttccaaaaaatgccaaaatagtggcaaaaataatgacaaaatgccaaaatagtggcaaaaaattattttagtggccaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaagaatccgatccctagtcatcaccaaccatttaactttttatgaagccaaatttctcgaaaaggctagtggtgttaattgttttctttgtcatcatcgcgtgttttttgtttatttttaaagttctgtgctttatcaaaatgcaaacatatggatgggcggagcgagtgagtaattgaaggctaattaatattgctgttcgagattctcggggtcaagtctcgttctcggaaatttttctgtagcgttactaattaaccgtaggtttgggtaaaactgcagaattgcagctcgcgccaattaaaaaaaatgcgaataaggcaatacgagatgcactactctgaattatgcattttattttaattctgcgcataaataaatttttggcattatgattcatccattacattagcataaaatagcggtaggggtcaactgcgtctga

SEQ ID NO: 25250 - DNA, 1284 bp, Heterodera glycines
  misc_feature (41)..(42): n is a, c, g, or t
  misc_feature (62)..(63): n is a, c, g, or t
aaaagtctcagtaatattttttttctccctgtgtcatttgnnaatcttttctattatctacnnacagaaacatacaactattttcccccctttatttatttattttttgcaatttaattcattaaaaattttaaattatgtaaattgggtggcaaaaaaaaatttttttgttgtagcccagtaaaattggtaatgatcaaaagggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttatttttgaatcattcatttctttttttacatgtaaatatagagcacacatagagctttcaaatgatgccagattggctaaagctaactgacaaataaaaaagttatagcatttcaaaatttgcggcgccgaaatggtccgcgccgaagtgaccccgaccctgatcaaaatgggcaaaatgggtttgccaaatgtgcgcaaatccatgagtttgctaggagcttattcctctgatcaaactccagcagcagttcatcttccctgcccttatttgttaggggggggggtgatcaatttggggaggaccatcttcccccgtgggaatgggagggatgcttccaagcggaccttgcgcgggggatcaataaaaaaaattccatctcacgacggtgggattaatgggcaaccgatggacgacgacgattggtgctgaaatattagcaatttagtgagccaatcaaaaccatagagggttcctaactaatttgttagcaattttttcgactttttttttttgccaaaaactatcatttattttccaaatgtgaacaattcgtatcaatgttccatcaaaaatatatatgggtcaaattgtgccttctgttctctccaaataaatttcacttttacgtgcacatgttcactaaaaacgtgaaattacaattcattttttggtttttacacaataaaacgtgaagtcgagattaggtaattttctgtgtttttgtacactaaaaacgtgaaattacaattttgtgggtctaaaacgatttgacgggtacgtgcatctacacaagacaacgtgaacggcggattacgattcatttttgggtagatttcacttttacgtgcacatgttc

SEQ ID NO: 25251 - DNA, 1529 bp, Heterodera glycines
tgaaaaaagcaatgtatgtaaaaggaaattttaaaatattacaaaaattaaaaaaattctttttttgaaaattttttatagtagtttatattgaaataaacaaaaacgattaaaagaaatcaatatttgctttattttaaaaacaaatattttctttcgtggaaaaattttaatatatcattttatattatctatatttatttttaataattattaaatgagacaatttatttaagacaaattattaacttaccaatttaatcacaaattattatttttacgccaattttttttcatatatttaaatataaaaaaattattttggcaattaaaaatcataaaataattttttaaattttttttttgtaccaattggccacatcacaattactatctgattgactgacctttgccacgtcaatagcctgtttgtacatttcacgcggatacggggaggggaacagtgtgaagggtgcaaaaacggacatgttactcctaaattaattaaattattaatttaaattgtctaaattaattaaaatatcaatttcaaattaattttttaaaattttaattacttgtctttcgcagtaggcaatcttgtaatcagaaaaactttgtgagaatagtcaattgcatcttccaccaaggtttgcacattttcttcatcaagaacaaaagttggagctgtacttggttgaggcgttgtcactaaaaattattttattttaaattgtttaaatatataaatagaaatatgtatttacctaattagtgataatttttcgaaaattttaaagtttttttgacttatgatttcgttaaaaaaatacaaaaaaaattatgtttatatcaaatttttaatgatattagtaacaaaaaataattctaaaattaattaaacaaatgattggttttgaaaattgctattttttgattttttaactaataaattttcaatatttattttaaatatataaaatatttaatttttttttatttataaatataaaatttaaaaaaaaaaccttgcaattgttcagttgtttcctctttttgttcttcattagcagttgtaccatttgttgcgttacaacaaatggtacagaataaaagcacaaaagacaatttaaacattttggcaaaaatatttaaaaaatatatttgttttcttagaataatattttatttaaatttgcgtttgcttttataataaaatttttgtttacattattataatatattttgcctactttgtttcctcgtaaaaattcatttccgtcaatgatgtaatcatatgcatggaatatccggtctatgctaagataataatttttttataaacatatgccattcattaacatccggatataagttgtagattagaaatatagcttgtatacatttttaataataataatataataatgttaataataaataaataatagatatgcaatttatatgcaacaaatttcacacaatcctggggatcttaaaacggtcacaaaccaccttttttcggcacg

SEQ ID NO: 25252 - DNA, 1283 bp, Heterodera glycines
tagttttaaaaatgaaaaatctaggggaaaatattagaccatattcgcccagagtaaaaaaaggtcatatactatcattttattcttctcgtattaaatcaagaatccggaagaattttttggggtttttaacattgtcgctgagcacgcgcggctccaagtcgacgagcagcgcacggggcacccatttttggccggaattctgcagaagacaaaaaattagaaatagaaatttttcaaaacgcaaatttttaatttccccccccccaaaaaaaaatcggtgaaaaagctttcatttttatagcttcttatttcatttacctatttgacaatttcatcagtttttaactgttaaaaaattctcggggggggggcgtggatgagctgcacccgactatttgcttcatcacctgtctaggcaaatttgttgggaagactgatcatgccatccacccatccccaaaacctcgtcagaattcgtctcttgtttatcctcttccctcgatttgtcccgccgtcctccatccgttgatccatcgcgtcagattataagtgtgggtgccatgccgtcatgtttgtacatgaaattaagtccattacgactcaaacaaaaacaaaaatacgtagaaaatattaccgttttaccattacacgaccatgtgctgattataattgtgggtgcactgctccaaaatcgggttgggttatagcgcgggcgggcgggagggggggggggttatcttctttttagctgggggcgtgaatttaaggcataaaaagacccaccaacagtgtttgtacttcattctcctcttttattcctatcaattcgtccaaaacctctatcaattgaccaaattatgtcgctaccgttaaaggaattcctaatcagggaatttgaaaaggcaagacagcatatagacaagcgagttcacgaagaagttgctgagaaggacgagctggccaaacaactgaaggatctgaagcgaaaacgaagatcaatccgcagcagacgaacatcgatccacagcagaacattcaaaaggactctttcaaagttagttgtgggtgccaaaggaactgattttggatgatttggcccaccaaaaaagtcaccgattttttgattataattgtgggtgcccggttttttccacccccccccccaacattgtcaaattcgaccctccgttcgtcctctgccgcgatttgcccctcaatgtgaaatgcaattttataaattttgatgaatgaagacagatttgaaaatttaggttaaaaaa

SEQ ID NO: 25253 - DNA, 1316 bp, Heterodera glycines
aaaaaattttgaaaattgtcttttggatttgttaacagattttattcaaaaaatgaccaaaacttgttttttaaattttttgtttttaagtcgctttttttgtggcgctgtttttccaaaaaaaattttttggaacattgggtgcggggtccggcggtgccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccatatttgaattggagctatccaaaaatagagaaaacattaaggaaggaaagaaagagatttaagattttttttcgcgtaaatttgaaaatttttctggctgctcaaaagttcaatctttaggggtgtattttcaactctcgcctctcgtcccaaaaaacgagaggcgagagacgagaggcgagagtacaaaaaatggcgagagttggcgagaggcgagagacgagaggcgagagttgtcccacccctgctgcataactcaatcggacaaacaaatgtccaaattggcatggaattggcactggcaccgaacaatggcgcaaacagtggcccgtcaaaatgggccgaaccggactcagtacggcatgcgacaagacaaagccgagggggcccggtgcggggtagggaaagtgccccccccccccccccaactttacggatttagcatgaaatcagctaacaattcaccgcaaatttcagtgcttgggcgatgtaaaattgtgaaaatagctacgaattacccttgaaaaatgcacaaaaaaagtcgtcgcttggttttaaatagagattttattttcgattttcagattttggcgcagaaaaatttcgcgggttttattttgctgaaacatttgctggaaattgagcagaaagtgcgcaagattcgggactcgcagacgcaagttcccgaattcttttacgatcaatgcaaatcattcgaggcgatttttggacggaagttgaatttgctcgaatgttcgaccaaattttcggttttttgtattcatctgaaaaataagacctgtaaatttaagccaaaattgcccagtccccctccggcgccattttacgaggcaattcgtcagtatgggccattct

SEQ ID NO: 25254 - DNA, 2278 bp, Heterodera glycines
tcacattcacaaacaacgcatccccttaattgtgcttccccccacgttttatttaatttcgtataaaggtacataaagccctttctttcatcgaaagtcgtctttttcgcaattttctgtagttgaacagcatccatcgttaatattgcctagttttctttaattaattttccgtttccaaattcttattcgattgtaagttttaaaaaaaattggttttaagtccgagtccgcctgattaccctaatcctaattaggtacttgaaaacgaaaaacattgacaaaaacacatttacgtgcataaataaattcattttttcaattcttttcttttatttgttagcctatatttaattttcttcttctcaaaatggcttcagaagatgcttccaaagttcgtcgctcttccatttctattttcattcatttttacttagatcgtcacagagcaacgtaattttttcaaaaccggcgcaactcgtgccgcggcatttcgcaaggaacagctgaagaaaatgcgcgaaatgattgttcaaaacaaagacaaaatttgcgaggccatttacaaggacttgcgacgtaacaaggagacaaatatgaaaatggaggtgaatttcgtattatttgcggtattttttgttaacttttagtaaagatgtttaatcgcgcttattaattttaaaatatcatttagttttctcgtttttcaggttgatgggcctttgcaagccattgactattgtctgtctgagttggacgaatggatgaaaccccaaaaggtacattagaaaaaacggaattttgctgaaacacactgatacatttgcatattttagctggatgaccaccaattgggcaagccgttggtcatttttgagccgaagggcgttgcgttggtgatcaccgcttggaattatcctgcagccctcgcttttcaaccggccattgaagcaattgctgctggcaagaaaacttcgaaattttggaaccttacattttcaatttcaggaaacaccgtggtgatcaaaccgtcggaagtgtcgccgaacacttccaaattgttgaaggaaatgtttgatgccacttttgacaaagtgagtttgagttgaaatttaaataaaacacttacaattaaattgttcaataaatcaaataattaaaatgatatttattataatccgtagaaattcatcgccgttgtggagggggcggcccccgaaacgcaggcgcttctcgaccaacgctttgaccacattttctacaccggaagctcgtcaattgccaagctgataatgcaagcggccgccaaaaatttgactcccgtcactttggaactcggcggaaaatggttggtcgttatgcttcattctgattttacttttcaactgatttagtccggtggtcgtggagaatgacgccgacttggagaaggctgctttgcgtatcgcagaagggaagtggttgaacagcggacagacttgcctggcgccggactacgtcatgaccacggccgagatgaaaccgaagctggtgaacgcactgcagaagagcattcagacgctctacggagagaatcccaagaagagcgagcagtattcgagaatggtcaatcaacgccatttcgaccgagtgaaggcgttgctggacaagacgaatgggaaagtgctgtacaagaatggggagccggaccgagacgatgtgttcattccgccggtcttggtggatacggacttgaaggacgcactgatgcaggaagaagtgtttggacccgtgctgcccatcctcaccgtgaagggacttgacgaggcgatggacgtgatcaacgacggagaaaaggcaaatgcttcgagaccaaatatcaaaataaatttgaccctttagccgcttggggcgtatttgttcacgaatgaccaacaaaaggtggacaaatttctgaacgaaacttcgagtggaggggtcacaattaacgacattctcaagcatgtctttggttagcaattgaaaaatgaagaaagtctatcggggttttaaatgcactttatgagtccattcgacttatatgagtccaatcgacttttatgagtccaaagatattttatgagtccaatcaattgacaattccgggtttttatacaataatttggttcatgttcgaacaaaccctatctttttggtatcattcgaaagcacaaagtctaacgaagctaaaatatataaaatcgcagcgttcatgcaattaccaaaaaagatttgattaattaagtaattgctgattatt

SEQ ID NO: 25255 - DNA, 1422 bp, Heterodera glycines
gggactcaaccctcactagttcaatctctgggactcaaataaccggcattccagacactgggactcaacccaccaacatttcaatgtcattccaatctctgggactcaatccaccagcatttcaatctctgagactcaattctcaggctttccaatcgctgggactcaacccaccaacatttcaatctctgggactcaaatctccggcattccaaacactgggactcaacccaccaactttcaatggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacactgggactcaaatctccggcattccaaacactggaactcaacccaccaactttcaatgacattccaatcactgaaaatcaagccaccagcattccaatacttggactcaacccaccagcatttcaatctctgggactcaattctccggcattccaaacaatgaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaaacattgggactcagcccaacaactttcaatgacattccaatcactgaaaatcaggccaccagcattccaatactgggactcaattctccggcattccaatctctgggactcaaatctccggcattccaaacaatgggactcaaatctccggcattctaaacactgggactcaacccaccaactttcaatgacattccaatcactgaaaatcaagccaccagcattccaatactgggactcaacccagcagcatttcaatctctgggactcaattctccgacattccaaacaatgaaatctccagcattccaaacactgggactcaacccaccaactttcaatgacattcaaatcactgaaaatcaggccaccagcattccaatactgggactcaattctccggcattccaatctctgggactaaaatctccggcattccaaacaaatgggactcaacccaccaactttcaatgacattccaatctctgggactcaacccaccagcatttcaatctctgagactcaattctcaggctttccatcgctgggactcaacccaccagcatttcaatctctgggactcaaatctctggcattccaaacactgagacttaaccccccaaatttcaatggcattccaaatctctgggactc

SEQ ID NO: 25256 - DNA, 876 bp, Heterodera glycines
tttttctgggatagagtataaatttaaaaattccctcaaaaataaaaggtaaattgcgcaccgccctccctatcatgctcgagagcatttgtatgtgtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtaattgcgcaccgccctccctatcatgctcgagagcatttgtatgtgtataaaatttatcaaaaaaa

SEQ ID NO: 25257 - DNA, 1446 bp, Heterodera glycines
taattgcccaaattaacgaatcggaataattaagtccaaccaaattgccaatcgaatgctttttcactttatttctgacgcttggtaagaggggaccaatcaaaggcagggggagcacatttttccaattgttgtgtgtttttaagaagtgaaggaaaaaaagtgatcgacaagggggagtccatccggcggatatgtgaaacgggaaaaatgagtaaattttatcgccgtgggaaatctcgaggatcggccgattcaatgattgtggtgcatgggaaaatgtgtagggagagtgaccaagtattgtggcaatggggtgggagcaagggggacacggacacagaccaaattagggaaattgttcgcagttcgcgacactcccggcagggtattggtggcaccatttgggctgttggatgagacggccaaaaaaggaggaatgggacaagggggggttgtgaaacgaatttggttcaacggcacgggctttccgagtttggcaaattccttccattctttaacggaagacagctgttcgattcgtcctgagtccatgattcgcgttcggttgaccatcatcggttgtccgcgtgccggtgtttgggaagtgtgattgtgcatgtgtgtggccaatgatgctagagatgaattatatttacttaatttttcttatattaaataatatgaaatatattatctcgcaacgaatacgaggacgaagaaaaatttaacgaagcagagatgtgtaaaaactcgtgcatctttcttccgcatttaattatttattcatgtagttatttaaagttaaataatttattaagatcaatataataaaacaattattttatattaaagtttatttcaattttgaaataaaaaaaataataaaaattattatatatttttttatgaaaataaaaaacgattgcctacgattgaattaaagctcacaatctaatcaattttttttatgcgcaataattaattaaataaaacaaattaaattacttgtatctaaaattttcataaataaattataagaaactaaaaaatcattttgtaaaatgcttaaatattaaatgtaaatatttaattaatttatttaatgaacattataaatttgtacaatttatattattttgttataaaattgatttaattattaataatttaaagttttcatacgataaaaatttgtaagaacaaagattaaaatgtccccgaccttggaagaacgaaaaggaagagaattaaaaaaaaattagaaacatttgatgcaatttttttgtataaaataaaatttatattaattaatttgtttgcaaataattaattaaagaatgcaactcaattatttacaataattattaaaataaaataactttccatttatgagaaatacaaataattataaattaatacaaaataaatttgctcacattaata

SEQ ID NO: 25258 - DNA, 2570 bp, Heterodera glycines
  misc_feature (49)..(49): n is a, c, g, or t
tgcatattttgccatttttcgtcaaatattttccgattcttttatcccnttcggaaaaaaatttgattgcctaaaattaaatccaaatctgaatgggtgcgcgagtgggtcaactgtgagtttcactgccgaaaaccttgagaaatttttgatttgaaattgcaaaaacaaccggtaaattatgagaaataaaattttttaaaattattttgcacccctaattttcaagtttttttgtgcatatttggtgcatattttacgatttttatgcatatttgatgcatatttcacgactttatttgcatatttatgagcatattttggccacttttcgtgcatatttttggcagccctggtgacaataaatcaagctcttctatcttacttaaattattttttgcgttcaattttattattctttaattaattttttcctttaaaaaattttgactcaaaaatcgcaaaattttcgacttttttgaacagggtctgccaaaattattttactactctatcgatactttaattatttttaggcaaaaacgatttaattttttaaaaatcttatttttggagtcaaaacttagatttttgattttttaagtcttttgtattctaaatgtcttttcttgtttgttaccttttcagtaaatttttgttctcgaattggccaatttatgtccgctgtttctctgattttttcgcgcgctgaaaatttaaataaatttgaattgcaaatttggcggtttgcctttggccatttcccatcggatgatttttccggtggataaattcgtttttgaagcggcgttttgctctgggaatattggcgttatgacaaccatcgccgtctccttgcgaatgcttttcatcacattttcctctgccatttgcctcttccaaaaccattctctgctcgttgtccaattcaaaaattcagccctccgatttcgttcaatgggcgccaattggacgggcatttgccaatcccttcaaataaaagtcaaaatgaaatggaaataaatgtaccaaagtgaaaaagtgagaaagaatttgtcgattatgaagggaatggacgaatttggaaaaagcaaaaatattttggccagcaaaacgagaagcattttccgattgaacaggccaaattggtcggaataaatgtgcttatctgaggaaagcaattttaataatttaaattatttatttttattaataattccgttaatatttcaatttaactcactcttgcccactgctccaaataaatcaaaacgactcgaaatttccccacagaattttcgctgtcattttcttcaatgttttctttttgcgaagtttcatccgtcaaaatttccacgattttcttccaaatcccaaagtctgaatgaatacggtactttgtctcgattctcctactgtacggctcggccccaccggcaataattcgtatggcaccagtccattccttcacttttcctcgttgttctaatgccattgcgcgctcatgagaaagcattgcgctgtttccgttcagcaattcgatttccatgacaatttccgccttttcatccgctccttaattaattaattaattacaattggttcgttaatcattaatcgcttttcctaattgccacccgtagctttgttcagcttttcgtgcattcggttcttctcgctctcgtgccattcctggtcattccaataaactccctcatcaaaaatgtggtcggctctgatcacttgtgccgtttttatagtcaaaaatctcagaacattgctgatttgggttggcccccataggggggagtctggcaatggtgggaacgataattagcggaagtgccatttgcaggcccatgaaagtgagtcggagcatcggcaccgaactgacgcggtccctccaggatttttgcattgctgtcacccgcaaatcctttgaaatgaaaaaacacagtgataattcgaccccaccccgctaaactcaaaaaacaaaaaaatcgctaccgtacccggcacagtacacagtaaaacgattcgtcgccacatttttctcgattttcccttccatttaaattgcaaaaatgctttccgataatattttcgatgctaaacacactgggaaagagacaaaacgaatcgaagcgaccgccaaaagattgggagacgacaaattgggcaaagggggactgaaatgggaaaggggaaatggcaaatggaaatttggaaatggcacccatttggtgatcagctcctctatttggctcaatacattttgcaaattttgatcagattccgttgaaattaagccttttttcacctgaatttaatttccttcacaattttcctttcccaatttaccaattcgctttttcccattctttcatttttctgatctttgctaaaattcacttcttgccaatgttcggctattttggtcacttccgtctctttttcggctttttctctgtcgtttatggttccaaaaataattctccatcttaatccaagccctgggaggagaattaatgataattattttctatttccccacccaatttgactctaga

SEQ ID NO: 25259 - DNA, 1219 bp, Heterodera glycines
atccgatccagacggggtcgatgatttctttgccgtccccttaatgtcctctagcgtagttgttggccgcgtcttcttttccagtgatgagctgttcagggtggaagagatgcttgtaagtcccagtgcggatctcgtctaaaacagcggataatccaacgaaaaacaacaaatggcaaccgatcactgttggctccaagtcgaccataaccgcacgcggaacatgacgcccattgcctgtttccgagaagaaggtgctgaacgaatcgtcttggttgttttggtcggatggcatttttccatcgggctgaatgccatgttccaagcagtacaattcccaacaagcatttccaatttgcacgcccgcttgtcccacatgaatagagatcacttcacgcttaacaactcgagtaagcgcttatttacatactaaattaaaacacgtaccatttttgatgttttctctcactaagatttgacttgattaaataggtcaggtttagtttgtggaaggctaaaatttataaaagaattaaagttttaaaaacaacactgatcgataaaaagaaaagctttagaaaatgaaggtagtattaaataaacgagcatgaacatgatggttgacgaacgggaccgctgcccattgagttattttgttctatacaactccaagtgtcactattgggtcactccactagcaaagtaaagcctaatacacaatgggtccgctccatgtcagacaaaattgttcataacgccaagtagtataatttgcgtaattttttgcgcgctatttcaaaaaattagctggtcaatgccttttttgacaaaaaatttttttttaggaaaaaaggccaaatcacaaaatacagtcaggtgcaaaagtaaaagaaaaaggcatcccgattggtcatcaaaaagttatggtgtcaaaaccaaattgacccaatttttggcggtgcaaaagtatggaagcaaaatctttaatacactaaaactattttatacggagaaaaaattcagaaaatcctctacgctaacttttgatgaacaaaaaagtcttttggaccaacatgatcagatcactccttcatggtgacctgaataccccaaaatatatttaaaatcggtaaaattttcgaaaaaaattcctaggggttgggaaaatttttctggaaaatttgattaggcctatcataaagaggacaaaatattctac

SEQ ID NO: 25260 - DNA, 1693 bp, Heterodera glycines
gttacccgatcagggacttttggtgccctttatggttgtttagtaggctccggcggcaaatgactgataaaatttggtagtttttacaccgttccggaggccaggcgagtaccaaatcggatattaaataataaaataatttggttgatgattaaatttataaattaatatattaaaataattaacttaattattcgaataatttttccggactgaaacggccattccctccaaattgcgcacattcattcttttttcgcttcgcccacacttattcttttttcacttcttcatagcaccattttgttgcatttacattcagattctctctttttcccctccaatgcgtttcgagcggcggaaacagcgaaactgacaacgccgcttcaatttcacaacagcagcagcagaacttttttccgcttggccaagtaatttttccgattttcttttgctaccgtaatccaccaatcgtttagcaattaccgtctttcgcgatggaccaacaacacgcccacgcccaccagcaacacccgacggataacagccagcccaagcagcagtttcagccccagcagttggacctccacttggggcagatggtcgacccgtcctttctgctccaggacttccaattggcacaatccgtcacggtcggcgtcaatggccaagttggcatggtgccctttttgggctttgaccttcaacaacaactgaactcattggccacggcaccagcaactgatcaccagcagatgaatgctgtttctgtggatgtgagtcatcaacggcactttcacaattccgttgcatttcaacatttgaaatgcatgtcaaaaatgccttggctttccttccatctaatggcctcataatgtcccgttctgtcctccagcgcacttcgtccgcgcgttcttcggccgtccccgcgtcggtctctgtgattttctcggccccttccgccgtcccctgcatttcttccgccccctcctccaattgctttacaaatgcttgtccctcttccgctgaattgttgctcaacgggtacactcatcagcagcaacattcgcaggtgccttctcccccccccccccttttttctccactcattttgctctttttcagattggtccaaatgccacgcgctttttgccctcggtgacaaaagtgcaacaagaaaagaatatgtcggctgagtttgtcaacgaccggcagcacatcggctacgatttgttctgtacaacggtaaacagagggacggcggtggtcgaattggaagaattcgaagttcggaacggcgcatcactgccgacttatgggcagcaccatttcacatctgctgaccaattcggacagctcggaatcgaccaacatcgatttgtccatttgtcagcagggcaaattttggaaggcaaacaaatcaaagcggaggagcagcaacagccgccggggaccaccgtggccatgtcctactgaggagaacgaggaaaagcatcgacccgccgatcgctgctccgtccgttgcccttccgccgccgatcagtcatttcccaacctcggccattctcgccgattcactcattggctgtgccacgaacttttccttatcattcatttcaaaattatttttgtacattccttctgtagattagttatcatcccttattgcatatggcataaattgctttgattc

SEQ ID NO: 25261 - DNA, 1828 bp, Heterodera glycines
tgaggacactggggtcacaactgttcccaaaaagactctttatttcatggatgcatatcatgatgcgaccaataatcaatttagttatctcatgattaacatgcacccaaattctgaggaggaattcagattatgtagcaaaatttttccagatgagactctggaaatttatttaccaattgaatagtatataagaatatgaatttaaattaaattaaaaatgtataaatttagctccgaagtgaaggagaatacagcattcctaaagaagcttgcctccaccagatcagaacaaaagaagaacgaattaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttgatacctgtactgagtgttttagcccaacatttattagaaaaaataacatcatgaaatttgcaaagaaaatgttaatgattcccgaggcggaatatttggctctacggagtgcgatgaatagtggtgattatctccaaaatgaaaaagcgagtttagacgcaaaaatttctcagaatttacaagaccccgacataagcgaggacctcaaggcgaagagacatgattggctctataaagaaagacgtacggtaaaggggatacttgaaaatagaccacagaaggtagtgattgagaatcatgtacccggtccgaatgttgcaccatatctaggcctcaacactcaatccaaaccacaggagaccgatgaacaccggaaaataattattcctaggaaaagacttgaagagcaaactcctgatcctgaatcagataatgatacaataaatgagttaactccggagccccaaacaacatccacattaaaacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagccgaatgatcttcagtgcaccggccaagtcaaagaagagtgaggacatgatcgaggcttttgatcgggtgttcgaaaagtctaaaattatcccgcatgaaaatatatagtgacagtagaagggaattccaagcaggaaaaatgaaaaaatattttgagg

SEQ ID NO: 25262 - DNA, 1118 bp, Heterodera glycines
  misc_feature (56)..(56): n is a, c, g, or t
agtaaaaacaatttataaataaaattaattaaaatgatcatttgaaaatttataanttttgaggaaaataatcaaaaaatgtgtgcaatttggaaatgatatggcaagaaaaatgttcaattgtcgcaaaggaatgaatttaaaagttaataggaaaaatctttagggatttgacaggacctgaaattataattgacaaaaaaaaatgccaaaaaaccataaaattttgctctataatttcaggcattgacagtaacatacatacatacagtatgcaaaatacagtatgaatacggatatgtaaaatggaaataaaaaaaaataaaaaaagaacaatatgcaaaaaagaaaaagaatcccattaattgaaaacagaataaaatttgggaaatctccgatcaaatgagcggaagcatttaatgaggaatcaaatgattgatcatatttctcctttgattgttttcaaggattgatcatttaaggtgactgactgatcagtgtacaaaaaggggagaattatgagcgatcagttcaaaattgatccatgggttcaaataaaaccaaaccgtatccattttttcaaaataaaatgatgcccaaccttagatatttggctcatccctcggattagttttcaaaacaaaaacattgcgcccagtataaccaccccaatttctgattgatcacgttgcttctttctaatcagtcgtcattggcactggtgctgttctgctggtgattggtgggcccaattgtttttgattgatcagcgccgctgggagtgattggaagttgcagcgttgtgaacggcttggcgccaccgcgtccaatggacttgggacgacggctgatctgccgcatggacaactccaacggtgatgggaagaacattgggcgtgccaatggatgacgaaaatggtgggatgaagcatcggaaggtgaggaggaggacgagccttaaattaatgactccaaatgacaatgataaaaggacagggtaattaaaatattattgattgaccaaaaattagactcctaatgacaatgaacaaagacaagcattaaattacagaaaattttgatcaaatttaagcacaaaatgccaacatcgaagaaaa

SEQ ID NO: 25263 - DNA, 1371 bp, Heterodera glycines
gggggggggagggtccgagcgggtcaagaaggtcctccttttccttctcctcccgctgcttttgctgctgcgactcgctttcgcttgcctgtccgtttgatccaccagagaattattttgcggcaaatgatccaaataatgttcagcagaaaagacgcggcacagaaaacaatggcagcgagacatgagccgagaaaaagagagccgggctcaagagcgtaccaagaggagaagtcgagacgaaaaaggagcacgtggaggaggggtggcacggtgccattggtgaagacaacgcaatggtacctgaaaagggagttaccaaatgaaaatgaaggaaagtatcgggaagaaagggaaagtgaaatatgcaagaggggagatccatttaaattggattttgtaacgagggagaagcaaagaaaatcgtttaaaatacgcaggaaggaatacttacaatagccgctgaaattttggacccattagcgtacattttgctccaatttacccaaaaagcagtgccattccaacctttccaccaacgctctcctcgcccttcgaattgccaatgttccgttgtccatcacttcgtagtcgccttccctggcccattttgtctgtgcagttttattacgcgcatcggaaaagccaataaacgtttggccgtatcctttgtaccaccattcgatgcgatcaaaatcaatctcatcagaagcattgagaaaacacggcaaaacggagtcatgcataagacggacagaaaaaatgtttgtggagagagggctcaaaacggaatgggcagaaagcgaagggaaaagcatcgaaacagagacgaagaaaaaagtgaagaaacatcgaacggacaaagaacgacggcgagtcattcactgctgcagaaattatacaaagaaaaaacaactgtatgaaaaagtgaggaaagaaaaatacgaagagaaaaataaacttaaaattcgaaaaaacgaaagaccataatccgtttacgtttatcaaatgaaataaagagaattcacaataaatcactctctctcaatgtcaggaatttcgtcggctttgaatgggcggtactctcgaattcgtggattgtaccgtttgatgtaaaaccaactgccagggtgcaatttgtacttcagccgaaacattgccaaatcgtcgtcccaatgtcggttgaatcgcttgtacccagcacggtcaaattccggtatagtccgatccgggaaaagtcccgaccaatgcgcttgcatcacacaccgctcaagtcgttgttgctggtcatggcaaagacctgtttttggtaaaatgcttgacaataaccaaaggaacagaaaatgccaatcatatatcggaacaagaaag

SEQ ID NO: 25264 - DNA, 2667 bp, Heterodera glycines
  misc_feature (1032)..(1032): n is a, c, g, or t
  misc_feature (1850)..(1850): n is a, c, g, or t
attatgattacagcactgagatggtttcggaccaaaactatctcaattttgtttcattcgttatatgaaaatgtcgaaaaaatagtaattaatttaatattttaataacgtggttcactaatttttaagggtaaatgtgtaattattatagggaattttcatttggcgcttaaaaacttttatgtgctattttttacacaaattttaaataaaaatttgcccaatttaaaatggtgtgtgccaaaaaattaagcattgtaaacggattccaccaaataaggaagtaaagcaaaaattcttttttttttttggtctttggtggcggcattaaatggtaactcacacacattgaggcgcgtcaaatcaaatccaacaaaaagtttggccaattccctttaggctaatgtcattttaggcaattggccattttttgttcgagaaaacagtgccgtaaaacaaagaatgcatgaatggatggatgcttaatccacttttattggaatatttttattttatttaaattataaatttttaaaatattttattacaatttttcgtaatttcctaccataatattttgtaaaaacattaaatttattttttatttttttaattaaaaattggccgaatacacaatttttcacaagacaaatataaaattctgacaaaatttaattgtcgtcactcacattgacaatccgccaagtcattcattcatttctaatgaacattgagaataccatagcttaattattattattattatttattattattatatattaaggcaaatgcaaaaaggtaattaaatgccaaaattttcagaatgccaatcagactgacatttaaacaatgaatttaaattaatattttgaacactgatttggactaattttaaagtccggtcctttctctacccaagtccggcacatttttgggcttttccacccgaatgtgaatacaaaatgccaaccatcgccgttatcataaacctaaaaaaaagttttttcaaaattcaattacagtaaaatntaaaaaaagcaatttttttttgtttattgcattccatttttttaacaattacggtcttccgacaaatttttgtgccaacaaaaaagtctcgtctttgaattttggtatgccgacgacccttgtgccctccacaaaccaaccagccgcagtgaaatcgcaaacaaattctttattcaaattgttctcataaaacttttcttctcctcccccccccaacccattccaatgcgccaatttgccattctcgagtcaattacttctcgaaaaattcccaaggggttgttattttatcccttaaaggcaaatttttgcgtgggaaccatttggctcaaatgataaataaaattttgtgcagggcaatgtgaagcgcgttttgtgttcgttgctcagctgataaaatgtgaaatgtgtaccatacacatttttgtgaagttggaataaaaatttaaaattatttaaatttcttttttgaattggaaaaattttttaatttactttaatttctttttgtgaagaattggataaattaaattgttaagtttatttaaataaaaaaagaatttttacttttttttctttttattataaagtttaacaaactgaatcttttttaatatttaaaatgaataaaaaaaattttataatcacaattttttttacttttaattaggtttagggtgtgggtttttattgggaatagtttccatttttgaaaaattgaaaaaatttcaaattatatcacattattatgaaaaaaaaaaattagtcaatgaacaaaaattgtacaaaattttttttaaaaaacaaaaactctttcnatagcattgttatttgttggccaaagcttataaagtgcatcggaaattcatttttaaaaacaattggaccattaaaaattttagccacttaatgaatatgaattggtgggccttttcagcctcatttcatcgaaagtgctttttcactatttttttctcctctcatttttttccaaaaatttgtgagtctattgaaactgacaaaattcatttttcaatctggaaaaaaatttacaaatttttttttgtctgactaaaaaaaggaaaatttctcatactgaaaattatgataattagactaataaagtatctcttattttttcgaacgaatacaattaaagaaattaaaaaaaaaattttccttaaaactgcgtttcaattttactttacgccaaacattgtttttttttttgtttaccagcgttggatgccgtattattaacgctttcttgtcttaggcttttattgtttataatcaagcattgggttaggataatgaattaataatttggtttttttttgtctctgagaatgttacaatgaattcatctaaatcataatgaaatgaaaaataattttctaaaccaaaatatatttttaatttattgtttttaatgaaatttggcaacaatttaaatatataataaatattctctatttcaaaaaaaattttaaattttcataaagctattataaaaattacttttccattaaaatttttctaagctattaattatgttctaagaataaataaattttctctgtcttgatcaagggaggtttttttgaatttttggcactttatgcattacgcaac

SEQ ID NO: 25265 - DNA, 1185 bp, Heterodera glycines
caaaatgggaaaatgattaaattttccaattcaattccaattgcttcccgttttcgggattggtcccaatgttggcattttcaccgttggtctcattgtcggcattcccctccaatccgttgttctgtgccgtcgccgccttagatcaaaatgggaaaatgattaaaatttaaaaatttaattacaattgcttaccgtttcggcatttgtcccattgttggcattggcaccgccgtcgctcatccccgctgctgccttaaatcaaaggggaaaattaatcaaaatttagaaattaatcacaattacttaccccttgacaattggtttcattgttggcattggcatcgccgtcgctcaccgccgctgccgccttaaatcaaaatggaaaaattttttaaattattaaatttcaattataatacctcacctcatcaccattaatcccattgttggcattggcgttggcactgatgttgatcacattgtccaattcctcaaaaaaaaaaaatttaattttgaatttaaaaaaatttcaaaaaaaaacccacttcgttggctgttcgatcagcttcattcatttcaacattgcctttcagcttgaacaccttaaatgtgagcgggaaattattaaaaatttaaaaaaaaagaagaaaaaatacccttcgtttttgtcctcgtcgagcatttactgccgctgttgtttctgtgcctcccggtgtataaaactgtaaaaaagcgaaattgaaagaaattttgaactaaaaaaaaaagttacattttttacaaggtggatggccacccgcgcagccattcttttttgatggcaaggcgcgccaccagtacgcctcgcaaagtttggcatgtcaaaaaaaaaataacacaatttagagaaaaaaaagttaagcaattgatgggggggggaggaaagtttgcattaaacggcaaatgcagaaggaatgtggtgcccgttgacccttgcaatgaaaacagtgcaagggaagggcttgggaatggattgacatatcgacccactcctccccaattttctctgcctgtctgctgtctcatctcttcccctccctttcgcactctccatctctctccctctcacactctctcttatttccactgcctctccctctctctcatttgttctctctctctcatatattctctctctctctc

SEQ ID NO: 25266 - DNA, 1387 bp, Heterodera glycines
aattttgtctgtcaaaattgcgatttcacgtgaattgttcaattgaggaaagaatgaatgtgagtaaattattatacataaaattgttaaaatgtgcggacagacaaaacataaacaaaacgaatattttttattgggaaggaaagggatttttttgggatttgccgagagaatcggacgaatggacgacaaaatggcacaatttgtccaattgcaggaaaaagacggagacggaacagaaggaaggacaaccacggaaggggacggcaccaccagcagaagcaaaaagtgagggactaatggggggggggtacggtaattagtattacggtatttgtcaatgactgaccggtcatctgctgtaagaaggaaatcaagcaaatcattaaaagtcctaaaactgaagccaaattcccataaatttttaaaattcggctaaaaaagtgtcattgatcattttattgacacttaaactaaattttaagaattttttcctacggcgcctatcggcaccgtcgtatattgaatttttaaaaattgaaaaaggtaaaaatttgaattaacatttttgttataaggttgaaaaaagcgagcccaactttaagcagtcggttggctttgtcttcgccttatgctgccagtgccaagtgcgaagtgccgacgaccattggcactttttcatttcaacattttggacattttttcgtgccctgttcagaaatgacagacaaaaagaaacaaccgcaaaacggtaactgaaggaaaaagctgaaaggcataacaaatgcataataatcagaagcaattggtcgtagtgaaagtgcaaagtcgcggacgacgttcaaacgacgtcaacgccaaatggcgtcaagttcatcgattgtgtttgatcaggcaggaaaacaaacataaccattgaaattggaaaattttgggtgatttgactatggcaaatgccaataagcaaagattcactaatgacatttggcatttgcctaacaaatgtctttcagcatccaagtcgaattcaaatcactcacaagaatttcatgtccattgtggacttcagcccgacaacaccatcaaaatgtgccaaattcccgaacaacacacatttaatcgaggatcgtccgccgaagtcggccaactgctgattaacatttaagctctaaaatgctttaaggtatacgactgtcctcggcacaaaagtgccggtcatttcaccgctcctttgctctcgacaacgttatgatcaaaaaatggccaaaagcagcacggaattggtgttgaaaacagccgatgaaggcgaaaatcgcgaggcggaaggaacggagcgggagacatggggtaaaaggagagaatgagagggggaagagagagaatgcct

SEQ ID NO: 25267 - DNA, 1669 bp, Heterodera glycines
  misc_feature (54)..(54): n is a, c, g, or t
  misc_feature (61)..(61): n is a, c, g, or t
  misc_feature (88)..(88): n is a, c, g, or t
  misc_feature (91)..(91): n is a, c, g, or t
  misc_feature (93)..(93): n is a, c, g, or t
  misc_feature (107)..(107): n is a, c, g, or t
  misc_feature (115)..(115): n is a, c, g, or t
  misc_feature (144)..(144): n is a, c, g, or t
  misc_feature (159)..(159): n is a, c, g, or t
  misc_feature (162)..(162): n is a, c, g, or t
  misc_feature (168)..(168): n is a, c, g, or t
  misc_feature (184)..(184): n is a, c, g, or t
  misc_feature (188)..(188): n is a, c, g, or t
  misc_feature (207)..(207): n is a, c, g, or t
  misc_feature (278)..(278): n is a, c, g, or t
aataatatttttaaattatccaattaggcatatttcccaacaagctctgttggntggttantggtgtgggaagaacctctaagagggnggngntgaagaaaaggggnaatggggngaagaggagatttggatgatattagtagnattagtgtattaganaanatattnttatgatattaatganattnggaagttttgaatgggttngataattaatttttattggatatggagaaattagggtgaaagtgatagaatgagaggagagtttgaagtgnattgataatgaatttagttaatgtgtttggagtagttgaaagaaatggggggttgagaggtggaatggttagggagtggtgagtgatttggtgtttatggaataaaaataggtgaagttgaaaggttaagagaagaattgttgggaatgatttgtagagagatgttgagataaggtgtgatattgtgaaggagtgaatggttggagttgaggtgttcgggcgtggcggcggggtcgaattcgggaaggatcagacggcacggcctaagagacagaagaaaaagattgcaaaagcaaacaatgagaagaaagccccgtaaagccaaagcaattctcaaccttttggcattttttgaattaaattcttcaacatgcaataaagaatgattttttattgatgcgatcacatctttttgccgactttaaaattttaaaaatttatgcatttaagttttttttcttaaatcaaaatttttgattttttataatttaattaattttggaaaatttttcatttttcttaaatattttgctcagtatttcggacttttttcaatattttttaaataaaataatttccatccctattgatcagcccatttcagtaaagcattacagcgcgagaggggtaatcgaatgttggtagacgagcgcagccaaagtgccgaagacgggttcgttggagcagcccttcagccgaacgcccttcggcgacggttcgatcagaaagtgccgcaccaactcattgccatccgctgaatggtgtaaaaatgattgacatcctctcaccagtgattagtcagtacaacctgaagatggaacccccgccggcggttgtgccactttcagcgccaaaccgaaggcgccggggaaggaattgctgtcgcggacaatgaaagtgcccgggggtttgtccttcagcatagcgattgcttaagggatgatcctttgaccaaaaccgatcaatcactgatcggtaatagccactgatcagaaaaaggactctcaccttcctccctactgatggtcggcttgtaccaatagcgggaggtgtctttgacaaacaccggatgatgatggatcacatcggaactgtctgaaaggcatttccgatcagaaaatgtgcttttccttttgtttgatgcctcgagcactttggcatttctcttttcaaattcctttggcatttttttgttgcaatttttgaccttttccatccgtctccatcacaacgttaagtcgttttatccgactcagtgttttcggggaaagtctccactcgtcgtcctccgccggtggctcaagcccaaagggcgagtggggacccggcgatcgggcgatcagtgaagctgatgctgtgccgttttggagatgaggggacggtgagtaatg

SEQ ID NO: 25268 - DNA, 1275 bp, Heterodera glycines
aaaaaaaaattccgttttttcggctggatttattaagggaaaaatttttgaattttttttgcacatgtccccaaaaatgtccatctcgtcaaaaaataattttttattgcattttttgttacagaatttcttaattttacatgaaaaattccatatatttaccaatggaatctttttgctgcgtttgtaaagcaatttatgagaggaagccacacctgttccgtcacctatcgacaccgccggaccccattgaaccatttttttttaatttgaccccaaaatggcaaaaatcttgtcattttttgcgcaagaccggtacaaattcctagcttttcccggttttggtttatttggaggatcaagattatcataaacgatttaaataaatttgtaatgctaattgtaagcatatgaccagggcccggatttttaggttttcacctatttttttttacggatagcatatggtgagataaacgcaaaaaacacattttcttcgatcaattttcgatttcgggtgactttttagcaactatttaggtacctatttcggggtttttagcgcctaaaaatccgggccctgcaatgaccattcaaatacatcgataaaatagaatcactgacaaatgagtgatttttctgtattttttcatgtttaataaacatttaaacaagtttcaatttagaattaaataatttttgttaaaattttaaaaaattttagaaatggagactgggggattatttttcaacctcctcagaaaggggggggggggataattggagactgcgggattaatagagactgggcgataattagagaatatacggtatataagagagagtgttctaatcaggagagagtgctagagaaaaattggcgtactatttttcttggcaatgtgtactaaaatttgaaaaacttttcgaatgataccaatttttgattgtgggagccaaggctccaaaatttcctgaatttcaaattccggtctctagaaaagaatatgtgccaaaaatagttcatttttcatttttgaaagggaccttttttaaattatttctaaatatttatgaaattggaatatcattttttttaaatttgtgatatactaaaattccaatgaacccaaataatttcttttttttgtcagaaacagtccccccccccccacccctccctaaatcggtgtgacgacgtttccttccttccttatctttccaatcaagtggcggggtgaattgtgatgatgatgatttgatgggggggggggg

SEQ ID NO: 25269 - DNA, 420 bp, Heterodera glycines
ttttctttgtcaactaaatctaacattgttggtatcattcgaaagcccttcgggtgctctattagtctgcaaaattccaaaaaatttcgttaagttttaaaaaaggttcgagccaaaaaagttgtaaaatctgattgtatgaattcttctggccataacttttttgaaccttagcgagatttttcgaaattttgcaggctaatagagaacatttggtaatagtgcagtttgtccccccccccctttttcgaaaaattttttatgttttcaaaagtcataaaaacactttttatggggttttcggggtcgctgatcatgaattcggcacccatttcgaccaatttcggtccccggacccgaattcgaacaaaaagtcgaaaattcaaatttttcgattttctatttttagtctaaaaatgg

SEQ ID NO: 25270 - DNA, 941 bp, Heterodera glycines
gggaccaaaaatccaacccgggaattaaagtccaggctaaggggaaccttttcccgaaagaattgggtctccccataaatttggggccattggttggggggggctcccccgaaaacaaaaaaattcatttttttaaagggccctttgggggtccccaaccatttagggggcccaaaatcggccaccccgaaataaaagtctcaggttataggaaagctattccgaaggatttggtttcccccataatttggggcgcatcggtttgggggggcttcccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaac

SEQ ID NO: 25271 - DNA, 1677 bp, Heterodera glycines
aaaaatttttgcttataatacatttagttggtcaaaccaccaatccaattaatttttttaatttttcctggttttggtataattttctggttttttttatttctggttttttattatttctggttttttttaaaagatgctcaatcgagccaatgatcaattccttttgtggtaagtcaaaatgacagaacccccccccccctatcaacgtaaattaataattacttgacaatttttaaaattcaaatttaagtttcatattaaaaattaaagatgaagaggaataccaaagaaataaaatgagaccacatgaaattgaccagacacgtccagtagctgaagtaccccgcaccaaaaaatatttggaaaatgatcgagccatcaaaaatctgattgaacaatttgatcagcttggtcctgatcagcgtgatgatcaaagatggattacacatttacacgcactgtcatttcgacttaccacaaaaggaattcaaatgcatttatcggctggccacctgctaggctaatcaattttcaatgatttgttttcgcctcatttctcattaaatcaattgaaatcctaggaattcctacggaaattctttattaatcatccttacaattagaaaagcgaatgccaacattgacagaaacagacaaagtgaattaattctcaaattgataaatctttagggtttggaatttccccgagccgttaattggttttttagagaatgtcgcgcaaaaaacgattttctatttggcctttgaaaatacggtgtgctccgaatatgtgacggagaaattttggaacgctttgcgcagtttgacagtgccggttgtgctgtgtagggaagtggtgcgcgagtcgggcattccggacgatttgtacatcgcagcggacgattttgacaattaaatataattttccacgttttgccatgacaccgtcgaccaaaaagtgttggttgaactgttccttatttacaattcccacttctttctgtagcattttgacaattttttttgtcattgtcaactttggcactgccgaattaatgaattttaggcgccaactttaactgtttggcaattaaattttgctatttttgaattttgtttttaaccaaagcattagaatggagaaattatttgatcgtttatggcgagttttttccggcgcaagtggaacttaatggtttttttaaattaaaaattcgattgactttttttaaactaaatttctacaagcggaggtggagaaagaaattataatatctttttttctttttcaaatcaattttttgccgaagaccattagagagttgtgattttttcatttgaataaaaggctcttaattgacttaaattaataatgtgaatttatttaagaaaaaaaacataatatagattcatatttggaagataataccggaaaaatgaaattattgttattattctttttgattttaattctaattgccctaattagtcctattggatcaaaagaaaaaaaactacaagaaaaatcattcgatgaaatatttggagaaaaatgggaagaaaaagaagaaaagcgcaaaatgaacagaagaaacgggaataataagaaatatataaaataaagaaaaaataaaggaaaaggaagaaatattcacaaaaaaatgggataaaatt

SEQ ID NO: 25272 - DNA, 982 bp, Heterodera glycines
gtatttttccggcttccatccctttccccttttctacacaataattcgttccgcttctttctctttctcattatttttttgccttttttcactttgtccctccgttttcctctttcgcttttcctcctttctctcctctctcttttccttttcctccttttttttttcatttttgccttttttctttgacattattttttttttcttcattaaatattccatttatttcttcgaaagtttgatcgctttctgtagacgatcctcctcctcctccttttcctctttctttccttttctctttttctcctcctccttcctcctcttcctttcctacgccttttccgacttctttttcttcctttttctcttttcctttttctccttcttcctcctcctctttttcttcctcttcttctgatgttgatgagtcacttttcaaattttcacttgccgaaaaatattcattctgaaagagaaaatgtgcgaattttctgtaattctttttactaattccaaaaatgacctcgtaattgagcagttcttttatctttctaatgccatcagtatccaacaattctccaaggaatcgttctgaattaatttccatttaaattattaattagggcaaatattccccgaatttccccccccccttaaattatgtttttcaattcgctggtttgcccttacttcgttttttcaaaaattccccgaatttctccctctccctctcctccccctccgcttcttcctccaatattttggccattctttccgccctcaatttggccacaatttcgtcccttcggttcgcatttcgcagctgtttccccacacaaattatcattttgatttgctccgtttgcgttaattcgtccattctctgcccattttttaaacttttacaaaattcgttaaatgccatcggaacgcaaatggccaaagcgcgcagaagggaagtgtcgtcggggccattctccca

SEQ ID NO: 25273 - DNA, 1136 bp, Heterodera glycines
aaaacgtctgtactaaactgacccggtccggtcacatcatgctggactagccattaggccatttgcacacttgggcagtgttacttttaaagaatatattaattattaatgaaattttttaaaaataatcagcgatctttgctggtttaattttagttgtttttttagttatttttttatttgttattttataatattaatttattgttattttgaatctgtgcttattattcttaattttatgtgattttagattatgtaaatttttgagtttatttgattctatcatttataagcaaatcagcagagattattacattttaatttggccctttttaatatttatttggttaattattaaactcttttgaaattttttgctgtcaaccatcattaggcctacttcaggtgtttaatttgtctatcgaaaacccaaataaactattgttagggttagcatgccgggtcgtcattaatttctttttttccaaataggtagtttaaaaacaaaaatttctccaaaataaatgtaaataagttgtttaatttttaaaattttttattagcactttatttttatgttttaattattaattaattttccttaatctattactataaaacttttgttctgcatttcttttgcatttatttcatacatattgaattcacgcaaaaaatttgttagacccattttcgtcgaattttgtaatttgattccaaacaatacatttatttatcttattaacatttatttgtcttctaaatccaactgtctctttgattttctatgtacatttttgttttttattattcataaatgtctgaaaaactaaatatcaaaatcttaaattaagcaacgaaaccctatatataattttatttttatatatatgaagcttagtaagttttatttaatgttgtaatttcactaagctataatttttttgtgtttgagtttatggtttagtcccttgagttgggctactacttttttcgccttaaatagttttggtttgaaataatttgttctttgaggtttatctttgttaatgaagtttttgatttttaatattagcggtttgtgacgaaaaataaaaaagttatggggcctcaaaaatagaaatttagaccaa

SEQ ID NO: 25274 - DNA, 1323 bp, Heterodera glycines
ttttcatttgttctcagcacataattagggggaatgcggtggggtcggactgcttcttctgctgctcactttggtgccatttgcacatggaatggccaagggttgtcgattcacggcccaccccctccccccctttcattacaacccaaaatgtttgttgattaaaccgggctggatttctaatcagaaattccaatccaaccaattttcaatgattttgttgtaatctcctatttcccaccatttccaattcgtcgtcgttgtcttttgtggcactgtcagcgctccgttcggattccgtccgttcgttttgttgcgtttgttttttggcgttcagtacggagacgcgcgttgaacggcgcaacggacaattcggagacaattgctgctgctgctgctgctccgttaagtcactgtcgtcgtttgactgttgttggcttctcagacttttgtcctctgtcgtttttgttggcttttcgatgggattacggtcggaatagtcaatgctcgttgcggaggacactttctggattatgcagaattattttaaactatttaaaaattcaaattagttaacgaaccagtgcccgtagggcactgaaagtaattgattttaatttatttttttaaaattgaaatagcttcgctatttaacactgtctctagagggcgctacgcgccaaaaaacttttatatgtaagaaggcaaccgatttttttaatggccgggaattcagttaactttttcttaaaattcaaatttttaatacgatcacttaaaatctcttacttttcctctttctcatcccctttctccctcctttctaccttcccatttcacttcatcactctcgctttctcttcctctcttctttttttgttccttcctcattccctttgttgctttttctcttcctctttatctttctcttccactttctgttcctcatccactttctcttccgctttctgttcctcttccactttctgttcctcttccactttctgttcctcttccactttctcttccactttctgttcctcatccactttctcttccgctttctgttcctcttccactttctgttcctcttccactttctgttcctcttccactttctcttccactttctgtttcttccactttctcttccactttctgttcctcttcttctcttccgctttctgttcctcttccactttctcttccacttccacttcctctttatctttctcttccactttctgttcctcatccactttctcttccgctttctgttcctcttccactttctcttccactttctgttcctcttccactttc

SEQ ID NO: 25275 - DNA, 1589 bp, Heterodera glycines
aatttaaatagaaatggagagagtgataaatagaattgagacccgagtattgaagcctagagaaatagaattatatagtaaggttcctccccaaccccattagtgaatttgagaattttgtcaagagcttttcataatcggttgagttgatccacatctttttccccctacagttggggaagtaagcccaattagtactgataccaagagtatagaaaattttggaaattcctgacacgagaatagcgatttaattaaaaattttattttggaccaaaaaataaccaaaataaaagatcgatgataattttcaaaaacaaaatctgaatctgtgaccgagaatgataaatgccaaaagcaacaaaactcaagactgagaatgtgataaatgcccaaaaaacaagagacccagaaaagtcaagactctcctccgtacttgactattaattgccgagaattggcctcatcaatttcggtcacagtgtcaagcatatttttgagaaaacttcgcagtttttcaattaatgtcgtagcaattggctgatcatttccgaccacagcaccgatcagcaacagttgggtgatcagaaacaaaaataaaggagttgcaagcatcttttttttatattgaatttggggacaaaaaaaaataaataaataattattttggtgcctgaaaaagttatgaaatttttacaagatttttaactgcttaaaaagaagaattttgtaggatttagatctcataaaaagtataaattcattaataataattaacacatacaattttataaaattatatacaaaacactttatgacgaaacactgaattactatcggaaatgagtcattaaaatatatttttaaaaatatatattggatcaataactgagaaatagaaacttttattacatttataactagggcttatatttttagatgctaaaaactggcgaaaaaaatttaaaaaataaaaattcaaaaaaaaaaaaccaagttcgtttttaggttctaaaaaaccccaaaatagtttctaaaaacgagaaaataagtgctaaaaagtttcaaattttggggtgtaaaaggaaacaaaatttcattcaaaaaatcaacaaaattatgccaaataaatcttattgagatttatatataatttaaaaaagaaaaaatccttgtcaagaaaataaatttatgtagatttttgagagaatttttcatatgcatttaaggtacatgccataggaagctcaggaaaaaaactaggtgaaaatttaaaaccataagcactatttataactgcgaaaaataaacatttttttagggtttaaacaacaaataaaaaaaacagaaatttattactaataattaacacattcaattttattgaattatatatatacaaatcgcttctgacgacagtgaattatgaccggaaatgagtaatttataaacaaataacatttccggctaaaaaatcggtaacaattttttgtcaatctattcaacttattattaacgaattattttttaatgaatttagccaattaaatgtattgattaattcgatttatgatatttattcgctatta

SEQ ID NO: 25276 - DNA, 1643 bp, Heterodera glycines
  misc_feature (18)..(18): n is a, c, g, or t
  misc_feature (673)..(673): n is a, c, g, or t
  misc_feature (711)..(712): n is a, c, g, or t
  misc_feature (714)..(714): n is a, c, g, or t
  misc_feature (755)..(755): n is a, c, g, or t
  misc_feature (781)..(781): n is a, c, g, or t
tgttgtcgactgcatatngtgtaatgccgcccttgttctaccagcctctcacacattgtaagcgcactatcccaacggacacataccatctgaatgacaatagatataaataaagtgtgttttgttttagctttaacctgcaaaagagtatgagaaggggcatcgagtaatttttgaatttttttcaattcgctgaaggctgtgttgctgtgtttgaaacgcccaacaatatgacgagttttggccaataaactgctgattgattcatctctcttcaatgcctcctgtatagccaaattcaataaatgagcagcgcaaggtccgttcggcattggcaaaatgcgattttcgttttcatccctctcgacgaaagcctgcaaataaaaacaaatgaaaagaaaaataaataaatttatcacccttttcatatttgctgccgaatctgacatgattatatgaacacattccttaggaatgccccatttgatcaataaatcctcgattttgaggcgatatttttccctgtgtgtgattccgaaaattccgtgattgccaaaatacgtgataacgacttccattttgaaattgagtgcgcggttaagctgtaattaaaccagtcataattaaaaaaaaaaacataaattgtaccacaaaaggtgcaagtgcttcgctnccacaaatcagtcgtcagagtaataaatgcgcattctnntnaatcatctctgattttcttggtgactcgtgataacaaaatnggcaaggcaatttttcttagaaaatntaaaaaaattatatcttggtttatgaaaattacctataaaaactttcactcttgactttttgatggggaaacaaagaatgaaatgtttggtcatccacagcgccgaaggaaatgttttttgtcaccaaaaaatgaagaatcttcttatccaacgaggagagttgtgctaaaacaaaaattaaatatttaaagaaaatgattgaattacagtctgaaagagtcggtccggtggatgactgaaagtctgagattgttttctgtttttgtttgtcctttttggctttcgattcaagagcattcagcttttcagtgaattcggagttttcatgaatggcgtcaagatggactttcagacttttaactgatcctttggtaagcgtgtattcgaatttaggcttttcatttgcttgacactcgagacaaattgctgtagtcttggacgtttttttaaataaaccaatttgccatatgagactcatatttataaagctaaaccaaaaagacataaaatatcaagtaaaaagttttagattataaaacgttgaattaaattcaacctgaaaaattaccaaaatgattaaaaagttaaagacattatgccaaatagatatttttcaaagaaaaacgaacaaaagtgaaggttttttggttgagaccgagccggaccggatccggttaaaaattcgccggaccggaccggattggcattttaaaaaatgacctgattccggatccggtctctcataatccggtcaatctatgtaatccggtgaatccctatttttccaaaaaagcgccggaccggattccggatccaggaaaatccggtaccggatccggtccggtccgctctctagtttag

SEQ ID NO: 25277 - DNA, 1120 bp, Heterodera glycines
taattaatgattttttcaaaaattaatttactgacttcaaattatcaggcacaatcgctttctatcacatatatatatataaggcttgttcaaccgatcgggaattgaaaaaaacttaattttgaatccgattttggacaaaggcgcaaatgtcgggacacggagaaacccatgtactttttgatcagcttttgttcagctcatggtcattctgacaatcattgtgtactctctgatgactccgttcgggtctttggtcggcgttctcgtcacggtgagtcataaatcataatcaacggtcatcgattgatcaaatctcaaattattgaaaaactgatcactgtagcttgtaaaccagggatcgtatttttatttttggtttggcacctaaccttttagcacctaacaaaaaaaatgcaaacatttttaaacggcggctcctaaaggcacagccgaagccgaaaataaaccaaatttataaaaattttaaacatattttgcgatttaaacgcctaaaatcaaaaaaaaaattaggtaatcttgtttcggttttcagccaaatgtgtctattttggattgattctggttcctaattgaatcaaaattttaaaaaaaccaaaaatttgttaagaaatacgcaaaaaattttttaaaaagatttttaagctaataagaaaatttttttgaaaaaagtctcggggttttgggtctcggtctcgagaaatttttggtctcggatagcactagcagtaatcccaaattgtccaaacagaacatggaaattgatgagctgttgaaggatgccatttcggtggtgctcgaggcattggccggcggcacattcatttacgtcacctttttcgaagtgcttgcgcaggaaagggtgagcaaaagagcagaaaacaaattaacacacaaatccgcgagaagcgaaaattgggcaaatttccaaatttgccacctcatttgtcagactaattaaactcggtgctaattatgaaacttaattttggaatatgaaatgtggcaaaaatattacaggccaaccatcactcaaatctggtccaattgagcgccattgtgctcggcttccttgtgatctgcgcactccaagttaatg

SEQ ID NO: 25278 - DNA, 1143 bp, Heterodera glycines
agcggattttggtataaaaaagtgaaatattttaatatttattttttctttattcagttggtgcatcttcggattcgctgttaaacagcagacaaaattggatgtagacattcatcttgaaaagggcacttatgcatatgccaattatggctatttatgtatcaacggaaaaggaaagggaacaaatgcccaatattcctacggtgttggcgataccgtaggaattggcgtcaattcggctactcgacagatcattttcacaaaaaatggacttcgtttgggttagcaaataataaataatataattttacgattttaaattacaatttggttaattgtctattttatctaatttattttatgtttaaaataatcaaaaatcccttaaccttttcacagatacctctgattttttcgttgatccatcttttgttgatggttctttttatccattcgtttctttgttttattctggtgacaaaattgaggcgaattttgggcccaatttcaaattcgatttggcgactctctgaaggaagaattaacaattaattcactaatgttttcgatcaatttgctcgtttttatcatttttatgtttttcttcttcaattaaaatttggttttttgcattaatcggaaaattttgtcgtttcccgggtatttaagactaaaaagatgaaaatttgcaaaaaaatagggtttttttccaattatatgctaaaattcatattaaatatctgctcatatgctatgaagaaatgggctcaaaaaagcatttctacgttaaaattttgatttgatgaggttttttagtccatataaatccatatttagcgtttttagtttatatttcggccatttttaggaaagtttcacaaaattcaaatgcatcgctaagattaaaattcgcaaaacaaatcgtccttccagtgttttgacttgaaaagtgatgatgcaaaaagtgccgatgccgtcgctcggatggcatttcgaattccgtcgcctttcgccgtcgccgcgttgcaaaagtcgccgaagcaccagcaggtggactcctcgacggagctgaactggtccagacagaccaacgcgcgttgcgtgtgtttgcattcggtgttgattttcaatttccagacagag

SEQ ID NO: 25279 - DNA, 1322 bp, Heterodera glycines
  misc_feature (26)..(26): n is a, c, g, or t
  misc_feature (1268)..(1268): n is a, c, g, or t
ggctcgattgggtctggggggaccantcggcgccacaccattggttcgatcggctatcgtgatcagcatcgccgtggttcgggctcgattggtctgggtgaccatcgtcgccatacgttcggaggaagagcccaccgagatcgccaccacccgtacagcagtggagacaaccgcgtcttctggccgaaccgtggatcgtcgtcgagaatcaccacaattacaacgttatagttctactcgaatcaccacaactttcgatcgaacggcagggacgccttttttgttgtgatggggatgtaatgatcagttgacttttgaccatttgctattattttaaattatatttgtttggcattttatttatgattttttttgttattttgttttgtgtaatttttttagttcgttgttctatgtaatttggagaataattggatatgtgctgtgctgtgccgatttgagttttaatattaatttgacggagttggataatttgtgaacaataatcattggtcaaagccctaaacaattgtccccacccttccgacctaattaaaagactgtccccgtgtgtccctccttgcctaattaattaaaagcaactaaaagcagcggaaaaaagtgactattatactaaataaaattgcaattcataatgagtttcaaaaaatccagcccatttactattaaaaaacaaaaagaaaatacaaataaatgaaaataaatgaaataattcaacgtaatgaaaagccaggaaaacatgagacgaataattaaataatgaaagcataaggaatgggaaacaaagtaattaagagagtaactttatagttactcaataactttgatgaattttatatgattaacgtcatcaaaccattactaagtgacaaattaccccaatctttcaaaacattcataagaagtgaaatatttgttgaagtttttggcataatgcttttgcttttcctccgatgccaaacattttaacactttaaaagtttgaatggagttgcaaatgtgctccaatttttccatgtcaacatcagatccgataatgctaaaattggagattttattaataaattagagagacttttttaaatatatataaaaatcgaacaattaaataaacaagccataaaaattcataaaattcactaataattcatgaaaattgaataaataatttaatttacatttttttgaccctttgaaattctttgggaaaatttctttgtcaatttggcaaaaagtttttttgcttnttgcattttcattttctgcttggaaagctttgtcaaaacgaatttcattattgt

SEQ ID NO: 25280 - DNA, 1146 bp, Heterodera glycines
aaattaaatggcgattgcgcccccccttccctttccacgctggagcgcttttgtacgtattaaatttttccaaaataagagatagtcatttttcttggatattaagaaaaaattaaaaatttctctggaaaattaaaagggcgattgcgcaccgcacttcctatcatgctcgagagcatttgtacgtataaaatttctcaaaataagagatagtcatttttcttggatataagataaatttaaaaattctctgagaaattaaatggcgattgcgcaccgccctccctatcacgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgtgaaattaaatggcgattgcgcaccgcactccctatcatgctcgagagcatttgtaacgtataaaatttctcaaaataaaaaatagtcatttttcttggatataagataaatttaaaaattctctgagaaattaaatggcgattgcgcaccgccccccctctcatgctcgagcgcttttgtaacgtataaaatttctcaaaataagagatagtcatttttcttggatatacgataaaattaaaaaattctctgtgaaataaaa

SEQ ID NO: 25281 - DNA, 1376 bp, Heterodera glycines
  misc_feature (1358)..(1358): n is a, c, g, or t
  misc_feature (1368)..(1368): n is a, c, g, or t
gttggcattttcgagtctgacaataagctaagccccccccctttcttcccatggaccgagatcaaatgcatttccggtcaaaaacaaaatgttcaccatttgcactgcggacaaaagcaaaatcaaattcaaggcacaggacatgtcaatcaatcaggcactgattcataaattattttaaatttttaagctattataaatgggggaggctgtggcatgacgcccggctgtgctttgattcgattttcacgaaaatggaactgaattttgcaattcccaaataacccgggacattaattatgcctttgttcaatttcaaatttaaataattttttattaatttggaacaatttccggggaccggtaaattggactctcgaaaaatccccgcgctggatccctcccgttccgggaaatctgttgttttaattttttttttttctgatattttccaattaaatattcaccggttatgtcccagtcaccgtcttccatgtcatcgtcctcatcttctgcagagtcttcgcactccgcagggaacaaagggggacaacccaatgtttgtgctttggttgcaaagacggggtttcaaaaaacgggggttaattcgcccagtttttcatttgtttgtgaattagtttaaattcccaagcttcagcatgtcgaaagccatggtgaccacgtgggcaaaatgcttggcaatgtgtccgacgattctgaggagggcgaggaggaagaagcagcacaacaacaacacgcggaagtagcggtggcggcgatggacgacgcctcttccgactcaccggcgacctcatcagacgaagaaatgccaatggaacagcgccagcaaaagcaaagggacgcggaggggacggaagtgcgtggagaggtggaaatgcattggcattccccaaattattatttttttgcccaaatttgttactggacccctttgaatttttgccgccgattcccttgcaaaaatttctgtcgtcctcgtcccccgcccttttttaagtgtggttttggatttgatttaaatattttgcgtcgattaagggcaacactgaagaggcggaggaggacgacgaaggacaaattggacgtcgaaaagcccaactgcagcgaaatgagcaggatgaggaagaagacgacatggacgaaatgtttgctcgggacgacgacgtcgaaatgcatggaattgaaggggaagaagaggaaggggcacagtcgacgagtcaaagggacgcggagggcgaggaggaacggcagatggacaccacgctgggcgaaggtcgcatttttttttgggtggattttgatcgaaaatgggagtttttcaggggatggacccccgnaaaaccgcanaattttat

SEQ ID NO: 25282 - DNA, 1029 bp, Heterodera glycines
taaatgttcggtgttcttaagaagacgggttttgtcgcttttaggtggaggcgggatttttcgtttttggctgagacgggattttgtctgggcgggattttgtcgtttttaggtggaggcgggattttgtcgtttttggctgaggcgggattttgtccgcgcgcccgcgccgctctggcgctatgtaatttcgacactgagtattttcgacactaagtaatttcgcactacgggaatgccggagatttgagtcccagtgtttggaatgccgaagaattgagtcccaaagattgaattgcttgtgggttgagtcccagagattggagaaaaagccaagaaaatgatgcgaggccgcgaagcggccgagccagtcgattttatcattcataattctataacacaatcgtactgcctagcgggggatgcgccgaaggcgctgaccccgctagtacaccccaataatcggtccgaaaattttcaaaaataaacgggactaacgggactaaatttcaccactgaaactgccccaaatttaaattcgacactgagtattttcgacactaagtaatttcgacactacgttttcgacatagagaaatttcgacactgaactatttcaaaaactttcactgttttccagcattttcgacactggaccatttcgacagtgagtaaattcgacactattgagaattttttaaaattaataagaaattttggtgttagtattaggtatgataaattttcctatttcattttctaattcgtactttttaaaaggttaggttggtataactgagtaaaacgtcaaacccagtgtcagtgttagacaatgactcataatgccaaatagcgatattttggggcgataattcaaaaaaacctgatcagtcagtgatcactgatcattgcaattttttgcattggttgttctgatcatccgaacttggtttagtctccaactaataataataaaattttaatgacccattattactttttcgttactctaaggaaaaatttttaaaa

SEQ ID NO: 25283 - DNA, 1062 bp, Heterodera glycines
  misc_feature (1038)..(1038): n is a, c, g, or t
tgcagtttttcgggtgccaaaattttggaattttcattcggcgcgtcataagcggatggtttggtggcaaatacaaacaaattttgtgtaattcgaatgcgctatgcgggctcaacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgataaattgttgagataattattctagacgatttttttatatctcaatgcttaactatcgcctttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgaccaatttaaatttccttacattttgggtttactttattatgctggcccatgaaaaaatgcagtttttccggtgccaaatttttgtgaattttcattcggcgcgtcataagcggattgtttggtggcaaatgcaaacaaattttgtgttattcgaatgcgctaggcgggctcgacatttccaaatgtatcaacaaagggtctatctccactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactgngtagaaattggcccagtgaaaaaa

SEQ ID NO: 25284 - DNA, 544 bp, Heterodera glycines
agtgctctatttccttctatatttttttcacttgttcccttatcccacacacaatgctgttgcacagcgagcacatgtcttactgtctacccttccacccgccacggccccacgtagacagacagtcagacagtgcactatttcttcctttctccagtggttatgcggaagaaaagaaggaaatagtgcactgtctgactgtctggttacgcttttgaaaaatttgaggatacaaactgcattagtaccacatattaattaatttattgaacttaaaaatggtagtaggcgaaaagcttaaaatttagtgtggttgatgtcattcatggccatggccatagtcaattagtgtcgagccaaatttttatgtaagtgcattggcgaaagaaaaaatttaaatttttaatttattttaacatcttttcattcaattcagaatcaattgaaaaaataggattttcgatttttatgttcgagttcgggttagggattggtaaaaattgatcggattcatgatctgaatactctcgactccagataatat

SEQ ID NO: 25285 - DNA, 1404 bp, Heterodera glycines
tgtgccattctttggttttattgggaccgcttcaaaacatcaaaaaagcaaatgtaaaaaagaaaaataattatttggaatttgaaatttcaattttaaattttgttttcccttttttcagctttatctccgccgattgttggctttgtgtcttcgaattgcttgcgccttctcaactaggcctcggaattgcgctgatcagccaccgttttgacgtttacattggcgaacacttcaagacgcgcaaatgggcactgaaatttattcaaattctactcaaaattggcgagaatggcaccaaggaaatggaaattaccaatttggatggagaaacattgccaattccaaaaattcaattgccacgcaaagtcatcggattcaaacgaatcatcatcaagtaaaattggcgattattcaaaagatttaattagacaatattcccattttcagttacatcgaccacaatgtcatctcttttctcgaccgattgagtccacttttcgcctcatttccgattaatttggcattcggcacgaacaaaatgggcattttggatttggttgtacgcaacacttggccaatgctcggaaaaaacattcatggcatcgaatcgtaccccagttttttacactgtttgcgacatttcgtcccgtcatttctcaacgaatgtccaccacttcgctttgtcttcttctgttttggcgaactattccccgaattccctgccgatgacaatgccatggcatcggaaagacaagcggtggccaaatggcttttcaccccacttcaaaacgatgtgccaaaagtgttcaaatttgaatttgtcaggaatgaatgggagaattggccgtcgaaaattgacgccttcaaagcggtgatttcgatttgattaattcatgcatttcatatttcttaaccaattttcctttgttttattaggcttttgccaatgcttcatcgcccgtcaatttcatcgtttccatttggtttcttttgccttttgctgcctccgttgtgccctttgatctgacgaatgaagtgactcgtgaacaattgacgttgaaaaagatgaacgatatccgccgtgttctgctgatccgttgtccgattgcgcgagacgaaagcaaatgggccaaatgggagaaagaagcgattgactggaaattttttgatcagtgtaacagaattgacattcatatcaataaagaggacaacatcggggacgggtaagcgaatgcatattcaaaaattcaattttattattgtgtttttgtttttaggcttcttgacgaaactcccggcccaagtgatcagccgaagaagtgaatgaatcaattgttgagaagtgatcaaccaaattgaaagatggaattgaataatgttgagcccatatgacgtatatat

SEQ ID NO: 25286 - DNA, 1464 bp, Heterodera glycines
  misc_feature (1447)..(1447): n is a, c, g, or t
caacaaagggcgcactgaaggcattttacaatagtatgcgccctattttgggggcataaatgcaacaatctgaagcaaaatttcttcaaaagggtccacatcagggatggcacggaattccgatttccgatttccgaaaatttttggggcctcggaatgccatccctggtccacattgcgtcttttgcaatcctcgcgccaaaggaactcgcacaaataggagttaagcatttgccgatgggttccatgttgttttttgttgcgcgcttttgctgaccgccaagtgcgctcaattgcctgaacctttaccgttccgttaatttatgctatgagaatagtaattgtaaaaaatgccttcagcgcgcccttgttgacatttttttaaattttgaggtgcaggcacaaaaccgaaaagtaccgttttgtcttcgggtcgttccaaaacctttctttctcatcatttagcataataattttgtgatacggtatgatttatacaatatcttcataagttgtatatcttgtcttccacctttgactaataaagaatgaaatgctcctttttctatcaaagtttgtttaggcattggatgcaaaatttgcactcaaagggctgctctttctgcacgaaatgtccaaatatgttgaaaatcagaaacatgaaatggctcaacaggatgaaggtgggatgggcaattccactacaaattggaaaaaaaagcttcgccgtcggttttttcagtgttcgaaatgccgagggtcgtccaactgatttcttggccccacctcggatcccccggtttcgtcgcagcgcccgcacatttcggggccgaatttgaccaccgtactcaattcactggtcaacttgcattcgccgacccttttgaggtgtctgactacaaaagaattcaaatgataaaaccgcggaaaattcccttaattaaggcttgcgatgggcttcgaaatttgagggaaatgcgtggacgtgttgcggtggtacgtcgcggctcgtgcatgtttgaggagaaggcgttcaacgtgcagcgggcgggggcgatcggaatggtggtgattggtcagttggaggggggggggttgattgaacgtgatcggaaatggttgactgtcgatacatttggtccatatactctccccaattcgctttcatttagacaaccgaaatgacacaaattcgtccgaccaaaatgcctttcttttcgcaatgagtggctctccagcagaagacgggggcaaagtgaccgttgttgaggaagtgcaaattccttgcgtgtttttgttccatgccgaggccattctgttgatggaacaaatgttctcccaccccgaggcgctcgtccgtttggcggactccgacctcagccccggcatttaatagaaacaaaaaccaaatttatgttttaaagttagctttttgtttcgagcaaancgttgcgacagaatcca

SEQ ID NO: 25287 - DNA, 2086 bp, Heterodera glycines
  misc_feature (55)..(56): n is a, c, g, or t
  misc_feature (2005)..(2005): n is a, c, g, or t
  misc_feature (2015)..(2015): n is a, c, g, or t
  misc_feature (2064)..(2065): n is a, c, g, or t
  misc_feature (2067)..(2067): n is a, c, g, or t
tgtaggcacaaatttggctttttaaacaaatgatctcatgcttatgaatatatannatatctaaataaacaacggtaccaacaacaaatcatccagggacgaagatcaagttgaaagtacttacaggtaagtaaattttaaacacttaatttaaataaagcaaatttaaaaaatcgacaatttcggcgccgagttttgcggcgcccgtaggataaatagtgatttatccttttatttattatttttcatgacgattgttttagcttaatttccccatttaaatattatttgttgtcaattttatcttttttatgtttgtctcttcattcgaaaattgtatttgaattttgtattaggctttttcgcattcattttggatatcaaataaaaataataattttgctttcatatagcaattaaaacttaaatgttagaatattttaattaaaatatggattagataataaagaaaataatgtgtttgaaaaaactttaaagataaaaaaattcaaaaaatataaagccatgcaggaaagtttctttttttaaatagatataaaaatagatatttattgattttttaattttcaaaaaattgattctcgtttggatatagttagaaaatgattaattattgctgcattcatttttatataattactaaattcttgtacccaatccttcatagtttttattttttgcttcgctttaactaattatattgctaataaatcaacctttttcatttgaaatttttgctcaataatgctttattttattttctgcattgtagaattgaataaattatttttaccagttaattctttattttataacctttcttaaaaaaattattgaataaaaattacattttaaaatatatttattttaattatggttttagttttaaaattcattaattacgtttgctgaaatcttttaaattaatttatatgctatatctaaaaacaatatatgtcgccatatttacatgtaatattttttttaatatttggaatttttttaaattctaaattaatgaataaataaaaatatatgaagaaaataattaattataaaaaatttatatttattattatttcaaattcagtaattaaataattacttatctccaataaaaatttttaccaaaattctagttaacaaataatataaatgttgttaacattaatgttaataaaaacacacagtgtttcttaaacacaacatttgagttcaattgatgaaccaattgtttatgattttatacaatcattcgttcaattggttgcccaattaattaatggtcagcaaattattattgtatgcattaataaagaattaataatttaatttcaatgtttattttctgaataattttctagtaaagttttaaaaatttattctttaatacaaataataaaaaaaagtatcaaatattgaaaaaataaactaaaataaatatttttaaaattattgaaaatagcaatagaataacggacaaattcattaaatttataaaattattgaaaatagcaataccatagcggataatttttttttaaattattgaaatagcaataacatagcggacaaattcattaatttttttaattattgaaaatagcaatgttttcgtacattttttctggcattttgtacatatttcatacatatttcgtggattcttttacatatttttcaaattttcttaaaaaattttcatcgctaatattacatatttttttagtaaaattgctgtaaaatattcaaaactgttaatttacgtgaagtttaatcatcagataatagaaatatttcgaatagcgaacaatattgaaaatattcgggaaagttaaattcggtgttaaatttaaatctttataattacttttaagactaaaacataaactaaattaatcagcttttatttaaattacaattcgtaaaaattattatctacgtcatcaatcaaaaccttcaaaatttgaataaattttggcantattcgcctnataaatttttaatgaataagcagcaaaaggaggacccatcgcaagaacnngnaatatttttatcatccagg

SEQ ID NO: 25288 - DNA, 1551 bp, Heterodera glycines
ttctataacttttttcaaaaagtgataaaaagctaaacttttatttataaaatagagcaaaaaattgcggattttttgagtatattatttttataaaatacttttttagaagggagttctgaatttttttctgaaaaatcgaatttttccagaaattctggaataacttttttatttaggaagttagaaattccaaataaatttcataaaattctcctaattttttgctatttttcaaactttattccactaaatttgaccaaaaacgaagagagttatgaattttcaaaatttcactggattttccggggctcaaattttgacgatttttcaaaaatttataaccaccttccaaaaagtctgaaacgcaaaataaagcgtatatacgtattcagcacctcaaattatgccataaaaatgcattttggctaatttaggagcaaaaaaatttttcatgaaatgcaaaaccatggggtcccccctatggttttgagtttcaaaatcacaattaattttataactttttttaaattcatgataaaaacatgagataaagcacattagatagagcttaaaattctctacaaaaatgctctaagacaaatttccgctaaaatcaacgcctgacgagttataagccttgaacggaaatggggagctcaattccggaaaatttttctatttccggaaaattttgaaattttttcaaaaatgccaccaatcgatagagctcgaaaaacggttgcatgaaagtggtctccgttttcctgggaaaaatctgcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcacgaaaagccaaaaccggcattttgagcgccgttcagtcgccaatttctacaggctcggcatttgatctgatcaaaaagtgatcagtgacaaagttgtagccaacatgtctggggtgtgccctctcagcggactttttccgctcccggttccctgagaaaagttacagcccgaaaaccgcgacgattttttttatttggccgtttcagcgccgctggcgctcaactggccgccggaccgaaaaatccttatttttcccagatgcgcctcaaaaagttgcttaagcaatgccgcactttcaggagcctccgggcaaaccacggggacttataattttttctacgagttgcaccttttctctatatatagtagaaactagagctgcctttttttctgcgcactagtttcgatatattaagcataaatgaaccgtcggctatttagctggaaaaaagcgcttcgcgctttcggagcttcgctacctaggctgtaaagcgattcaaatttatcgaatttggttggagaggtttttttaaatttttaaaaaattattaggggtttttagtccacatcgagcttcaaggacgggcgcttcacgaccgtttttt

SEQ ID NO: 25289 - DNA, 1354 bp, Heterodera glycines
ggcgcatcggttcggggggactgcccgaaaaacaaaaaaatcgaatttttcaagtgtcgtttggggtactcaaacaattatggggacaaaaatccaccgcagattaaagtacaggctatagggaagctattcgggaaggattcggtctccccataaatctgggcgcatcggtcggggggactgccccgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgcccgaaaacaaaaaatcgattttttaagtgtccgtttggggactcaaaaatttttgggagcaaaaatcaacgcaaaaataaagacaaggtttaaggaaagtatttcccaagggttcggctccccataaatttggggggctttggttcggggggaattgccccaaaaacaaaaaaattgatttttt

SEQ ID NO: 25290 - DNA, 2001 bp, Heterodera glycines
  misc_feature (1739)..(1739): n is a, c, g, or t
  misc_feature (1819)..(1819): n is a, c, g, or t
  misc_feature (1977)..(1977): n is a, c, g, or t
tcctccgtcatcatcttgctcatcttccatcaacgttgtttccggggactttttttcgggaaaacggggatggaccaattcaattccgtccccgtctcctcacacaaccaacagggacccaaatgtctccgagaaatgatgagaaattgtggcggtgacggtggcgggggtcgatgatggtttatttattcttgcccgcgtccccgtcgtccccatcaccagctccgattgccatggcaaatgcaaatcgtcttccatcatcatcatcatcatccttctcgcgtcctcgtcgtggtcccattttttggtgaaataaatgtgtggtgtcctccgcggttttcgctcatctgtctgtctcatcgagacgggactgaacttgagactttaaacacacagtcttggttctcaagtggataaattctcggggttttgagtctcggttctcgaaagttttggaaaatttcgactctcgaggcagctctagagacttttcaaaacataccagtttagcaacaagaattccattgcggaaaagtttgcattgagtgaataaatttgaattttgtggaatcatcgaaagtcccaaggattcagatggttaggaatattttaggaaatttaaattctagttaggacacgaaaaggagagacccttgaaattttctcaaaattttttgttgattttttcaatttctttgcagaaagaactctgaggccttaaactaaaaaaaaatccctggtgcatcttaagtccttaaaaccgtcgttggctctccctggtgcaccaccaccctatctctctcattttcatcagtgttttggagtggggtgtgctgctgttgctcacaaattgggccccagggaatttttgtgaggcgatgaaaatccggccttgagactgacctcaattagccacccgccgacccctcccggcattccaccctcctccgttcttgggtgacgcaatgccatgccaataatggcggtgccgcgcccaattggcaccgccgtcggcggcggcatttggagagggatgggacccctctgggcggtttaattgatggaatgatgatgaagcggttggataaaaaagagaggagggaaaatgggggaggtggagggggcggctgcctgactatttgatgaatgaaaatgaattttgggatggcaaaaaatgaaaatggatcaaaaaggagatattattgaaaaagaagagaaggcagagaaaaaaagaaaattagagagactattgaaaaggaggagacagcagagaaaatgaagaaaacaataacattaaatgttagattgaagaggaaaaaggagcaaagagagagagagagagaaaattaattcatatttttggccaagaacatttaattgttattaaaagtcattaattcaaagttttagaagaaaaatttaaatttaaaaggaggcaaaatatgcataggctttgggagagaaagaaaaaataaaataatcatgaagaaacgagacaaacagagatagggcgagatagtaagatattaagaagcaataactgattaagcaaagaaatcaaacacaaaatagagacaaaaaatgaaagaatcagagaaagcagaagcaaataactgattaagcagagaaatcaaacacaaaacagagacaaaaatgaaaagaatcagagaagaagaagagcacccatcccaagacagagacgcagagacatgcgcctttggggcgcagcagcggaaggnggcgtgtcttcaaggagggaattgtgcgccttcttcaagaagcagcgaattggagacggcggattacggtagcggacggnggggcaccctccgggcgatgccttgaagaaatgctccgccgccggcgcatcatttccattcttttcaaattcacttcgccggtcggaggcgggcgactgacggacgattcccattcacccaattcacctttctccgttctgtgctacccaccaccttncaccgcctacaaaattttttggtt

SEQ ID NO: 25291 - DNA, 1627 bp, Heterodera glycines
  misc_feature (239)..(239): n is a, c, g, or t
ttaaataaatttattttggaaaattttgtaaaaaattccaggattttaagaaaatccggtgaaaatcaattggattttaaaaaaaatagatattgtaaaagaaagtgagggttaaacccccagagatttttgatctcgtggatttccaaaaccgggccccctagccccatctgataccaatttggctttttcgagcccaatttttggcctcaatagcccggaaagtaattttaagtgcnccgccggtctttggcattctataaatctctggcaaccacccaattttgtttcaggaagggcagcaattttaataaaaattcatggaatgaaaaattggggttcaatcctgggccgaaccggccacaatttaccaagccttgaaaaattcaatgagggaaaaataaaaccaaaaaaaaaaattaaaaaaattcgccttgagaccggaattttgacaattctggatgccccggacaggattttgaaattaaaacctgatttttgcgggaccccgatccgtttcatcatttaaaaacccgcccggattccggggttcgggatcttgtaacctgaccgggtcccgaccccgtccaccacagcacggcgtacttacatagttccccggtcggtccactggcacccactcgtcgtgcctgcttcccgtccgtgccgtccaacaagtgggccaagaaagtgccaaccccgcacaccagccacacccagcgcgggatgttcagctcggccggcccggtggccgaattggcgctcagcccggggtcaaagcacaccacgagcccatagcaacacatcacaatcagtgcaccggcaaatgtcagcacattgggggccaaccaacgggggtaaaactgaaaaaaaaaattttttgaaaaattttgcaaattttgggcgcactgaaccgaccaaataattggtttttttcaaaattggactaaagcaccaaaattcggtcatgtaggcccttaggtctgttaattatttccggtagaaccagttttggtaatactgcggagcccccccccccccgtttttgaaaaaagttgctttaaaagtcgtgaaaacatgtttatggttgttttcggggtcgctggtcatgaatctgacattcattttggcttattccaaattcccagacccgaattcgaacaaaaaatgccagaaattcaatttttaaaaattcgtgattcggaaaaggcaaaaataaatgtcaaatccgtgaggcgctccaaaaatccccctaaacatgctttcacattttacaacaccctaaaaaaatttctaccaaaaaggagggaggggcaacggcagtttttttttttttgaaaatctttaaatttttgaaattaaggcctatctttaagcaaagaatgcattttaaaccaattaaaattcgaatgaatttatcattcataatgatgcgattattaagaataaacctcaaaaaccaacttggaccacccaattccagaagggatgcgaaatgtatgtggaaattggcgagttgtcaatgcagctgtacttgtactggtcgaacccggcgagttgctgttgcgacaaataattgaccccgaaaagtttagacacaaccataataatattgtacaacagatac

SEQ ID NO: 25292 - DNA, 1539 bp, Heterodera glycines
  misc_feature (543)..(543): n is a, c, g, or t
tgccatttgaaacaataaaatgatgagcaaaaattagacccccactattgacaaagaaaatattcatcagattttattaatgcataaaatattattgtttaatatgttaacaaaatgtgtaaagtgaaatgatttcatttttagccagtggatttttgtgataaaaaatgaatcatcgacggattgacaggaaataataattttagtttacattgactataaaaaacggactaatgagaaaagaaaaaaatttttatggcttttttggaaattcaaataacatagaataattaatttttaaagtttttatgagagattaaaaataagttcgaaaattttaaacagtcttgcatctcatctaacatcatttttgaatggatgttgttgaaaataaaaaaaggacgatgtgaataaacattaaactgcaacttttatttcaagaatttaaaatttcataaaaattttcagagtttacattgattaaacacgagaataagcaagctattcgtttaattttctaaccaaaaatatattctttggggngggggggatgtaaattaggcttttcacggtgtttaactgaaccaaaaaccggctttttggaggaaaaattgaaatccgcggccctttgagctataattttaaaaaataatagacaaaaccatgtgaattttttttttaaatgttataacatgatagcgcaggacctggtaaaacttcaactcgtactaggcaaactcgtactgccctactcgtaacataaaaaatcgtcataaaatcgtaataattttttcaaagttgaccaaattaaaaattttttttaaaatttgttttttgaaaggtgttatgaacatttactcacttctcgacggctgttggattgagaaaattgctcgtgtccaatgcggcatttaattggtatatattttctgtgacaattttattagtaaaatttagtataatttattaaattttattaatatatacacatttatactcataaaaattttgccaatatttttcttgcaatatattaaaaaaatttacttctgaaaaaacaatattttatttatttttctgtcgagttgcccatctgccgaattattttcagtttggtgctcgagagtctctgtctcgagaaaagtctcgggctttttttgggtctcggtcttcgaaactcgccgagattcgagaccgataattttttacaccgcctaatgattggcttttggcatttattgtaattgtgtgaagtcaacaaaaagttaaaaatatattaataataaatttttaaaatattatatcagtaaaaattaaaaaataattaaaataaaataatataaatcagaaaaagaggattatcaaatccaaaacaaagtcacatgcattccttcccgaaatttttctctcaattttttttatcagcatttacttttctaaaacaaactctaattggcggttttattctttttttatcagtgtcaacgagagtacatcaaattaagtaagctgattggaaacaatcacaacaattggtat

SEQ ID NO: 25293 - DNA, 569 bp, Heterodera glycines
catttttcaaaaaaaacttggtgaatgtgcgagcgtagaggtccggcggtgccgataggcgccgccgggaaaattttttgaaaactgatggatctgttaatagattttgtccaaaaaatgataggtttttgcaatttttagagaatttttttaataagatttacgaatttttgggccctgcgatgccgataggcagcgccaggcgaattttaaaatttaaaaaaataattaaaaaagaaaccgtcaacctgaatcgaactcgtgacaaaagtactgttagtattgaagcactatccaccaatccacaaataaaataaaaaacaagtaaaatttatttcatttcataaaaatttctcgatagttaaaaaaaaatcaaaattgtataaattttttgccttttatccatgaatatgtcattcttaggggtgtattttcacccccgcgcccccgcgggggcgaaggtcgcgggggcgggggtcagagtcacgggggcggggacgggggtgagccccaaaaacctgtcccgcccccgggggcgggggcggggtccgaaccctattataaactca

SEQ ID NO: 25294 - DNA, 1426 bp, Heterodera glycines
aaaatatgtacaaaaaccccaaatatgtaaataaaatttttttaatggtattttttgggaaagaaaatccccgtaaaatatgaaatagccacaaaatgacataaaaattacttttttttggtatttttaggcaacattttcaaacttattttttctttataaattttcaaaatatgtaaaaaaaatgaaaatatgtagaaaaatatttgccgaaatttatcgcgaagcagaccgccgaattctcacgatggttcaaaattatttaccacttaacaacgtagacactaacattttcccaattcatcagccttttaatcatcattttattattgcttttttgattggaatttctcgaaattatgaaatgagaccgtgatttgaaacagataaaatgttattttttcttggatttttaatttcaatgtcttttaaacttttggtatggaaatggtctaaataccttggtatggaaacggctggtatggaaacggcggtatggaaatggcggtatgtaaatggcagtatggaactgaccccaacccgaaaaaatccaaaatatgtacaaatatgtaagaaaatcccgaaatatgtataaaaaccctgaaatatgtaaataaaagtcccgatttttgttcgcaaacacaaaaaagaaagtgtttttcctgctatttagagcaaggagaagccaggaaaaaaatatgtaggtatttacataaaattggcagccctaataattagtaaacgcaatccaatgctttttaggacggacgattcgattcacaatttttaaggttttaatcaaagtgtgaattaggtatgtataaaaaaattcctaacatttcaaaaattcatcataatttttttgaaaacaataaaagaattgggttttatttatcaagaattttacaatgattattttattattcgtttttttgtaaatcttttcagcaactgaaaaacgaaattttataccgaagcttctgtatacaaccttaaaatttaggtgttgtctgattctgtttattatgaattttgcttgttgctgtcatttttcaagagttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcaggccgggtaccaataataattgtgagtcagcaaatgctcggctcaaacactcattgcaggactcgttgcgattgacgcgggtgcaggttcatttctgttactcttttctgttgaaactcgctctttgcccagcgcccggctcgtggtgccaagtgctcagcgagttattttcactgacaatttcgcaccaaaaaaaagaaccaaagcggat

SEQ ID NO: 25295 - DNA, 1710 bp, Heterodera glycines
  misc_feature (67)..(67): n is a, c, g, or t
  misc_feature (112)..(112): n is a, c, g, or t
  misc_feature (126)..(126): n is a, c, g, or t
  misc_feature (1518)..(1518): n is a, c, g, or t
  misc_feature (1613)..(1613): n is a, c, g, or t
attaatagtacattttttaaactataattatcaacactttaaaacaaaaaaaaaatttgcaaaagtntaggtatcattttctttgtacaaaaaaatttctttgacaataatntattactagggtgngagaaagtatggatttctatatttttctgagtgtttattttaggctaataagcatataatagtatttgtagtttagtttgaaggttctaggacatattttttatttccatattccatatttttgtccatatttcacagttttgtccatattttatccatatttcaacatttttttcggaaagtatctaaaaaaattcccaacttaatcaattttttcaattttcaaaatgcataatttcttaataatgccaaaaaaacgtcaaaataacactaaaacctcgagatgtatttgatctgtcaacaagagaaggaaaattattgattttttgattcaaaataaatgtttttatgtaattttacccatgaattttacataaatattttggcaatttcgtccatatttttagagttcttcgtccatataatccatatttttaatcgtttttgtaatccaggaaaagtttgagatgctttgatctgtctataagagaagaaaaaaagttaattattttattgaaataaatatttaaaatgagtctacttgtccatatttcctagaactctatttattacttatattaatgcataaaaaaatttttgatctaaatataattttaggataaacagcactttccccatatgttcaacaaatcatcaaactacgataaggtcctccagcacctccctccacgtgaagactactgtcctgatcaaatgaaaaaagccgatttacagaaatttgataattggtataactacaatcgcagtcaaccattcgacctcaaagagaaactacctgaatactgctgcaacgacgtccgaatcctcacccacgcccttgtagaactacgccgggaattcaaacaacttacacaaagggacggaaaacacggtggaatcgacattttgtggcaagccatgaccatcgccagtgcctgcgtcaaaaattttgccctcaatcatctgaagcctaactcacttgccatcgtccctgaaaaaggctatactccacaacagaatcaaagtgcactggccatcaaattttttgactggtactcccacatcaataacgtcaacattcaaacggcacactctcggtacggcgaatatgtctttaaacgcgaaggggaggtttaccaagtcgacggatacatcaaaggcacgaatggaaggcgggacaaaattattgaagttaatgggtgtgtttggcatgggtgtgagatatgtttcggtaatatggatgaggaatcgaggatgccgaacggaaagacgctgagggaaataagagagagggagaaaaggaagcacaaaacattgaggcgttacgttgacttggagttatatgggagcacgaaatcaatgaggagctgaggagaaacaagaagatgcggngatttttcaataattggaaggataattcacccattcgaatacgcgacgcctttcatggtgggaggactgatgttaaaaaactactgcatactgcnaaacctggacaaaaaatcagctacaaggacttcaccagcctctacccgtggaccaacttcacaacggactacccactaggacacccaaaaatcatca

SEQ ID NO: 25296 - DNA, 1749 bp, Heterodera glycines
  misc_feature (1743)..(1743): n is a, c, g, or t
attaatcacttaatttattggattctttttcctttccattaatttatttaatttaccattcaaaaattcatttagaatgtttttagcgacagaaggctgaattttgttggccatatttgtgtaaggaactactggcgaaatgattggcatttccatccaaatttgggcatggccaacttcgctttgctttctctcaaaccattctcgttcaggggaccaattcagaaatgcttcttctttggcataattaatttcttttaattgcaatggcattggccaaacccttaaatggattttgcgattaattcactcttgaatttcataatttcgcaatttcatcaattcggcacaacccaaacacttaccaaaacgaataaataaggaaaaacttttccaatagaaatgccaccgaagtttcgccggggaacagaaggaacactttggtgaccatggtgaggatcacttgcgaattaaagtgaccagcactttcgttgaacaatttcttttctaaattttcattgaatttaaatgcaaattttgtaattaaaacactttataaaaatatggcaaattttaatttaatttttaattaaaactaattaattattcttccgttttgtcgccaccttttgcccataattcgacaaatgcataaaatgttctaaacctcctcaaagtgcttccattcagcacattttcgtcgtccgtttggtgcaaaatatacaattcgtttggtgacaataagtgctcaagaagagccaagggaagcgaatgctctgaaatttaaaatggtaataaaagttaatggatttaaatttaattaaaataaaaatcaaagaaaaatacaatttacgttttattaatgtaaataataaactaaatgaataaattgaaaattaccccacaaaacattcagattttccatcaattgccaaatggtttttcgcttcatttccgcctttttcacttcctctttcattgaatcactttgtgccgttgtccgttcttcataacttaccattttttccaacttttccataattctcgcagctttatcatcatcatcccctaaaaaaattccataaaatgtttaatacttttattaatttttaaatgaattaattttattcctttttaaatttcataccaattgcaaaaagttcgtcctccaattccattcgaaatttctcatgcttttccctaccaattttctcatccttttcattggtataaacgtcaacaaaactttctttgagtaaagtaccaattttcttcccgaatttagtgagaattatttgaattaatttcccattgaaattaagcttcggcgggacttggcccatttgcggaatgacaataaaattcacattgaaatgattgcccataaattttatttccaattttggcacagtcaaatgattctttttcaaaaagttcaccaaaggattctgaagaaaatatttaaaaattttaacaatttttatttatttatttttcatattttttgccttgcaaaagatgcaataaattgaattgtcactgcataactttcctttggtcaaatcgcattgaaattgtcccaaaattttggcgtggatatcaaatccatgcggcacaaagcaaattgtgctcagtgatttgttatccggttttatgtaaaacattggtggcaattggaattggacatcaccagacttaaatgccagaaattaaattaattaaaaaattaattatttttcaaantttatt

SEQ ID NO: 25297 - DNA, 1533 bp, Heterodera glycines
gacttacattgtgccacaccgaatgggccagaatatacttctcggcaccgacatccaaccaggaacggagcagcacaaagtcacgactccgaaagggcggcagaccgccgactgaacacggcacggacaaatgccaacaataattattaatgagtaacaatttcccattccctacgggcgtaatagcaaatgtcgttgttcgggttcaaaaagccgacaggcaccgtcttcagcatgtatttgtcccactgtgatggtacggtagggaattacggcatcaaattgtttggtggaagaataaatgaaaaatcgattgattggactcacttttaaccggtagtcggtgtcctgtggaaaatgaattaattagcactgtaaaagcttaaaagagatgctcgagaatcatgtcgagaatggcatttctcaacatttgcttccattttcaaatgccaatttccgagcctcgcgcaaatggcaaaactcaaattcccgagcactgttcgcttcgttctcgggactcaattaactctcgggcattttcagcctttttctctcacctgaagcatgtcataacaaagtgcggccggcacatcggcgaattcgctgcgcgttttgatcatttgcagcgttgactgtttcccaccgttgccgccaccgctggcgtcgtccacgcggcgtgtccaaacgcgggtccgtttccgctcgtacgccaacgtccaatcagagtgcgcgtcacacaattctctgataaatgataacaaagaaaatcagtacaatgtttgcactgactatacagtaactgttggaccaactgataaaataaactgatcggtgtctaaaagttgtaaaaaacactcaaatggcaaaacattgagtgatcagcgataattaacgagactttgattgactctcgagccgaatctgggtggaatttgaatctgccgggctgtagccgccgtcctatcagcaaaagcgtttttagtccagttaagcaagtgaccagttagtctaacccgtattcaaattttgtcaccaacaaaatttcggataataaaagtaaaacaatgattgcctataggaaataacattggatttaagcgctaactttgcgtaacgaaaatcgacatcctccagcacttcaactgcattcagtcgcattgcatcggacggcagaatgccattgaccggaggaagggtaactgaatggaatggcattggcatgacattcttgatggcattttggggatgtggccaatcccgatccccggccattcatattgaaatttcaaattcttttcgctaattaccttttctcgttcccatcaatgcatgtgaacggacggacacaaaagcgcacctttgcacaattttaaaatcaattgaatttcaaattattgtccctaaaaatttggacaaattaaattttttgaaatacaataaaattcgaataaattaaattggcggaaggggcaaaaaaaggatggatgaacaaatgaatgaatgggaacaaagcggaagaagaggggggggggg

SEQ ID NO: 25298 - DNA, 2103 bp, Heterodera glycines
  misc_feature (27)..(27): n is a, c, g, or t
caacgcagaattaaagtacagactatnagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtggaaaaatttcggcaatcggaacttgttccgaaggctcaaaatattttggcaatcggaactccaaaggctcaaaaaattttggcaattggagtttttccgagggcttaaaaatttcggcaatcggaacttgttccgaaggctcaaaatattttggcaatcggaactccgaaggctcaaaaaatttcggcaatcggaatttatttcgagggctcaaaaaatttcgctaatcggcaatcggaaattggcattctgacatattcctggtaaaatattttttttaatagagagtattttgcatccaaaaaacttatttttttttctcagaaataaccaatttatgatatgaagcgccccactaatttcagggccctaattatgtaatgttatcaattaggagcaaattttaaaaaatattcttaaaagtgtttatatctcaagaaaattataaaaaaaatgaatgataccaatttcttctgaagattttgattcatttgaaatcccattaattaactgtagacaatttgtcaaaaagaatagactaattaagaagtggagcataattatctataaaaaaactgaggaaaacctattttaatagaataataatttttttattcgtatttgatcatatatattaaatattttttttttaattaaaaatatctctatacatttgctttatttttaatttataaaaattcaataattgattgtatagatatgaatacaattgtctcaaatcccatattatagaattaccaaaattatattttttgtgaaaattttattacgtcagattttattttatagaattattgtaaagtaaggggaataaattatacaagcaatattacatttttatgagaaatatagaaagtttaattaaatttatatttttttccatttttaaattaaatagacaataaaatctaacctaaaattttaaagaaatttgtagtgtcgaaatacataacgccagatttctgcggacttgatacgcttgtataagcacgaaaaatgcattttccgcttggtttgggggtgtttacgattacatttataatgcctatttttgcttattccggtgtttttgtgcctaatgtgcctattttcggaattcaaaaaaatcactaacaaaaatgcaataaaaacaaaaaatacacccctaagaaattgcacgaaaaattcagaataaacaccctcagaattggaaaatttttgcccaaaaactgaaccacaaaatttaattttttttttttcttaataaaaatttttggtttaaattttgtccttatttgaaaaaacctttaaaatatttgattagttcattacaaaaatttttatgtgttttgcaacctaaaaagccttaataaaaaaatttatttgcctatttttgtgcctatttgaggatttttgtgcct

SEQ ID NO: 25299 - DNA, 1843 bp, Heterodera glycines
tttggcaatatgtaaacttttctgaattagataactaaatgattagctaagataataaaaaggcaatttggcagcaataagaataatttatgtgggattataagcattggttagaatagtgcgaacgtaccggcagtgctaagtcaattcgggcaaagtaattggccatttgaagacaatttgacaaggttagcacacaataataagcagaaataaactggcggataaataacaacaaaagatttggtcaaattagcaatgaataagtagtttgaatttaaaattaagtgagggattcattaaaacaatcagttgatgagaattagttaatgaaatttgttacgcaattttatttaggtttgatatattagtaaattgaagcaagagatgaaatagaagtgttggggtaacttttgcagtaattacttcaaaatacagcagcaaatttaagtgttaggaaatgaatagtggtagtcaatttgacagaatgattgggaaattgacgtggcactcaaaaattctcctaatccgtaactgttcattttgattgggaagcgacatggctctcatagattctttctcctaatccgtaattgtcattttgttattttttaattccagcatgaactttgattttttcgattagactaggacctggattttctgtaacaaaaatcaaggaaaattaatatctaactgattgccgaaaatagaagatgagtaactaaatcccaaatgatgttttttgtccccaagtgtcgggtcccttcggagtcctaaaatgtgtgccacgggtgaaaatctattcaattttatatgtttcaagtttttcctgcggagccgaccattcgtattagaagccgaaaagagaattggaaaaatttttacgaaaatttcgaaattttataacaaatttcattaaaatggcctatttttccaggcttcactgattgcgatattgttatttaggaaaaagctgatagaacgacttgaaaatataattataagatttaatttttttacaaagtataaactttcgagttttattttttgtttaaattttcttgcttttttgaaatgtataaaaaatgttttaactttataatatttcacttaaaatttaaaaaatttcgaatagttttttacaaatttatgaatgtgttatgaatagggctgccaattttatgtaaatatatattttttcctggcttcttcatgctctaaatagtaggaaaaacactttcatttttctgtttccgaacaaaaatcgggacatttatttatccaccatttgtcccttttctgctacagtccatgtccattcttttcgacatcattcctgttgatcatcaacaaccacccttaattggacaatatctgaggcgcatttattttttgtttcttcgatttaacaatgaatttgttctatttttgcactacagtaaattatttatatctctctctctctttatccatacggtttcagctcctgctggtcattgtggtgcaacagcagggcttccgcccggcaattgtcatgaatgtgcccctgttgcgctggccgacacccccagcagttcaacaactcattttgcaacggatgaacaagtgatgccgggattttttgtacctttatctttcaaattttaattttatatgaattagtatttgaaaaacgaaaagtgccataggtccttgaaaagatcaaatttgttgtaaagaatgatcaatgtgtaacatgggcataattcaaaagctcgctatttttaaaacgatttctgctgggtaattaagcaattccaaaaaaaaaaagtttaaatatgaagcagtcaaaatttgagcg

SEQ ID NO: 25300 - DNA, 2471 bp, Heterodera glycines
  misc_feature (289)..(289): n is a, c, g, or t
  misc_feature (371)..(371): n is a, c, g, or t
  misc_feature (409)..(409): n is a, c, g, or t
tttatttttaaaaaatttcaacccttttttttaaattttctaaaaaatttaagaaaattcttcattcaaacattgaaatttttaaatttgattttttaaaaaccattttggcatttttagaaaaaatttgaaattttattggataaaaaatatatacaggatgttatgaaagatggacaaaacccaaacgcctttccattaagcatgtaaaaatccaatgaaaaataaacgagataaccgatgagaataacaaagatagaatcaacatacgcagtcgtgcacacaattntaacatcaaaaaaagcaattccaaaataaagcgagaccgctgcttcagcacggcatgaacgcgcagagtctgaatgaaatcncatgaattcggaaccgcaataaaaatgtaaattagatntaaggattcttaacccatgtgggttttgggaattggttttattaggtctttaaaaaacgaggttttttattttttaacaaaaggtaaaagaaaaataactaatcaaaattaatttattccaatcgcaaataaaatgagagaattgaaaattcgagtccgcccatttgaaattttttctggctacgggcccgcccctaaattgtctttttcgaaattccttaaattggaaaatttacacttttttcgttttttgtattttttattctgggtttggtttttaatggctcacctgctgaagaaaagcgtaagtcgataaacaaaattgttgtaaaaaaagagtatcgtgaattttattgctaaatttttacgtttgacgaaataatttaaagcgcaaaaaacaaaatttcaatagtttttgaagaaatcaaaaatatttcaaataacattttctttgtcaccaaaatccccaaactatatcattcattcaaaaataaacaagaaaaatcacagagttactgacagacatgctccattgaggaaagtttttgctttgaatgcattaaatgaaaattggtaactcatattggacataaaaataaaattcaggccattcattgatgagaaaatgtgaagaaaatgataaaggggcgggctccttttatttgaacaaaaattgtgagtgggagagagtaagaccatccgtaatctttaatctattttgagtatttgaaagcattttacaatttcttttcgttttttttaattctttttccttcttttccaacttcatttccaaaaaaacttatcccatatccactttattacaagtggcacccaacaaaactttttttacttttttttatccttctcgttaagtttttccaatttcgttttcctgcttccattttattttaaaaaatgcttttctctcccccctccccctcatccacttcatttttttaggaaagcaaacaaataatatttgagaaaaggaagcattttgattaatttgcacgactcacggaaaaataaatttgaggcaatggaatttggaaaacaatataaaatggcataatgatgaaaaatattaggggaatttttaaaaatttaaattaattaaaattaaaatttattatagaaattgtatttgtttaaaattgaataagcagttgatgaaatcaataacagagctaccgaattcatcgataaacgccaaacggggaaaacataggaaaagccgaagaataaaaagtaacaattaatttttttttaattgttttgttttttgggtggcacctcatagctgtctgattctaatcgatcggaaaagcaaaaaggggaaaaagcatttaaaatgccggggggcagggagggaggataaaagcggggggggggcggggggggggactgatattgctgctgtagtagtggaatcaattaaaaaaacactgaatgagcgtagggatgagcgccttggagccggaaagaggttggagatcgagaaataagaaaaatcccgataaatccgacagtccagagccaagactcttgcacatccctaggcttaaaaattagggtgggatagagtacgggaagtgagcaaggagaagtgggacaggagaggtggaggagacagatcgaatgacccgtccaagagttccgaactctctgaggcattgatgggagatgaggaggagacagagacagggattgaattgcaaatgactcccgcgggggttgggtagcggaggagaggggaggggaacagaaatttacaaatgacccccccccccgtcgagggattgaagggagggcgggagaggggagatagaaatgaaggggaatagagagaggagggaatgggagtggagggaagagagaagagaaccagagattgttgcaaatgaccccccacctggggttgagtggagagaagaaagcgggagcggaacacctttttgagggagaggagatggggaccaaaattgttgcaaatgaccccctcccacagaagggattgaggggagggcgagagagggcgggaggggagtggggggaggag

SEQ ID NO: 25301 - DNA, 1481 bp, Heterodera glycines
  misc_feature (73)..(73): n is a, c, g, or t
gtagtcggctttcctctctccaaatgctcgagactggcttttccccatataaagcgaattcttcagtcggctnttccttctcctcctccaccgactgctgctgtccatcatcttcgcccaacaaatccgtgccaatgccgtcgccgtcaatggcaccgtcagctgatgttttcggcacgaatttcggcttcatctcagacggcactttttctcccccgctttcctctacgtctctgtccctttcatgtttcccatgaactgtctcactttgtgttctttctctgcccatcatattcttgttgctggtgcttgtgtgggcgttcatctcctccgcctcctctgacgacgcgtcttcgcatggcaccaacgcgtgctgcgactcgcacgcgcgtatcgtacttaaaaaatgatgataaaataaatcaatgaattagtttattgattttttatcgaatcgatcaataatagggagctagctgtacattggcctctgcgcaggttcgcagttccgcccggccggcttgcgcgtgccgtgccacacgcagcgcaacagtcgcatctgtttgggtttgatcgggatcagtcattgaggtcgggaaggatcccatctgatcactttttatcggtatcccatctgctgatcactttttaagttttatctcacgcattatcctttccagggatatgtgccgatgccctcaaaatttcggcaatcggaattccgagcccaaaaatgtaggaaattcgcaatcagaaatcgacattccgacccatccctgatttacacagaaaattggtccagtaaaaaacaaattacagtagaccactgttacgatgtttttgattttttagtattcgaaaataaataaaaagatcaaatataaacttctgctgacagaatttcaactttaaattaaggattaaaatgtacggcacccatcataaaacaataccgtataactgacccattttccgggaatctacaagattgcttaaacaatttttggcatcaaatagagcaactgactggtgccataaatataaaaatacttttaaaatgccaaaaaatacaattttaaaacttgtccggacgacctgtacgcctccgtctccgcacattttgctgcagcgaccccacacggaggggcgccattctgcagaacaattcgctgcaaaatagcagagattaaaaattaaactgattacagggtgctaaatttgaatgcacccgagaaatttttgattttttaatgaaatttattaaaaaatatggaaaaaaattcccgaatttctagggtcccctaaattcgaggccaatccgcgcgcgacttcgtccgtccactgaccgttctcacactcgcgcttcagtttcggcctggcgcgccggtcgcacagtgccgccgcggtggccaatgtgccgttacggaacgcgcagcgaacatcgcgccgcatcttcaaacaattttaaaaatttattttta

SEQ ID NO: 25302 - DNA, 1469 bp, Heterodera glycines
aaaatgtaataaaaaagaatttaagaaaaaaaaaaagattattgtgaacaattggttaaatatttcaattttccctgctctttaatcaaaaaaaaaaaaatttaaaaaattatcttctgcggattgggtcaaaaattaatgaaaaatttaaaaaatgttgcttgtgcgcgctgcactgacccgacggcagatggtacttcaggtagtgcatgtacatggtcatcgaacatttggacgactcgaccggcctgaccagcagcatcgacttgcccaccgagcggacctggtcgcacagaatgcgtggcaccggcaatttggcggcgcaaattgcgtcgatgatggtgtccatggtcacctggaaaaaatattttctactcggccgaacatgtcctcgggagcaggttgattcccgcccggaaaattttcaaaaacccttagttgtttttgtaagaaatttccaaaaaacttttgaaaaatttttccaaaaaatcgatgaaaaattttcaaaccattatcttgaattcatgaaaaaatttagaagtttttggttccatttgtttgaatttttatgtttttaattgaattaattgttgaatcccaaaattgtaaattcttttttttttaaataaacacctccaattgcattgctctgattcgccgggtgttcagtttgatcagcacgaacaggtcgtccggcaaaaacacttgctccacatagtcactgatatcgcctaaaatttatattttgttttttgaaattttcagggcggaaatgctcctgaaatttacattttttgggaaaaattggaaaatggaaaacaaattttagctaatttaaaagggggggggggatttgatttaaaaaagctacccaatgtggtcttctcaatccgtgccttcacccgtcgtgccaacttttcgtcccgctcatcggccaatgccacggtgatgataggcgttgaaatggagcggaccgcgttgatgattctatacaaatttgtaattttttttaaaaatgccaaaaaaatatttttattttttgcttactcttttatcctgggcacgccttgggtgatgttcatggacgcaacgccagcaaagtgaaaggtttttagtgtcatctgagtggagggttcaccttaaaagtgaaaaatgcttttaaagatgggcgcacaacgacaaaaattataggacaaaaaaacctatccggatgtaaatgtgtaatggaaaaaagttgggttggctatttttgggttttgttgcattttgttaaaaaattttatcccctatggagcggaagaacaggtcgcgcccctccaagaaattgaaatttaccaaaacctaagaatttttcaagacaccgaatttaaaaaaaactttttaaaacgccgaaaaagttgtgatcccggagtttttaagaatcttagaagtttaacaatttatgagaactgtttttgttatatttcgag

SEQ ID NO: 25303 - DNA, 2027 bp, Heterodera glycines
cagataattgtcggatggtccgtggccaaattcggtctgttcggaaccaaaccgcagcacatccaaagtccgctgatcaattatttgggcgtactgatcaccctgatcagtggagtgatgttcgtcttcgtttacaacagtggccagcaaaaagaaaaatcggcagcgaataatggccacggggatggcgacgatgaagcagctgcagagcgtgccattcaaaatgatgggcgaagtgcttctgtgccgttgcgcgacgatgggtgtacaaggccaacggggtgggcaatccatcggtgtgacatgccattcaaattaatcggaggaggtcaatcaataaaatgccgcaattcaaagccactaattaccccccccccccccccgcctttttcatcgcgaaatggcacaacacaaaatatattgtaattacagagatccaccgtatgggagtgtgagcagcagaaatgaaaattgttcaacgacggcggaagggcacagcgtcggacggaggacaacaacgaccgttgggacggaagaaaaattggcaaatggccaacccaaaaaagggcagagctttttcaccgggaaaggccgaaaagtgttgtaagaattgtgcattttttgaatttcttggcgtttttcactgcttcttcatttgtcagttttgtttcgctcgccgtttgtttgggctttctccacggacttatgctaacaccgattgtttatgtgcaggacaatgaccaaaacgcatccgaaaatggtaaaatttgaaggaaattgaaaagagcctataaaaaatgccaaaaaattggaattacagtactaattttttaagtacgttttatgatcagtagagactggcgcgggacgtgataccttgcgggaatttgagagcccagtccgcaatcccgtatttttggcactctggacaaatttttttaattcccgacagcgcctagaattttcctggcggcgcctataggtaccaccggctggcttcgccctccattcaaattttttgtaggaggcgcgacgaaaaattaaatggaaaaaaataaagatttttcccaggaaaaattatattaaatatgtatatttttaggattttatccttacattccttctttttaccttattttaataaaaagcgctacaaaattagtagtatttaatttttgaaggttttttttatttaattcaaaagtttttcaaagtttcaaaaatcccacaattctcgcgagggatcccacaaatctgaaatgcgagatttgcgggataaatccggcgcgggattccgtcacaaaattgtttttagttccaatcccgcaacgggatccacaaatctgaaatttccggtctctaatgatcatttccatcacagataattattttcaaaaaactttttcggattttagcttttgaatacttttaaatcttctcaaaacaaattttttttttttgctatgaatttgcttcagtgctcgactttgtgttctcgcatttctgcgccgtcttctttttctccaccctttattttgtgctctattcgctgttccgtcgcgggcgcccctttgtccattcgtcgctggtgagatgaaattgcgcgttaattttgagattaatgctcgagaggcttgatctcgagtttagactcgagaaaagctgtgggcttatcgcgaatctcggggtcttgaaagaattgaagtgtaaggtattgggttctcggtgtccactctcggggtcaaaggtcagccgcccgtctcggactttgcaaagcccaagtcattcattgtccgccttttcaattctaatcggcacgtgctcaggtgcttccgtcggtcgcctatgggctgctttggtcggtgggaatgacccttttcatcgtgtccaaccgcgtcctctcccaaccgatcagttttccggtcactgttcgggtcagtgcttttttgagtggtgccaaaattgcgatcttttctttggcactgccattatctctttcctttagttgcctgccattattggtgccg

SEQ ID NO: 25304 - DNA, 1560 bp, Heterodera glycines
  misc_feature (45)..(45): n is a, c, g, or t
  misc_feature (56)..(56): n is a, c, g, or t
gcgcccgttttttaaaatttgtgagctcagacgggcgcttcgcgnccgttttttanacttgtgagatcggacgggcgcttcgcgcccgttttttaaatttgtgagctcagacgggcgcttcgcgcccgtttttaaatttatttgggccttttcggccgcttcgcggcatcagacgggcgcttcgcgcccgttttttaaacttgttgagatcggacgtgcgcttcgcgcccgtttttcatattttgttttctttgacgggcgctccgcgcccgttttttaaatttgttaagctcagacgggcgcttcgcgcccgttttaaaatttagttgggccttttcggccgcttcgcggcctcagaaagaggtacaaaagtgataaaagaggtacaacagtgatcagaagaggtacaacagtgatcagaagaggtacaactgtgattagaagaggtacaactgtgattagaagaggtacaacagtaattagaagaagtacaaaagtgattagaagaggtacaaaagtgattagaagaggtacaaaagtgattagaagaggtacaaaagtgattagaggaggtacaaaagtgattagaagaggtacaacagtaattagaagaggtacaaaagtgattagatgaggtgcaacagtgattagaagaggttcaacagtgattagaagaggtacaaaagtgatttaataaatttttaaaaataaaataaatttccttttattaattaaaaagagtgtttgaaaagtacaaggatttaatatttatttaaattgaaattaatattacaaattctaatttaaaaatacaggagttctttaataaaagtaaaacagacacggagactcagttaatttttttttcccacttcagtaccaggcgaataactcattagggtttgacctcagcgcagggtggccagcagacttattgtagagttcaataagctcgatttttccagattttaaaatttcgaaaattttcaaaatttttcgagttaggcctaaaaaacggttttcgggttttttaattttatgattttttaacgaattttcacagaaaaacggagaccacttttaagcaacagtttttcgagctctatcgactggtatttttttcggaaaaatttcgattttttcccggaaagaaaaaaaatttggcctgagcgggacatttgagtcccgggtccataactcgttaggggttgattttatcgaaaaaacgccttagggcaaaattgtagagcttttaaaatgctatcgaatagtgtattatatggccggaaattttcaaaaattttcgagctaggccccctagaaattttaaaaattcataacaaatcgaagggttgatcaattttacagaaataaagccttaaaaatagataaaaatcagggagaattttatggactttatttggaatttctatcttaaaaaggaaaaaaagtattccagaatttctggaaattttccatttttcagaaaaaaatttctaactcgggtctgaaaaagtatactgtaaaagtaaaatactacaaaaatccacaaattttttt

SEQ ID NO: 25305 - DNA, 2090 bp, Heterodera glycines
  misc_feature (28)..(28): n is a, c, g, or t
  misc_feature (56)..(57): n is a, c, g, or t
  misc_feature (71)..(71): n is a, c, g, or t
  misc_feature (1886)..(1886): n is a, c, g, or t
  misc_feature (1893)..(1893): n is a, c, g, or t
  misc_feature (1924)..(1925): n is a, c, g, or t
  misc_feature (1987)..(1987): n is a, c, g, or t
ctgtgtgtgattgccatctctgatgacncaatggattaagtcttcgggtcttctcnnccgcttttcacccnccattttaagctcatcctcaatagtttcgcattcaaattaataaaataattttgaagcaaatttgttgcaatttctccgtgtttttcatatgaaaagcttaaaagcccacaaagtccggtgcttttgtatgaaaaatgtcggtgaatttagtaccaaaaaagttttttcctttttcctccatttttttttgtccttttccccgcggcgcataatttcttctccgatcacaaaaaaaggcgcccgtccgtccgccgtccgctgcattttgcccgaggcgaaatgagggcggagtaaaaaaggtccgccccccttttttttacaaatgcgcatctgttgccccccattaataaagtgcccttcccccgcttttacctcttttgccattttccgaccgtcgcaatttttgccgaccaatgcattcattcgtttgtacagtaattccttcttaccattttcagtttaaatttatttgctactctctctcataataaattctttgtcaaattttaatgcaaagatattttctgtgattttgtacgtatgagcccataaatatcagtgatttccttttttaaatgacaaatttatttcgcgttaaaatgccgtgccaaatttggctagagattggacgggcccgggggcccggcaggcttttaccgggccgcccggtctcgtttttttggacaaacaaccgggcccggcgggaggcccgtttaaacgggggctatttttacggaccgcccggctcggtcaattgtgtaagcccgtcctggtactttcaaaattcaaagtctctattacccagttggtgtgctttaaaatgatattattaaatttatgctttgaattggaaattttctagaaaagccggggacaaaggaaaagccacccaaaagagggaccaaccaacagcagaaggaccagacgaaacttgttggtttttgactaaaaaatgtttgaatttggctccaaagttgatcactatcgccccaccattcccagcccatccttggcacagtttaatggcagtgttatggtcccagggtttaggatctctccccctgggaccgtccctgctagtttcgttttttaatactaaagaaatattttaaattagatataattagtgttttaatgtttccaatcattcgtattttttcctaaaaagtaaatttgagtattaaatatatttgtgtatttatttgattaaatttttgaattactcccgcccgtaagaaatgacgggatttttacgggggtcccggaaaacttttgactcccgcaatttttcaccggtacctattaaataaaattattttggcatcgaatgagcttccaatatttggcaaaattcgtataattttaatttttgatcacattttgaggtttttagtcgcttccaatagcaaattccctccctttcgaccatttaaccaatttcctccaataagcaattggccgcgccgcgggggcgggggagttacagtaagcaaccgaagacagtgaaaagcgagcgaaacaatcgcacggtttttatatattacctacttttaattcatttaaaatgtatttcataaaattcttagtttatttgcaatattaaaattattcacacaaaaagaaaatgacacttaagttgttggacaatttgatatgaaagaggataaaatcacaatttatgtgccgctttttacattcggaaaacgccgaatttcgtttccgccgcctttccttcccttttttgtgcggaaagtgtcgcctgaagggcgaggccaagcacacggcgagtgtccacgggatcaatcacacctgancaatgangggggtactccgtgaaaaatgcttaatttcnnccttttccgcgttttaaaaacggagtttcgtcgactgtttccccccgggcattttcctattntcatcacaaatgtccaacgtgaagattctgctggaccgatggatcccaacctggggtctttttcgggcggttttaaaatctggaaaaccatacaaaataattt

SEQ ID NO: 25306 - DNA, 2308 bp, Heterodera glycines
  misc_feature (28)..(28): n is a, c, g, or t
tttcttttttttgtaattctcaatctcntggtaaaaaaaatatattggataaaattagctcctttttattgatatgataacaattttcgtcgtttattgaggtggaaaatgaataaaaagcaccataaaatttttattaaaaaattcacttaaagaatgatatgaaaaaagaacgatgtttttttgttttgtgataatttatttttcatatttttttgtaattttttatttttacatttttttaattcctaacaaaaagtcacctttgcttgtagatgaatgagctgtaaatgaacaagtgttgtcccgttacattctcctcttttgccatatttgattttgattggcgcaatgccaaccaaatgcgcctgtactgatcccattggagcaaatacaaaaacagaaaataatacaatacggtcaatggaattcttttacaacaatttttgatgtaagagaaagccaaatttacagataatattagcatgatgcttcaaataaatttaaaataattatctgctttggaataaaaacaaatgaacgttgccctaatgtccttatttctaagattttcccttatttctgagatttgaccttatttctaatgtttgtccccatttctgagtttccttatttttaagatgtgtccttattgctaagatttgcccatatttctgagaaatgtccttatttggggtgtccaatcttagaaatgtaacaatgtttctgaatttgtcctatcgagtgttgtagtgacttaaaaattttaatatgagagtccttggactgaaatacacaaaaatttaattgtataaaaatcttgcaaatgaaaatatgaaataacatgtgggtctgagcgcatccattcgtcgaattatcggaatttaaatcttttagcgatcaattcctcgataaactcaattaagtacaatcccactgttacataagtttactattgattaaataacattaaaaaaaataaattaaactttactgtaaactagagaccggaaatttcaaatttgcggatcccgctgcgggatgggaatccaaaattttttgcgggacgggatcccacgggattaatcccgcaaatcccgcaatcccgcaaatcctgcatttaaaatttgcgagatcccgcgcgggattgcgggattttggataattcgaaaaatttcaattaaatttcaaaaaatttccaaaaatcaaaaaatacctgaagtttttaaaaataaatttttaggggctggcgggatgcattaaaaggggcgaccaagatttttcgaatggatcagacggtaaaaagagatcaggaatcaaatctgttaatggtccaaaaatttgactattttttgcttttcaaaacccttttttcggcgcaattttttcaaaactaggaacaaaggggtccggcggtgccgataggcgccgccggaatttttttttttattttttttgaaaattttgtcaatttcttaactgattttgtccaaaaaatgaccaaatgtcgcactttttgactcgtatctacaggattaataagtaaaagccgatccgacgggccgatagacgccgccgggaaatttttttgcaaatcctagatgaaatttgagatgaaaattgaatttattttgattgattttattataaatttattcaaaaattttggcattccgtcttttaaaattttcaaagaatgtatgcggatcctgccggatcccgcacaaaaatcaaatttgcggatcctgttgcaggattggaattcaaaattttttgccggaccggatccggccggattaatcctacaaatcctgcattttccaaaaatgcaggattgcggactgggatcctgcaaaatcctgcacaggatccggtcctgctccgggctctagtatcgggtattgttgcgcgaaacgtttcaattttggacagctagcagggaaatccaaaaaattttgggttgttaattagggatctgtttaccaatcccgcaatttcgttggattagggatgaacaatcagccccaattttaacactggtacagtagtcatggttaaaagagttgtacatccattcatccttcattaatgattaatgatattgttgaaaaaataaaataaagtttttgcattcacaaaaaaatatggggtttcaaatgatacagaccacagggcaagagatgatttggctccataattctaatcgaatttaggtatataattaaaattaaaaaatatataaaaataaaagtgcatgcatttttctaaaggccacaaaaattttttggatacatttcaaaaatttagt

SEQ ID NO: 25307 - DNA, 926 bp, Heterodera glycines
agggttctccctggcagtccgctcacataactctcttgggagttaggagcatttttcatggtattttcaagaaaattgtgcaatgtgggcgatcccggatcattttagccagtttacaaaccaaacactcatagtaaaaaattatttcgttagaatacgagaaatagtttgatacgaaacgctgtttattaatttgcatatatctgtgcgaaaattacagatccagaaaaaatcagctataccattcgaaagctgctttcaggcgctctcagaaatcagtaaatcggctcctattcatgcactagcatttgacatatatacacgtgtctttctccatatactaggcgcgattcgcgcccaaacgcgtgggtcggccgaaaaaaaagaattttggcgaacaatttttgtgaaaatttttcatttcataaaggtatattctctgaatttttttagatcatttcttaggggtgtatttttccgatttttttgaattttggaatttttcggaaaaaaaacgtcaaaaagggcaccaaatcgctaaatctttgtggtttttttagaatcaaggagcaaacacatgttttttgactgccttttctatcattttccaaactttagtacaccattcaatagagcttcaatagctttacaatttagttcagaggtgatctttagctttttctgttaataaaaatgttttattgctttttttggaaaaaatataaaaattcaaaaaaaaccgaaaccgaaacgatataccgaaaatttttcttcggtttttttcggttcggtttttttcggttttttaaccgaaaccgttcgaccgagaattttttgagtttttcggtttttttcggtttcggttttttttcggtttttaaccgaaaccgttcgaccgaccctcttgtccggtctctaaagaaaat

SEQ ID NO: 25308 - DNA, 1862 bp, Heterodera glycines
caatttaaaagttgcattcacctgtttctgcttggcccgtctgaatgccaacagttcgtcttgaatgccaacaaaaaagtttgtgccgactgctttgtccaatgcctttcgcttcgtttggtatttcgcaattttggccaaacattggcccctcagttcggcaccgtcaattggctcaatggcgaaactgccctcgcattcggcatccttaaacacaacatgaacattggggaaattaagaaattggtgggcctcgagtcggaattggtctcacccaattcgaaaagccgggaatcattttttgtaaatttatcgtgcccaggtttttccacacctaaaaaattagaaccccccagatttttaattctaacaatgatcccttcttggataaattttttgtaaatttattggaattcactcatccgccgcggcgattggcaccgccggaaaatatttttttcaaaattaatttgttgaaaaaaattcagcgattctttggaaaagctaaaaaacggggtcatggcagttcgcacaatgggcagttcgtacaaaggcagttcgtacaatttgcagttcgtacaataggcagttcgtacaatgggcagttcgtataataggcagttcgtacaatggagtttcgtacaaaagccggttcgtacaacgtttcaattttgcgtttcgtacaataatcaaattaaaaaaaaataagtgatagtgacacataatttcatcaaaataacaaaaataaagcaaattataaataagtaatgagctaataattataaaaataacaatagtaataaccaaaacaataataattcattcgagctttttcggagaatttgcatcacttcaactgaacttggccaatgaagttttcgacaaactttaaatttacataacattttattccattccccaatatttttttgcagaaaggggttagcccgtcattattttttactaaataagaatttttttgtacgaaacgccaaattgaaacgttcgttgtacgaaccggcttttatacgaaacaccattgtacgtaactccattgtgcgaaactcctattgtacgaactgctattgacccggatgtcctcatttacgcctcacaaaaaaaaacactgattgattacagcagtccaacgtctttttggggaaattggcgctgacccttggcgagttggttggatgtgcggcccattcgccctccattctctccattttgaggtgactgttcggtcctctccctcccctcccttccccgtctctccattttcccttttctttcttactccctcagctcctccttcgcttggctgtccgtcctccgtcgtttcggtgcccttcgccaccctttcgtccgccactgttccatctgcgcttatttggccatttgtgatacattttggccatcgtcggaagtgctgcgcgaacatttcactgacgaactaagagattgcagagaatggttgggagagatggcgacggaatttgtacttggcgaaatggacgaaacaattcgacaatccatcggaattttgtccgttaaaattgacaacattctcagactgatttaacttttgtttaatccaattaataaatggaaataaaatttcttcatttatgaaacaaaaaaccttactattcattttggtgaaatttctttaatttatttctaattttaaattttataaattatatttccgcctttacagaccctttatctcccaatttccatgcacttcaaattggccttcgtctccattttgctcattcatttcggtgctttttctgtcaaggttatgccacaaaaccgtggccatggccagcagaagcaattaatcgtcgttttctttg

SEQ ID NO: 25309 - DNA, 1700 bp, Heterodera glycines
  misc_feature (1582)..(1582): n is a, c, g, or t
  misc_feature (1614)..(1614): n is a, c, g, or t
aggtcaatgggcccggctaatcaattaatgccatttttccaaagaaaaaattccctttctgtcgtgggaggatcccttttagccggcacgcgcgtcatcatcccaccgctgcttcgacaaagagtgctgacaacacttcactttgctcatcctggcattgtgagaatgaaagagttggcccgtcgacatgtattttggcctggtcttgacaaggacattgagaacatggtcgaacaatgtaaagactgccaaaattctgcaaaaatgccacgtaaggcaccgcttcacccatggcctgtgccggatggagtttttgacagaatccatgtcgattttgccggtccttgtcaggatggtcgaacttatttgattttagtggatgcaaaatcaaaatggccagaaatcactcaaatgatttcaacaaatgcggccagtacaatcgatattttaaacaaaactttccacagatatggttttcccaaggaaatggtcagcgacaatggtcccccattttcatcgtttgaattccgccgtttttgtgaacaccatggaatcaagcatagtttttcaccgccgtaccaaccgcattgcaacggtttggctgaacggatggtagacacttttaagcgtcaagctaaaaaggagggcacaaacaaaaatcaaaattggatttcagaatttttgttttcctacaggacaaatccgagtcaggttttaaacggttttgctcctgccaaattgttcttgggtcgcatgccacgaacatcactttcattgttggcaccgaaaaacgattcaagtccgaacaagatcaatgtctaccaaagcaagatgaaacgacagtatgatcagcaccatgacacttctgatcgacaattcaaaattggtgacacaattttaacactcaattatggtcggtatggtaagccatcatggcttgaaggtaaaattgttgatggtaagaatttggtctggaaggtcaaaatccattctttgggtattgtggttaatcgccacataaatcaaattcggtcatttattcccaaaatcccaatttcaaaagattttgtcgaagagcagagaccaaattcgccaacaaagaccccgacgacaaagaacaatcagcctcatggttcgcatgacgagcaaccttccgttttggcacgtcctcagcgtgaacgacgcccgccgaaacgattgaatatcggcccaaatgctggcgctcgatatgaaattgagggataatttcatttaaagggggagatgttgtggatttgacaatttaaatatattttattatttattgacacgattccctgtgtcatcacttggaaatgtttatttaatattgaccctttcactcattcgggtcacttgccgttctctccttcatttttcatttcattgattgtctttcctccgtcatttatttatttgttatttatcatttatttttctgtttgtctttgctttaataaagttgtaagcaaaagacataacataaatgacgtcttcaattataaactttaagtttttcaaaaaaagatcttagattttctataagagaaaattcaagaattanattttagaaaattttcatagcgatttttctanatttttataataaatattttttttttgcggcgctttttatcaaaaaaattcgggaatatgggggtccggcagtgccgatatgcgcc

SEQ ID NO: 25310 - DNA, 1906 bp, Heterodera glycines
aaaacttatgcaaaaaaaaaacgtcgattttcataacagattttcccgttaaatttataagaaaaacataatttttttttaattggcgaaatattctacatttttgaaaaatttttcttccactttcccaaatttacatgaaaatgtattcacattcctaccattaaaacttttgccagtcagttacggtagcgccggtactacaaaaaccggtaccggtaggaaaaaacgctaattatcgaccggtaccggaacttataccatgcaactcaagtaatgatagggcttacatttttagggtttacctattttcattagctccctgtgacctgaaacgcacgaaaaaaatgtttgcttttttggtggttgtaagcgactttttgagttattagcatcattttaaggtttttattttttcgaaacaaaaaaaaactaaaaaattttggaaattatttagcgttttgccaaaaatttatgaaaacgatgcaatcgaaacggaaatacaccgctaagaatcgagcccagttcagaaaaaataaacaaaatatacgaataaaatgcaataaaaacagcaaaatactagtgatgctcgagagtctcggtctcgagtctcggtctcgggttttcaagtctcggtctcgattttcgagactcgagaccgagacttttttacacccctaatgattgttggcctttggtaaacttctatttttataaattttaggttcttttttgttcaaatttgttaatatatgcgtggtccagcgggttgtgttcttggttttgttccttatttttgcgttggatcagttcccctccaagtattattttttcttctcatttttcaaaattaatgttttttttcgatgggagttcaaacacaattttaacaattaaaaacgtaaaaatgtcatttttggacaaaatccgttaacaaattgcagtaaaattttaaaaaattttcccggcggcgcctatcggcaccgccggacccctgttcccgaaaattttttttgaaaaagagcaccacaaaaaatggtgtaaaaaagtcaatcatatgaaaagaaaaatgtatggtagcttaaataaggaaaaaaacaaaaatttttgagaaaaaaactcaaaagattgatttttttcgatttttaagtgtgtaagaaaaaatttttgaaaaaagtctcgggtatcgggtttttttggtctcggtctcggggttttgggtctcggtctcgagtctcggggtcgagtctcggtctcggtctcgagtctcgagtctcgggaaatttttggtctcgagcatcactactggattgatcacagtctcgcggcctttgcccgtgccatttgccaaatgtgccgttccgtttcgtttttggctttttcttttgtgtgtttttctttaatttttttgtctttcaatgcgttcttatttttgtttccttaattaaaatcgtcctcccttgagaattcctcccaattccattaatatttcttctcctcttcttctgctaaacatcaaccgttttcggcttctttattggcttttctcccccaattatccctttcctccgtttttcaattccttttggaaattcgctatggccaaaattatctgacagcatctcatttattagcatgaaagtgcttttttcccattggcatttgttttgctattggcatttgcttttataattggttggctttgtatttcctttcctctcgtttctttggttggctttgtatttcctttcctctcgtttctttggttggctttgtatttcctttcctctcgtttctttggttggctttgtatttcctttcctctcgtttctttggttggctttgtatttcctttcctctcgtatcgttggttggctttgtatttcctttcctctcgtttctttgg

SEQ ID NO: 25311 - DNA, 1100 bp, Heterodera glycines
caaaaatacattattgtggtttttttaaatttattattcataaaaaaattctttaaaaaaagttgtgcggaaacttatgttacaccctaagtatttatgaaaattaaaaaggcatacccgccggaccctccaccgaacttaaagtctataaaatggctgaaagttgaccaaaatttgaccaataacgacaaattcacaaaccttcgtacgaaaacgcttttttgggagagacatctgagaaaaaaagaacaaaaacaaattaagaaaaaaatgaaaaattcaatggacttgagaaaaacggcctcgcaattgtcagcaaatttcaacgaaacctataaattatgaaagtgtaaatcattgtaagataagatttaactgttgtacaaatctttcctcctttgatccaattgtaaacggattttgatcacttttaggtcattcattccccaaaatccaactgatcagtcgttggcagtgccaatttgacccttttctgtccctttgtgtgcccacccctttgccaatgtgcattcgtgcccgttccgatgcttcacttaaagtgccattttctttcattacaaagtggtaaaacctccggtgaacattcgcaagtgcgcccaaacaaaagcgagcggacaaagcgccggaagggtccattccgccgtcaattgcaacctgaaattgaaagaattaaatattgtccgatgaaacaaattaacatttatgcaatggcacctctttgatttgccatggcactttgaacagttcgcccgactgagtatctaactcaaaataagcgatggaacaccaatggtcgggcaattctgaaaaagaaccatccgttgacagtgaatgttctcaaaggcacaattaaaagatactccgaactgaagggagttgaagcagttcgaaattgtcttcaatgaaagaaatgtttaacggcaaaagaatcattggtcagaaaatacaatgagtgaaccgatgcgtttgactttgggcagtcgtattttggtgacacatctgaaaaaagatggtcaaattaatttagaaaaagcatttaaaaagccttgccattcaaactctacctgctgctgaaacgg

SEQ ID NO: 25312 - DNA, 1399 bp, Heterodera glycines
ggtcccgacttttctggtcccggtcccggtttttgtcaaatttcccggtccgctcaactctagtttattttcaaaaaaattttttgtcatagcaaaaaatttgttaaattttataacaataataattaattttcattacttttgtacaattttcattttatttttttattgttttttcttttttaaaattttcattatttttactcccattttttaatatttgcacaactttaaaaaacagagatatgccaacagaaaaaaaaagttcaaatttttaacggaatcttttggcggaaacgaaccaaaaaattgacatcttccaaactgagcccatcaaatcaataaaaattcactgctaaacaaatgaaaattttttatgtctgccaacactttccgttcatcgaaaatgaaaacggtgcaaaaaatttccgtataaaagggtaattaaattgtcatttctcagcatattaaaaataaaacttttaaatttgaaatttgattatagtaaatgcattctttgatcattctcggcattgcttttgccaatttggcaccaaatgcttttggccagcaatggccaaaagcaacaagtgatgaaacggtttcggcaaccatcaaagtgtcgggcggcaccaaagactttggctacaaaagattgaccgcctcttcggcgttgggcaccggtgatcagtcggagggccaaaaagcgctgatccgtgccgaaaagggcgcagtgatcaaaaatttgatcatcggccaaaacggggcggacggcattcactgctatgacgggtgcacgctgcaaaatgtgtggtgggagaaggtgggcgaagacgcggccactttccggagcagcagcggatgcaaggagtacaattttctggtgacgggcggcggtgtgaaaaatgccaaggacaaagtgttccaaatgaacggcggtggcacgttgacgatcaaagattttgtggtaatctacacatatatttaataaccaaaaatgcgtggcaattaatcccggatttaaattggatatctatgccatggatgcaatggaatataattgaattttttaaaatattttagaccattgtggtcgaattcccattcaggcaaaatccatcttttccccgtgttctgtcaattatgtaattatttattccctaattaaaattgccttcctttcatggccgaaaacattggcaaattggtgcgttcgtgtggcaactgcaaatcgcaatggccaaaagcgcaaattcgtggtggagaatgtcaaagtgacgggacttgaaaacgctgttgtgcggcatcaacgaaaattacggcgacgtggcgaccattaaaaatgtgcagatcagcgggtctaagaaagtgtgtgccgaattccaagggaacatcagca

SEQ ID NO: 25313 - DNA, 1738 bp, Heterodera glycines
  misc_feature (1651)..(1651): n is a, c, g, or t
cccatacccattgagtgctctgaaaaacaggtggtaattacagtactttgtactttcccatctccattgagtacagtacatagacggtaattacagtgcctagtgaaaatttgccgtgccattcaaaaaaaaattcatcatattttcaggcctccattgttggccatgtccgattgatggtgatgagggaatggccaactgcttctactgggggtacaatttttaattgaatttcgaagatttttttttgcgggggggggggcggcggaaaacccctaaatttgggttgaattttaattttacgaattcaaagaattataaggaagaagctggctgggcggttaaaacgcggaaagcgggggttgataagatccataaaagaaagggcggatgtgcctcggtagcttaatggtagagctgcccacggaaagggggcatgagtgggttcgattcccacccgaggtttaacattttgcccatttcttattgaatgccgccgcgcaaaaagcgccgccgaaaattttctcgtaaatttggatgggccattaaattggtaatcaattccagaactgttttctgcccattctccggcgacatcattggtcggaagcaatgagtcgagcagcaggggaaaaggttaaagaaaggaaagaaatggttggcaaactgataaaattgcttggcatcgggcgggaatcgaacccacgcgcccatccaatccgttggcaaaccctgccactgagccaccgaatccctggcgcaattttgtgccaaaaattacacttcatttatcttcagaaactttgccctacgatgtgactttgctcaaaatggattttgagcctgactttggctgcacaatcatatcgcatagccaccgttacattggtcagtttttcaatggaaatgagacgaaaaaagcgcgaaattgcacaatgcctaattaatggcaattaaatttgggccatttttttggcacattttaaatttgggcattttggcacactttctcttcagctgatattgtgcccggaagcgctgcgcaccgttcggcccgtctccgtgtgggcgattgtgtagtggcggtcaatgggcactctgttgccagcatgggccaccaagtcggggcaattaaaattaattaaaaaaccaattagcgaactaattgggcgagcaatggcaccgtccaattcagtcccataaacgaaatgaccaacaggaagcgattttgccatcttttgttgatttagcatgtgaaaataataaaaatacgacgccattttggagttgaattctttaaaaaattcgacaaaatttccaattttttttcgaacggtccattagaaaaatttttttttaataaattgactcaaaaaaaaatgcaaaatacggtccttaaaaaacaatatttgttaaaaattggtttttttgagtgatttccatggcaaacaaaaaatttctttggtattttttggcatcatttccaaaatgcatgccatcatttgtaacacccttttgacatctgatttcgcttccctggggcaaagccatcgaaaaaatgttttctcgagacgatactcgagaccaagtcttgctaaagcagtactcatttaaaagggttggcgcttgactcaaaaatgggattaatttntggagtgggtattcgagtgttttttggcacatttatggggctcaaatggcacgctaattagtcgcgcatggaaagcgtagaatttta

SEQ ID NO: 25314 - DNA, 1066 bp, Heterodera glycines
  misc_feature (218)..(218): n is a, c, g, or t
tgaacaaaacatcatcatttgaaacattcaagatttcgatttatattcgagttcgggttagggattagaaattagtcaaaatacatgtcagattcgtgattagcgacctttaaaaccccggataaaaaattatcatggttttttatcgtaaaaaaattttgcaaaacaaaagggtccccccttttgtttcaaaaaggcccacttttaaagtagcgccnaagtaatatcacgattttttatttcaaaaaattttgcaaaacaaaagggtttgtatttagatatagattaaaaattcacaaattttcatctatttgacgaaaataagcgcgatggttgtttcgaaagtcacacaacaaaacaacgccagtgaagatgaattggagttgcacaatgcctggcctcaatattccccagccgataaagttctccccacacgctttctacaaattattagactcatcaacaacaaattcaaagagcgtttacccgcctggcaaatcattgaacaacatccgcaacacttcacccatttttttatgcaaattcttcaaatggcactcgacgaaaaacttccatttgtgcaccaaatcgacattatcactttcttatgcaattgttttaattctttggaagtcgatttggtgtgccgtgaagctggtaaactttgttcaatgcccatttggataaatctactcaaggttggcggatttcaactattttttgaattcataaatcaccccaaatcagagacaaagagatttcttgctggagcaaaatccaaaaatgaaaaagatttggacaaagatggaacagaaatttgccaaattaccttctgatgattttgacgctttggactttaataggaggtttttatggcggttgcttcaaaggctaaagcggacggttgacttcatcgacgatgagagacaaagtcaaaacaattaaagaaccttaacaatctcttcttttagaagccgacattgatgctgtgagctattgtgaacggcttgtttctctttttattgacttagaagcgcagcttacgactcggtaaataactgggggc

SEQ ID NO: 25315 - DNA, 1536 bp, Heterodera glycines
atttttaagaatgttgcaatggacagacagaaaagaggaagaaaatgattcgtttttaatcattaacatttacgtacatataaatgaatatattggagctcaccaagaattaatccgggccgggcgccgttttcgtacaagaggatattttaaaaaaataaatgaaacaattgcatttaaatcatatatactactaatgttaattatgctttttaaggttttgacccaattaggtattaataactacaaaaagtaaataaaagattacgatttttgaaattattttggcaactaaattagaccagcttggtatcattcgaaagctcttgatgaggaggagctttttcgtagcaaatgttaaacgattttaaaaaaagataagagcgttcgaaaatttgtttttcttctaactcatgaataaatgcataagcaagcaaaaaatggctgtattacgatgcgttatataccgtatttgctctttttatatgccatggtatattatttttcaacctcctcagaaaggggtatataattggagaccggcagattaatggagactggcacataaaaagagcaaatacggtagatggtaggtcagatcattgttaattaattttgctgatcagatcgcttttaaggacctgtaattagttcactagtaaatccggtcagatgactgataacgattttgatcagatcattaataaatctttatcagatcactagtaaagcccggtcagatcactgaaaacccattctgatcagatcgctgtgtccgcccattggctgatgtccgtttccccggtgatcagtcgcatgctcagcgtggagatgaaggagaagcagcagcgaatgatcactttggacgaattgggcgtggacatggaccaattcatggagtttttggaggccatcacttatctgaacggaccttttctgcccaaccgtaattccattatactgtatctattcaattcaaccctctgaaatatttctctcccattttatggggttgaaaatatgtgatatttaaatttttttaaatatgattccaatttttagccaaaaatgtgctgatgcttctcaaattggctgattacttccaggtgggtcctctgatcacttatcacatcctcttttccctgtctgatcattttaattaaatattaaatttaaccaccataatgctaatgagttttgtcctaataaaagtgtcgcttcactttcaggtgtccgcgttgaagtcgcgttgcgaaacgcatctgatcaattgcgtggaaattccactgatcgaccgtttccttttgattgatcgctacggactcgacaatttgaaagtttttgctaatcaaatatttaattttttaaataatttttaatgatttttcaattattttcaattttagaattactttttgcatttggatgttaacaaattgcgtgccttttttgctgtgaaccatgaattgtttttcctgtaatcagcaaggaatttttgtacgctttatctgtacgagcatagcccggctttgatca

SEQ ID NO: 25316 - DNA, 1417 bp, Heterodera glycines
  misc_feature (30)..(30): n is a, c, g, or t
aaaagatttttcgaattttgacccaaattnttcgaagtgaaagtttttggcgtaatttatgatgccgctgattggaagtacttcttgacgattttttaatggcccaattctatgctatagcccatatttcggttcttttattcacctgctgtatataccacccagaaatgagctcctgttgcatgtgtggcgaaatggtttttgtaagatagtaaagggataaagagcggaggttcgagtccgttgtgcaacatgattgtttttatttatttttgtccaaaattttaaaaaatgacgatttttgggaattatttttgaaggtttttgccaaccaaattggacaatcttggtatctttcgaaagctcttgataatgagaagctttttctaagcaaatgctaagcgatttaaatatttagaaaaaagatagggacgtttgaaaacttatctttatgaataacttttcgaatcgattcattttcaaattaacctgacctatcattagatgcagaatttttttatctgtcgatatgtaaaatttggtgttcgtcacccgtgctggcgtttttttcccttttgtcacctagtttagcaactattttggggcttttcgagattttaatatttattttgaattttaaattttggtacaaatagtattgtttttgttgtgttaataccaaaggattttttgtttttacaacaaattaagggaatttgtgttcatcgtgcattgatactttacggcttattttacgattttgtcatgtgaatgtttttggctgttgagtctcatgcccatttttatctctagaaaaaaaaatcggcctaagatttggaggatttgattgattgctccgaacacacaccccacagtcacaccgctattccatcctttactggaattgtttttgcacaaacacttccctttgccatttcattttcagtccataatttcatttggtgttaaacgattcacacttttcagatagttgtcaaagtttcagcggagtagaaaatgagtgcaaagcctttgctcgagttgtatgtgaaggtaaatcacaaatataaaacaccaaagttttttttattgtttttcaggcctcagggattgacagccgacgcatcggtgcatgcttattttgccaagaattttggatggaactctacgctctttacgaagtgggctgtgttcgtgttgaggtttcatcggaaatttctgctttatgcaattaaatttttcgctaaattaaggtaaaaactgtgaatgtcaattcggaaggatacaaaaagcacttttcgggagcacagccgccaataatggtggaacaagacaagtaaaacataggggaaacagcaacaaatctttgattacattctgaagaggcacggcaaatgcggacaacactgacatcgag

SEQ ID NO: 25317 - DNA, 2154 bp, Heterodera glycines
  misc_feature (44)..(44): n is a, c, g, or t
  misc_feature (89)..(89): n is a, c, g, or t
  misc_feature (177)..(177): n is a, c, g, or t
  misc_feature (213)..(213): n is a, c, g, or t
  misc_feature (223)..(223): n is a, c, g, or t
gtttgaaaaattttcgatacgcagcacctgcggttttatgaaancgatattgtattttcaaagttttgtgcgtaatgtattcagctacnacagataaaatgatacgtcaatgaaatattgcgcaaagaatatgtgaatattatcggaaagtaagggcaataatatgtgaatcatttnaatcgaagtaaatatgtgaaaataatatgtgaatcnaattaatggngaagtaatatgtggaaattaatatgtgaaatcaaataaatgggaagtaatattgcgcaattatagcaatcactttcgtatttattcgcatataattaaatattgtgaatcataaaatgtacctatccagttatttatatggttttcttaattccatgaaccttcggtttcaaaattcttaaaagcgggccctggccggccggagaattcccggttttctttcgttcccgctcacctttagtattagcaaattgtcaaaaattttggatctggaatccacaaaattcttggttattaaatctatccatatccattttcaaatcaaaatccaggaataaactaggcaacttttatgaaatgaatagttttttcttaaatttctacaataaatttaaaaaagcgcttaaatactctcaccggaaaattttcttgcatctttcataaataaaatagctctagtgcagaaacttcattcgatattttcatgtctttgacttctgttttctttcagtttgggttatttgatttctggataattttatttaatatttattcgatttggatccaggttaaaagacctaaaagccagatccatatgatattgatcaggatttggagtttaaaattgcgctttgcgggaaaataatgattatttatacttatcatattttaccgtgttgatgaattttggttttcttcttgggtggccaatagccataatgccaaattttcagataaatttgaacatattccaaatggccaatttagtgaaattggtacgaaattcatataccatataatttctaatttgtgcataatcaattaaaattttctttaaaggtcggcttcttcatcctggttcttttatggccaaaagcattagcaaacagtaggtcgaagctcacaagctcacctttcctattttgtatgataaaattattattttaagtaacatcggaagtgaaggacatgatggataagttttcttcactaaaagcttatacaaatgacatcgtcaaaaaattgagaaacgtgagcgataatatcgacgatttcatttgggtcacacgtccagtgagcgcattaatcaaagcaggggctaaaaccgcatttcaagtaaaaaatgttttttaaataatctatttattttgacttttagtttaattatttgtttaaattttaagccaaacgctgaagagctagaagccattaaagtatggcataactttgtaaaagtcgagtttgaaaaccttatagaagtgacacaacaactaaaaccaggaattaaatattatttaattcaagacgaatatataaaggtttgaaaaacaaatttgtttattcataatgaaattacgaatattaaatttaaatatttagaaaagtaattctgttattcatttgtttttcaggctgtgaaaagaccaatgcatggtttagaggaactttataaaaatataacggacccagacaaagaccgttcacaatatttagaaaaatttcgtgctggatgtttagcacagcttgaagttttgcaagtaagtatttcaaatttaaacaaatgatggcaataaaacaagttctcttaaaaatagtcccgaggtacgtaaatgaaaaaaacggattttaatggcattccgcacttcggacaatttttcatgctggttacaagtcgcccgcatacgggtctgtatcgtttcagcgccgccgtttcggcgccagcccttgtttttggactataacttttttttcattaccgaccaaatctaacaatcttggtatcattcgaaagctaaacatgtttagaatctatttataagcaattacttagcgattagttgcttattaaaaaggttttaactgaaaattggaaaaaattccaaattttgaaatattttcttaataacttctttacaggtcaaaaattttttt

SEQ ID NO: 25318 - DNA, 1406 bp, Heterodera glycines
tttttgataaatttatacacatacaaatgctttcgagcatgtaggaggccggtgcgcaatagacctttatttttgagggacttttaaatttatactctatcccagaaaaatggctatctctttttttgataaattttatacacatacaaatgctctcgagcatgatagggagggcggtgcgcaatagacttttattttgagggattttttaatttatactctatccgagaaaaatgcctatctttttttttgagaaattttatacctcacaaaagcgcttgcgtatgagacggagggctgtgcacaatcgccattttatttcacagaggatttttatatttagaggttatccaggaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttataccacacaaaagcgctcgagcatgatagggagggcggtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaaagctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatttaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatatctatcccagaaaaatggctatctctttttttgataaattttatacacatacaaatgctctcgagcatgatagggagggcggtgcgcaatagaccttttatttcttgagggaatttttaaatttatactctatcccagaaaaatggctatctcttttttttttataattttatac

SEQ ID NO: 25319 - DNA, 2113 bp, Heterodera glycines
gcaaattgaatccgcgaccgcaggatttttcggtcccgcccctgtggattattaaacagttcttggcggatgtaattagattaatagcaaaacagaaaaacaactgttcatttttgctgtaattagcacactttagtctttttcttgattaatgtcaaaaaattcagaataaataattgatttgaaaaaccttacctctgccccacaataaatgagcaaaaatacgttcatgacctaattatagcaaattatggatgcgctacaacgttaacaggaccgaaccccggatttgggccaaatgtaaaacaccttccctgggcgttttcgaggtcgctgatcacgaatctgacatccatttctattaattccgaaccccgaaccccactcgaacaaaaagtcgaaaattaaaattttcatgagagatttggattttatttgatgccagcttcagacaagcttatatatatccggttttcattattgttctaaaattgattaaaacaagtgtaatacttagaaggtgggccccctttttggaaaaatttctttttgttctaaaaagtcgtgaaacatgtttatggtgggttttcagggtcggggaacccgaatccaacattcattttgaccaatttcgaatcccggacccgaattcgaacaaaaagttgaaattcaaaattttaaaaattctcacttttgttccaaaattgaccaaaacaagctatttcccggtcacggtttggtaatacaaaaaagtctttcggaaaagaaaatatttaatttaaagaaaataaatttcctaataaatttttttaaaaattaaatattttaaaaatcttcatcattgatatttattggttttctgaacttttttcacaaaaattatatttggttttcactccttcatagtgatctgaaaagccaaaaatggcttgaaatctggaaaattttcgaaaaaaattcttcgtttttttctccaataccaaaaatgttccatcaaaatttaaaaaataggccggagctgtactttcaggaaaaacttggaacgttactgaccagtgccgggaccgggacctgcggtcagtccctccattggcttacattgaggaacgctctggaagagttcgatatcatccagaagcatgtcgcgaataatggccatgtctttgcgatacaattcgaagttatatgaggatgaagcccgctcaatttcactcgcggtcacataggtcgctggctgccttttgatgtagcgtaccctcgctgaaacaaacgtgataggaacttaatgattattagagatcggattaggccgggcccgtgcgcgggtttacgggcccgcgcccgtaatccgtgtttttaggctggacacgggtttcacgggcacgcgggctttacggcttttttgcacgtgagccgtaccacgtgctgtttccaaacggacgaaacccaactcgtactattatgtagtaaatatagaaacagaaaaaagcgagacagcgttaagtcatcagagaacagagaaaaaaagatactctaaaatagtacgagttgggtttttaccttttatgtaaatacatttttttcctgacttctccatgctctaaatagtgggaaaaacactttcttttttgtgtttgcgaacaaaatgttgggacttttatttacatatttttacatatttcggggttttaaacatattttacatatttcgggatttgatacatattttgtactttttcttacatattttcttctttttttttacatattttgagaattttttacggaaaattttggaaatcctcaaaaaaaatcaaaaatttctgcaaatttttcgttttttatacatattttgagaatttttgaaaatttttttcttgtgaaaaataaaaaaaactttttcgtggcttggacactttgtgggggtgcccatatttacctatgtacatattttgatcaatttttgtacatatttttgacatcacatccctagaaatatatttaaattgtaaaaaatatcactattttcatcaactttttccattttttcactatttttgttaattattttgcaatttttcgtaactgaaaatccgcgcccctttctcaccat

SEQ ID NO: 25320 - DNA, 1647 bp, Heterodera glycines
  misc_feature (1599)..(1599): n is a, c, g, or t
acccattcattcttaggcacgtattgaggctcggcaacacaaactaacgggtaattggaatgcaacttggaacctgaaatacgccgaactcaaaaggccgactcgagtgggctcaaatgggaaatttggttggcaattaaacataagaatgtccaaatgattccatttttaggcattaagctcaggctgaagaaggagaaaagggggtttttgtttttctcttccaaagatgccaatgtcaaaagcaaaattgtgcaattcggtgctgaacacgtcgcgcaacgagtgtttgagcacattcttcgcgcctggaaatacggtgtcgcggattaacgttattttgcgaatgaatcccactctctttctctcccttctttcgccttttttgcttttcaattctaatcaatgcttttgaactttgttctcttttttgatcacgggtttatgccttttgctttacattcttctcgctttttgcagaactttcatggactatatattcataaaacacattacgtatttatttattcatgaataaaaaaaaagttatcagaagggcaaaaccacttactctgacgactgttcagataatatgtcgtagagtaagtgataaatatatggatgaccaaaaataaaatcaaaatatattaataaaatgaggtcaaagtcaattgagatcgacagtataaatgccaaatcacttaaaaattaattctgtttttgcttttccgtttaggtaaataattaatacccttaaagaaatcgaatcatttattcattgagaagcttgtaaaaaatgttaattggcaggattggaggtaatcgtacgctttactggtcccacaaaaaaaaggtgaaaaaaaggaatttcagcttttaatggtgcactcgggggttcagggcgctgatcacgaatatgatatctatttcgaatcccgaacccgaattccaataatttttttgtaaaaattttgaaaaatacagaccataaaaaatagtttttttaaattataaatataaacatttctagggggtttcggagtcgctgatcacgaatctgttacccatttcgaccaattccgaagcccggacctgaattctgttccgattctaacaaagtgaattttggtttcgaattcgggttcgggattcgaaataggtcgaaatggatgtcatattcgagatcagcacctgcgaaaacccctgagtgcacgggaaccgcccggctcgccgcgaccacttcgccgcggccggttcgccgcccatagaaaaatgtccttttcgccgccataattattgttcaaaaaatttttaattttttttttcaagaatttgttataacttaggctgaaactatggtgcgaagcgaaaaaattaattaaaaataagtttctctttattttgggcaatttaaatgtatatgtattaggataaaattctggcgatggatacaaaagaaggaacgattgaaaaaggcgaagccgattggtttaaataaaaatttcgtcaatgttaccgaatataaaggaggggttgagctccgggcataaaaaaaatttataagcaaaaattctaaaaatctctaatgcacaagtatgnccgacatctccctcagaagaaaatatcagccatacgaagactccaaac

SEQ ID NO: 25321 - DNA, 1483 bp, Heterodera glycines
tgtcttcatttgtagcaatgcgaggctttttttacttcgcttttgcagactctcaagtatttcgggaacagttggcattttttattagaatctgaaatttctttgtttagaagaaaatttgaaatgacataaaaatgaaatgaatgatttatttgatgcaaaaacattatagatattgtatattctctctttttattttctctttgacattatgtatttccaataggcgaaatgaatgtttctggcttagtaggcgaaatgaatgtttttggtttggtaggcgaaatgaatatttttggtttggtaggcgaaataaatagtaggcgaaatgtcagtaggcgaaatgaatagtaggcgaaatgacagtaggcgaaatgttcggttttgggttagtaagcgaaatgaatgtttttggcttagtaggcgaaatgtcatcgtgccagcagaatcactgccttagcattttccctcattttcgtttgtgccagtgtttatttgttagttcggcttttccattataacttttttatttgtcacccaaatgcaacaatcttggtatcattcggaagctcatatgtttcgtgcgtttcataccatagggataaaaacctaaaatataagccctaactatgaacttttgaatgtttcctaatttgtccgggttttaccgtttgaaaaagttaagagtgcatccatttagtccattatgtatttcgatttaaaaacttcataaatcgtcttttttcgttatcatagcgattcacactccgtattcaatcgatatacctttcaatttatctttactatgcctcttcattggacttctgtggacactcgcaacgcacttttgtgcgccgccgttccttccattggcgccttcgtgggctcgacgatggccatcaaagatcaggaattggttcaatttctcaaggtttgctgacaccagagttgagcaattaattccaatcagcttttagaatcaaaactttccttctttcgcccgttgttgcaaatacaattatttgctggccaacactgccgtcaccattccgttcggttacgcttcttatttggtctacaaaattggaggaggtgtcaggttttttgacaattaatggatcaaaggaatgcattgaggattcagttgcaccgactcaaaaatcgcattgggactgtacggtgcgacgctgctcagcggctgttttttggtgccaacgctcaaaaaacatgataccaaggcggtaggcaacctacaagttcatcttcccatctccaagtccaaccctttaagctgactgccaacgctgttgtccttgccggactttccgtcgccacttctgtggctttctacaacatcgacaagatttccgcttattggacgtgagttatttgggagttgtgtcaattgtatttgccaattcagcatgcccttcactcttttggccattttatacgctggacttacggtgaaggcgaattgctg

SEQ ID NO: 25322 - DNA, 1493 bp, Heterodera glycines
cgggcttaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacttatagaattaaagaataaaactgacaacttattaactgaaaattataggtgaatcacaagaaaattcaacactcgggcttaaaatccggagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatcgtagaaaagtcaattggtgcaatgttttcgggatttacctatagaattaaagaataaaactgacaacttattaaagaataaaactgacaacttattaactgaaaattataggtgaatcacaagaaaattcaacactcgggcttaaaatccggagaaaagtcaattggtgcaatgttttcgggatttacctatcgtagaaaagtcaattggtgcaatgttttcgggatttacctatagaattaaagaataaaactgacaacttattaaagaataaaactgacaacttattaactgaaaattataggtgaatcacaagaaaattcaacactcgggcttaaaatccgagaaaagtcaattggtgcaatgttttcgggatttacctatagaattaaagaataaaactgacaacttattaactgaaaattataggtgaatcacaagaaaattcaacactcgggcttaaaatccggagaaaagtcaattggtgcaatgttttcgggatttacctatcgtagaaaagtcaattggtgcaatgttttcgggatttacctatag

SEQ ID NO: 25323 - DNA, 1286 bp, Heterodera glycines
acataattacagtattcatcattaccatacttggaacaagtacagattttgcaatgagtgccgacggactgttggtggaccattcttccggcacaaatggaaattgtgcggggaaagtatcggaccaacaacagggcccaggtgaaagcgaagagagggcggtgccaaattgggacattcgcacggcgggagagccggcgcgagtgttggcacagctcggcttggccgagcacatcgctctgttccgggagcaggaggtcggacgcggaggccaagtccagacgcggccaacccttccccttcagattgacatgcaggcgtttctgctgctggacgaacagtgcttgaacagtctcggcgtggcaaccattggggcgcgccggaagattttgcacgccattcgaagtcagtggccgccgtttgcgccggcattaattccccccccccccttcagaacttagggattccgcccaatgccacggaatttattcgctgtgaaaaggcgccgttctttcgttggtcattctttggtggacctttcgtttcattttccttttcattttgccttaatcttttattgttttttcttaattgattatttcggggattttaggaaaatgcatttttcgcttttttatgcctaaatatttttattcgccaaattttgcatttttttagattttattgctgactttttatgttttccttaatttattttcttagtttgaagtcagcgtatatttagtatttatttattttttgcaaatgttttcacgcctaaaatcccctctattaattaataattgtcctgtgattttctccaatgtgccaaaactttacccatcttttgccctttcttcgcattgtattttttgtcactttaattaatgaataaataataaattgaaaataaaatgacaaggttctcagatgtgaaggtttaagctcacttttggttttttaagcaccggtaggcgaactttttaaaataacacttcgaggctttttgttgcattttttgtgttttttttgtaatataaaaaaaagcttttaaaaattttcatatatttgaattacctaaacttaatttctttttatattgtaattttattctgcacgttaaaagacgccctaaatttgtttatcatttcaaaatgaaaaaagtaattggcgttaaatgttgtggcgttcaacgacactcactttacacccccaacaaaaaagttttatttatttactccaaacaccccccaccctccagcagccctcccactttcgccaccccc

SEQ ID NO: 25324 - DNA, 855 bp, Heterodera glycines
ccaaaaatgaccgaaatatgctctaaaagcccaaaaatggcaaaatatgcatttattctcgaaaacccccaaaatatgcttttatatgcactaaaaaccttcaccaaatcaaaaaattttaacgtagaaatgctatttttgagcccctttcttcatagcatatgcgcagaaaaaatgcaaaagcatataatttagccatagttataaatagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaaactcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaacattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaatcaaaaattgttcggagataatgctatttttgggcttctctcgccataactaagccgcaaaaaaatatgtaaaaacataaaaatcc

SEQ ID NO: 25325 - DNA, 711 bp, Heterodera glycines
gaggtggaggcccaatcatcgtcaattgtggctcaggaggaggaggaggaggcggttgtggttgcggtggtggcggaggcggttgctgtggccggaagaagcgcgagacagcggcattagaagcggttcagccccacttcaaatcggacgaaacgccgtgcccacagacagagtggagacaagtcattgatgaggttggcaaactgatcacagatccaaatcacatccctaattgctaattttatagagcatccgcgttgacgatgccattggctcggtcaatgccattcaaactgctttgtaccgccgctatgccaatcagaagttcctggtcacctgttcggcagctgatgaggacaaaactggcaccaacaaagtgcacttcagctcatccggcgacggttactgtaacttggtcaaagaacgcatttggtgccaggcggtcgcgctgagcgcgtgaaaaacgcatgctatgcataaacaattaattctttttgatctttaattattattttttaatgttaaataattctccattatttggtttttctatgattcattaattttaaaatacttatttaacagtgtgacatttgctttgaaaaaaattaaaaatttctggcgataagtaataaaattgccaaaatatttgttaaacttaatagcgcgctcaaatttgtaaaaaagtttggcgaataaattttgtgaata

SEQ ID NO: 25326 - DNA, 1452 bp, Heterodera glycines
agttcattgtccatttcgttgaaaagaaatggcaattttcttagagcaaaacaatcgtttgataaaggcgaaaacaatcctaagaatagactttagaaaccaactaaaaaacaaacaaacaaacaattagtccggcttttctttggaccaattttctcgccaaaaatttgatgtcaggaatccgcctcaagtaatcattgtacaaagtttgacgaatggatgtaaaatttattaatatttcgaccatatcgagtcgttctgaaataaatatataataaatgtcaattttttgtgtatgaaaatcaccttcaatctgtcgaatgttaaagagtggctggcgtaaccattcgcctaaataagtttcaaataaaaatgcagcgttaataataaattgataaattcttacgtattaagcgtttgccgggctgagaacgacatttgttcatgtgatcaaaaagcgtgacagaaggagaagaaaaaacagcggaagcatcttaatattaggaaaaattaaatggtctgaactaacagtgcaaattccatttttcctaccaatttctccaccgattgtgaaaatgtccaatgcacgcaatgtagcattgctcaagtgcatgaatccgtgctgcccaaagcgtacaacagaaaaagccccttcggattggtgagaatcagccaacagttgacagtgggaaaggagcgaatgcattaccacccaaacgatcggagggaattcaaaatctgaaaaaacgaaacgaaaccttttccccctttattccaaaattaccagagaatttctggtggaaaagccttctcacttcggccttgcacttctccacatcttcttccacttctttctccaaataatttctttgtgtttgtgcccgttgaattacgttttccaactttttgaaacgattcggcgcatttttggcgttttgtctgatcaacaaacattcgcttggctgaaatgcagcaaaacattgctcaaataaagtgaaatttggtgtgtcgtttagttccgcgataacaatgcgcatttcttgtgaattgcagaacaccaatgataatttattctaaacagaacaattaaatgtcatcagttttttattaagaattttttactccaaaagaattaaatccttgcggaaatcctttatttttagaaaatagttttaattttaaagtaaatctctaaattgcctctgtgctcaaatcatcgtcattcagccaagcgcacataatcgtagaaagttcggctaattcaacggagcccgaaacaatgtcttcaaaatcttccatatttccaatggatccctcaaatatcaattaaaaagcttcatcaaattgaattttgaattaaactttagctttgagtataaatttgttcggagtgatttcctcataaagctcaattctgtagcgcaaaagtaagacgagatctttgataattcg

SEQ ID NO: 25327 - DNA, 1692 bp, Heterodera glycines
tatcaagaaaaaaggaaaataggcaaataaaaaagtgcgaatgcagtcttgatcattatttcgttgcaaattagtttgggtttggcatttcgtaaatgatggttacacatttgatgaatttaagcgctttttcttgccattcctcacacacaatgccgtcctgtggattatgccacaatcggtctccttctgcgacgccattttattatctttttttgtattttactgtcggattgttcactgtcggattgtccactgtccaattgtccagtcacgttcctccgccattctaggggagagaaaagatcgaggtgggaattccccgacaaaatttgttctttatagcaaatgcgtagaaaaatatgcaaaagcataaaatttaatattgcgacgccaaaatgtcccgcgtcaaagtgacccgacccattaaattaatgattagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctattaatgatgaattaattcaaatgaatactaataattagggatgcaatttttaggctctaaaaattgccaaaataggtaggctttgggttctaaaaaaccccaaaaattggctctaaaaacctcatttttaggggtgtaaaatgacaaaattcattcaaaaaggtaaaaaaataagtcaaatcagtattgagttaccttattttttaaattcaaaaatttgtccaaaaaaaatttaaggacgatttttgagaaaattttttatttcttaggagatttattttcagaaatttttgggtcgattcttaagggtgtatttttcgtttttattgcatttttttaataaattttcggcaaaacgccaaaataggcaaaaataggctctttcaaaattttttaggcttttaagctctaaaaataaaagcctagaaaataggcactaataactcgaaaagtagcttaacaacagcccaaaaaaaacatgtttttcgtgcgtttcaggccacggagagctcaggaaaaaataggcttaaacctaaaaattgcatccctactaat

SEQ ID NO: 25328 - DNA, 2034 bp, Heterodera glycines
  misc_feature (2004)..(2004): n is a, c, g, or t
aacattaaaaagacatttctccgtcggttaattcaaagacgaatatgaaatgataaattgtgcaaaaatgtttggaagttttccgtgtttgagtcacttcggggtggctcccaaccagactccggttccttccccaaaatttattaaattatttgcaaaaataatgttcagaaatataattgtacatagggaaagaaaagggggatggcgcacattcgatccccttcgaaagttgaaacaaatgagatgtgtgttaattttatttacaaaaaatttgagcgaaaggaacgaaaagagagaagtgagcattaatgaggttcaattggagatgagtttattggattgaatgtaataatcattataaaaaatttacaaaaaaacatttttggggagcaatgttctttacatatgcccccttttgcggacattcttaaaaatttaaaacacataatatttttatttcattttttaaagttttcattttctcaacccaaaaaattgtggtaaaattttgagcgttgggacttttccctttctctcctttttatatttttttatcgcacaaacactttgaatcggaaaatttgtttgctgctcattagtttaaactttcatcccgccaaaaacccatcgtattagcttttattaattagtttaatcgatggcatcccaccattttgatcattttttaattttcaataatttaataaaattaatcaaaaaacataataatttgcttattttccaattaaatttaaataaaaatgactttataatttgtttatttctcctttagtgttgccttcattgttttgtgaatttgccatgtcttcttctccgccaaaaagtgcccattcgccgcttttggcccaacaactgtcgtcgacggctttgtcctccactgcttcctcggcaacaatggcagcactggaaggcacgagtggcacatcgacggacaaaacgacaaaacggacaaagcgaaattccatggaatcgaaggaacgcgaaaatggcatctcgtgagatatttaaaggcttttataaaatttgttgaatatttttttttattgttatttatttttcgtacaaaaatttaggggcggattttttgaaagttcaccccagaaagatcaaattaacctttattttatattttttaattttaaaaatttaaatgagagagagagagggtagcgcaaaaagggattataataccgaaaaacaaacatttttcttaaaatacaatatttatcaagatgtttttagcacccatctgaccctgttcaacttcatgaagggaatgatcggctccggcattgtaaaatgcttattccgtccattcatttgcaacgccttttctgttctttgaagctgactttgcccatcgcctttaaacaagccggcctttggacggcgtttgggcttgtctttgtgttcggcgcattgaacacaattaccatgcatatgctggtggggggggggagttcaattaataattttgtgatgttaattactataattattgctataattgcggcgcagttaatttttacaaattttttcaattgtccgatcgcttagttttggattgattttttaggtgcgttcggcacatcacttggcaaaaacaaagtgggcaccctcgcaatcatttttttttgtcattacttttccagaaaaggagcgggaaacggtgggggcccattgagttacggtgaggtgatgcacgagtcgttgacggacagcttcgaatgggcacggccatatgccaaaacagccaagtaaaatgccgtgttttggttaggggccgtcccagagggagagggactggcacaaagaaaaaaaaaaacgaaaacatttggttgtcaccccaaaccccgaaaatcatcttaagaccgcggactgttccggtattttggttgcaccagtttaagcttaaaggcaattttcttatggggaatgggcatccctgaagaattttatcaaaatgacggtgttcccaantgattgcagagttttcgttaatgccacaat

SEQ ID NO: 25329 - DNA, 1086 bp, Heterodera glycines
ccccggccgagactgagacaaccccggccgaaactgagacaactgcagccaagactgagacaacttcagccgtgactgatacaactccagccgagactgagacaactccggccgagactgaaacaactcctgccgagacagatacaactccagccgagactgagacaactccagccgagactgaaacaactcctgccgagactgatacaactccagccgagactgagacaactccagccgagactgagacaactccggccgagactgaaacaactcctgccgagactgatacaactccagccgagactgatacaacttcagccgagactgatacaactacagccgagaatgagacaactccggccgagactgaaacaactccagccgagactgatacaactccagccgagactgagacaactccggccgagactgaaacaactcctgccgagacagatacaactccagccgagactgagacaactccagccgagactgagacaactccggccgagactgatacaactccagccgagaatgagacaactccggccgagactgagacttctccagccgagactgagacaaccccgaccgtgactgagacaaccccggccgagactgagacaactgcagccaagactgagacttctccgtccgcgactgagacaactgcggccgagaccgagacagcttcagccgagactgatacaactccagccgagaccgagactactccggccgagaccgagacaactccagccgagaccgagagaactccagccaagaccgagacaactgcagctgaaactgatgcaacccgatccccgactgctccatcaaccagaggcggatattatcccggagctaggtcaacacattcatcttctgccccaactactccatcaaccaggggcggatattctcccggagctcggacaaccgattcatcttcagctccaactccgccaccaaccagaggcgattattatactgggacaagtggcatccctgaaacgagccccccccccccccccccagtattgggcaaaggtaaagaacattggtcccgaaaaaacttttttt

SEQ ID NO: 25330 - DNA, 1643 bp, Heterodera glycines
cagttcggcggggccagttcggcgcgggtttttcggcgcggggttttttcggttcggcctttttccgctcaggctttttcggcgcggccagttcggcgcggccacttcggcgccctatataaaatgactttttcggcgccgaaaaaattttcaaaatctggagcacaccctattaaaaacaaaaaatttcctgctgacaactacatacacactaattttgagaaaaagttaaaaaaatatttgttttgcagtgttgtgtaccatcgaatacctggtcagtttggaacttttaagtcaaatccaatataaatattcgagatttgaatccggggttctgagttaggcaaacttatggtcagattgtaatcagcaccctcgaaaccccccgattggtgattttgaaccaaaatataaaagttaattaggaaccacaattatgcaccattgctcaccattgcattagcacgttactttgaaagaaaatggcataagttatatgcacaatcaaaggcagcaaattaaaacttttttgaaaattttttgggatttttaaacactggagccgaaaaagctattttacatagggcgccgaactggccgcgccgaaaaagcccgcgccgaaaaagctcgcgccgaaaaaaccccgcgccgaaaaacccgcgccgaaccggccgcgccgaactggccgcgccgaactgggcggttccccttgagttacctggtcacttaatttgctaaactgatttagttgatgaaatttttgcgaattttttgttggtaataacttaaaacaaatggctgatataacaattttggctccgtattgatactgcaggaaatgacagctcttttaattgtgtaccagaatatcttaatacattatatatgaccagcttgccaaggcatgaattgagatagaagaacgatgttgttgttatgttagttgaaactaatggtactggtactaggctcagaattaaaaatgttagataaagttcttcactgcgagatcttaacagggaacaaagctggcactaaagtgcttttaatcctgggatggtttaaaagttagattgcatccaaaacatagagataataaagtgaaaatatttgttttaaagaaattttgaccgattaaattttttgaaaagctaaacaaaaagaaaaaaagaatttatacgttgataatctatgaaatgtgaatatattgaagtcaatgtctgaaatctacaaatacttaaattacaaaaaaccctttttagtggtttaagcataaatttttgataagcattttttaatattttgatcaatatgtttttggaaagtcaaagaatcaaatttatagcatatatcaggtaagttaatcgctacattattgggggtggtgtagcgagtggtgggacaggcaattgtgcacgtgactggacaatccgacagtggacattctgacagaggacaatccgacagaggtgtacaattggacagtggacaaattaatttacaacgaaataatcttttagcctgcatttgcacttattttatttgcgtattttccttattttctggatatgacacaatttgtcccattcggcgacggcattaatggaattttttgtgcattttactgtcggattatccactgt

SEQ ID NO: 25331 - DNA, 1126 bp, Heterodera glycines
gtctgatccaagtttaaagcatcataacttttttctcagctgtccaaattttataagtttggcatcgttcgaaagctctacatgtttagaagcttttgataagctatttgtaagcgattgaacagcttataaaaaagttgaaacatgaatattatcaaaaagtcaaaatttttgcatattttacttataacttttttatatgtcggtatatctttgcgttttttgaaaagccgatagagcttgttaagagcattcgaatgataccaagtttattgtatttggtcaacaaataaaaaagttatgatgctctaaacttggctcagactataccggccagactaaagtgtcccagtccggatgattgtatgtatgcccattttatcatttctctttcattgactaaattgcgggtgcgagagaatgttttggaatatttaaatgattaaaaaaattcgaatttttaataattatgaaaatgtaaattggtatttttaattgaatggggcattaaaattttaatgggaaaaactaacgaaaaaatttcatggttttctacagaaaaattttattttctcagccacaataatttagaaaatttgaattgtccgctgaaccaagtaattttctgaaatggaaatctgtggccttgaaaattgcagcaaaacgacaaatttttataaaagaaaatttataagtataattatggttagtcgggaccgggagttttccgaggctgcaaaattttgaaattgggttgaaaggttaaaaatgttcagtatatataagtcggcctaatacgaattgtattttgtcctttcaaaattggacttcacctcaaacatatgccattgatactgaccgaaaaatgagggacaaaaatgtttttaaaaacatggaattttccaaatagttgtgaagtggttaatggaatggatgctaatcaagccaaccacaacaaatttacttatttatttgcacgaaacaatggaatgcgtttgttcgttcgcgcgggcggcggagtgccgtcaccgccgttccgccgacgacgggcgacccattaaaaatggattattagcatttaaggaggacgggggtagcagggggagggtaaagcggggaccggagg

SEQ ID NO: 25332 - DNA, 1396 bp, Heterodera glycines
gggtcagcaataaatcggacgtcattatttgttttgctttttcaaaagcattttgctgttcggacgtccattcccaagctacgtccttttggaggagtttgtcgagcggtgcacgcagttcgcgcatgcatttcacaaatcttccataataattcaaagcccccaagaacgatcggagggtgcttttgtcaatcggtgcgggcattttccgaattgcgtctgaacgcgacgggtcaggacgaatgccgtttgctgacacaatatgcccaaggaacaaaagttcgggctgcaaaaatttgcatttgtcgagttggatgcgaagaccgtactcttttatgcgcccaaaaagagtgtaaagtgccgtgatgtgttgctccagggttttcattgcgatcaatccatcgtcaagatacgcgaaaacaccagggatgccagcacaaatttgttccatcaaatgctgaaatattgcctgtgccgatttgactccgaacggcatgcgttggcattggaaaagtccgcgatgtgtgttgatggcgcacaattgcttggattcttcatccatttccatttgcaaatacgcatcgcgtaaatccaaattagagaaaaattttgcgccattcagtgaggcgtaaatgtcgtccggccttggcagtgggtggcggttcaattccaatgcattgttgaggccggtcgagaagtcgatgcagactctcgacttgccctttttcttttttacggccaagatcggtgcggcccaatgactgaaatcgatcggcttaattgcgccaatttgaagatttgaagaagacggtccaattcggcattcacagcttccatggcgccgtgtggaatgggacgtgcgcggaaaaagacaggctttgcatcagatcgcagaatgatatgcgccttggtttttgacagtgtcacaatccatcttcaaaaacttccgtgaaatcattttggagtgccgctgtaagcgatgccacatcattgatcgatttgtttggtggcttcactgccgaaaaattttcaatcattgtcgcctgatcagccgatttgctggacggaaataaaatttggcggggaatgatcttcaaagcttcgatccacggcaatcccaataaattgtgtccgacttctccgctcacataggcgatcagagtttgcggtggtttgtcggaaaattggacggtgcagatgaatttgccaagcaaggcgaatggctgatcattgcagtttttggcatcgatgtcggatggagtcagttccggttctcccaactctcgccatgtttgcaatgaaataattgtggcctgagcgccggtgtcgccattcatggaagtttgccttccattaatcaaaatgcacaatttccaccatcgtccttgagtcgtgc

SEQ ID NO: 25333 - DNA, 1796 bp, Heterodera glycines
  misc_feature (1780)..(1781): n is a, c, g, or t
tgctgaattggcgagtcatcgcctccaaccctccggtgctcaattttacgctcaaaaaggatggaaaagtcatcggggacgaggagaatggacgacgcaaattcagcttcaaaattgacgagagaggaggcacaattgcactgctcaatgtcagaaaacattggtcgtcattttcactgtttcccttcagatcaacaaagtgaacgacgacgactatggtcagtacacgtgcactgctcacaacggaaaattgtcggccgatcagcacgctttcctcgatcgaccgagtgagaaaaagggagagaggggaaatatggccaatacgggggacacttacccaaactaaattttccaatttttagacccgccaaatcagccgttggtgtggccgcttcaagtgacaaacaattcggtgcaatggcacgtggaggaacagacgaaggcgggacagttgccggtctcctattttcacatcgtatacaaagcgatcaaaagacgagtccaaaagcaacagaaggaagagtccaagcaggtcggaatcatagtgttgaaattgaaaaaggggattttcttatagaatttggatggatcacttgaaaatgccatggcagcggacgaagaggaagacaacggcgacttttggcagcagcgacgcctcacaacggaggctgtcgaccgtcaaagtggcgacgagaaacaatcgcttcagaggacggcaactgggaagaattgaagcagaacgccagcgaaatgaccgcaattcggcaaaagagtggggaaaatcattttatttctatttcttgttcaacatttgtttatttcagatgctgaaaatgagtacgacattggcgggcttcagccgttcactttgtacgagttcaccttcgtggccttcaacgaggcgggcagcagtgaccctgtgacgatgaaacaggagacggtgaacgattgggtgccgccgccacgcgaagtgcaaaacgccgaacggcacaacgaaaatgttggcgtctcgtccagctcgacatcagtggccacttacatcagcgtcggttagtcgaccgttcattatttattttatcccaaaaatgatacaacataatttaaagcattgatttctccttcacaaagggaaagatagaagcgttcgtaaaagcgaaaagaattttaaaaatttaaaaaggttttcaaatatatgaaataatgaatagataatcttcgctcattaatttcattcaaaatcaaataaatacgaaattgagtaacattcttattaggcttcgtttttttaatttcataaattgttttatcaaaagatttcgcaaatttacgaaaatctgaacaaaattatgagggtggtgcaatctaagcgaatttatcaacttaaaaaaattgttaaaatggtgcacttcaatagaaatagtaccaaccaaaagtgcttatgtcttaacatttgtttgtttatttatcgccggtgtctttaggtttgatcggatttttcgtgctgtccagcttcgtcatcgccgctgcctattgctccatcgactcgggtgggaatgcctccccctcctccgccgatggcaaatgcattgcgacgcccacccccgtgccctgagactcaattaattctttttttttttgaatttcacattttttgcgttgctttacttatttatttttgttctttttggtgctcattcattccttttttgattttctttcgatttcaaacaaacaccataaatatctcttgaatctcctctctttcgcttgatcttttccnnaatttacgacgatca

SEQ ID NO: 25334 - DNA, 1570 bp, Heterodera glycines
ctgtttaaaaggaattaaaaatttttaaaaattttattcatctccctctttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgactttctgaaaaaaatatttggggtactcaatttatggggagcaaaaatcagaaaagtaatataactatcgattcggtctccccataaatctgggcgcatcggttcggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaag

SEQ ID NO: 25335 - DNA, 939 bp, Heterodera glycines
aagcgcttttgtgaggtataaaatttctcaaaaaaagagatagccatttttctgggatagagtataaatataaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttct

SEQ ID NO: 25336 - DNA, 1089 bp, Heterodera glycines
tcaaaacgcttcacacttctctccacgcttccaacttcagcttctttctccagcggatgattacgcttcatcctcgtccgcttcatcttccgcttcgtccgcttcgtcttcttccgactttgtcctccctttcctccatctttgtcccctgagtggtcttctcagcttacaaactcattcagtcgcttccgattatgcgattgaactgattgttgaagacgaatggacgggagcgaagggtagcaaaaaattggagctccatttttttgatgacagtgaacagagtgatcggatggtccgttttgatcatttggcttttccttctctcccctttggctccgattggcttttccttttccctttcagatgaattttatccgccaaaatctctcaatgaatttcgataattattcatcgaattctttctctttgccggcattttctttttgggtggcagaaaatgctgcgattggcacaattgtaggccaattcgatcagaaattggtcaacgagcagacaacattgatcggagccgaagagatgcctttcgctttaaatattaaaaatggcactttgacagtgatcggtcagtgggacaattgcccaagaaaaattggtcaaatttaaattttaaaggtccaattgacgctgaaaaggcttcactcttttcttttcaccttaacagtgattttgatgatgccattgaactgccccgaattgatgttcatgtccgaggttggcatcggctaattgctttgcttgtgagtaattaatgggatttaaatggctaatttcagatgaaaatgagcattttccaacggtggagggtgccggaggtgcacttttggttgctgaaaatataccaattggaggccgaatattgcgaattgacatgagagacgaagacagaacgagtgaagagggggggggggggggggaaattaggggaaaattggcaaatttaaaaggatttgacaattaatcttttacataattagcaaattcactttggcttctcatttgtcaggtgaattggtcgccttcgttgacccatttttgacggatgagcacaatgcgttttttgttgat

SEQ ID NO: 25337 - DNA, 2104 bp, Heterodera glycines
ttgattaagacaaaaaagataaaaaataaagggaaatgaattttaatgtaatttttaatctttgtaaattaattacttttttatctaataactggctctttgttggtttttctttctaatgtgaattgtaacttttggtaatttttaaatgcaaatttcctcgggtatcgaccataatgctgttacatttatccaaaaaatccgttgtatagtctctggcagagacaatcaaaatgatatcaatggacagcaaatttttattcacaatcgggacgcaattgtataaaatttgcgtacactgaactattagaataaattaactaaaaatagcagtgcattttttcttgttttgatttaatttaaaatatgtattcagttgaaaaatggctatattaatatgaagtcaatataaaatggcaaaaatttttaaatatttaattttataaaaaaagggttaaatcctatataataaagttgagtgtctgtatgtttctgccattgtttgaatttgtgtggcgttatgttttgtttttgcgttaaaaatgcatttgaaaaatgaaaatgtttttgttttgttttgcgttaaaaaagcatttgaaaaatgaaaatgtttggttttgatttttcaatttgttttgcaataaacattcttaaaattgtacctatttatttgcttttttatgtatgttcatagtttattaagttatttgttatataaatttgttttttgtaaacgaaaaaatttatcagtatattgtttgagtttgatttagtggttgttgtttctttgtttgtttattttgtttttgtgttctttacgtgaaataattatgtttatgcttaatgttatttgaacttttaatgaaatagaaatgcatatctttggtttgttctgtgactttagtgtgagacactaatgtgtgccatgcttttgataaaacattagtggtttgttctgtgactttcatgtgagacactaatgtgtggcatgcttttgataaaacattagtggtttgttctgtgactttcatgtgagacactaatgtgtgccatgcttttgataaaacattagtggtttgttctgtgactttcatgtgagacactaatgtgtgccatgcttttgataaaacattagtggtttgttctgtgactttcatgtgagacactaatgtgtgccatgcttttgataaaacattagtggtttgttctgtgactttcatgtgagacactaattgtggcatgcttttgataaaacattagtggtttgttctgtgactttcatgtgagacactaatgtgtgtcatgttgtgccataaggaaatgccacaagaagagatgatgaaaatgccaagaatgttgtgccataaggaaatgccacaagaaacaagaagagatgatgaaaatgccaagaatgttgtgccataaggaaatgccacaagaaagaagaaaagacgaggaaaatgttcgatgctggtgggttgagtcccagtgattggaatgatggtgggttgagtcccagtgattggaatgcaggagaattgagtcccagtgattggaatgctggtgggttgaatcacagtgattgaaatgttggtgggttgagtgccagtgattgaaatgcaggagaattgagccccagtgattggaatgctggtgggttgagtcacagtgattgaaatgttggtgggttgagtgccagtgattgaaatgcaggagaattgagtcccagtgattggaatgctggtgggttgagtcccagtgattgaaatgctggtgagttgagtgccagttattgaaatgcaggagaattgagtcccaatgattgaaatgctggtgggttcagtcctggtcattcgaatgctggtgggttgagtcccagtgattggaatgctggtgggttgagtcccagtgattgaaatgctggtgagttgagtgccagtgattgaaatgcaggagaattgagtccctagtgattggaatagctggtgggttgagtcccggcgattggagaaaaagccaagaaaaggatgcgaggccgcgaagcggccgagccagtcgattttatcattcataatcctataatacaatccgtactacctagcgg

SEQ ID NO: 25338 - DNA, 1623 bp, Heterodera glycines
ttcaaaaagtccagcaggcatccgtcagacgcaagttcgaagaccagcatcacaggctcacgcgtcattgcgattccataaagttcgatgacgtttcggtgcttcaacttcctcacaatgcgggcttcgctcatgaaatcattaatctgaacagagatgggaaacaattgcaaaattaatcaaacacccgcccgtctcccacaaatgtcaccttctgcttgttggcagtttccaaaagtcgtttaaccgccacgcgcttcttttgttttggtgttcgcgccaaaagtcctccaagaacaacgccatattttccacgtccaagctcctcgcccaatgtgagttggttgtgtttgatctcccagtcggcatgcttcacgcctctctttagaacaacgcaacgtccctgtaaaaaaagggggaacaattgaatgaatttctgatcctcccgttttctcacactaatgagcgaatcctctgagcgctggtgatattcgatgaagccttcaattgaattgatgttctcattgtcacgcatgaaagtcccgtcggcgttttcgtaaaagtgcacatccaaaagttctccatttgtgttgatggacagagtaaaagtgcgagtttcgtccttgtcttgcgttcgccgaagaagaaagtcaccatccttctgaagccgctcttggaggtcctcttgaacgatctgaaaaaatgggagggaaattttagcacaacacgggcggggctcatcactcaccagtccatggtaatattcgtaacgcagcaaattgagttcggcaggatccattgaaaaattcgtccgcgtagacgagccccagcgattgccaaatggatggcaacggaaggtgttgaacaaaataataatagcgatgccgaaattaatttgttagaaagtgaatacaatggacaaaatgtgttccttttatacacaaattttcacaaagtggcagcaccactctaaaatgtgtgcaaaacgaaaaatgtcggtatttaaataagaattctgagagggtcaactcattttgatggaaattcttttcgatggaaaaagaaaaaatcaactgaaaaattatgcctttttgggactgaaatggacgcctataaaataaagtttaaaaaacattaacgtaaaattcagtcccggaataaactaattgtcgaggatggcctaatcaaccacaaacagaacataaacagcatgaacccaaatttaaaaaaaagtcagaaatagaatgtacggcttttataatcgccaattgccgtttttatgcttttccgaaaattaatttttttgccaaaatttgtccatatatatttcataaaaattcttcagtttttcaactttgtctgcggcgattgttggcttttggtgttcgattttcttgcgccttctcagcttggccttggaattgcactgattagccgccgctttgacttttacgtggacgaacacttcaagacacgcaaatggaaattgaacaacaaattgcttattatgcaattggacatcgaagaaaatggcacaaagaaaatgcaaattgtcaaatccgcctttggaaatccattgccaatcccgcgaaatccgtttcccaacaaagtcatcggattcag

SEQ ID NO: 25339 - DNA, 2088 bp, Heterodera glycines
gttgtaaagaaaattttcggaaactaataaacataaaaatttgcgaaaatttcgaaaaaaattctctttttggggatgtattgttgaaaatacattctccctgaagaaggagacacccctagaagtcataggaaaattggataggtttactatctcaaaattttttgatcagaatacccataattgagggtccaaaatccgaaccttaagtttcaaattttagttatatctccggtatttctttagatcgcttaaaaagatgcaaattaggttggttctccaattcagaaattaattaatcccaagaaaacttttccgtttttttctacgtcgcagaagatttattcaattacattagataattaatatatggcacaaagatgtgaaaaatatttattaccattacaaaagtgttggagcagagcaccaaaaaacaaaaggatgaagattggacggggaaggaagcagcagttcatttctgtttattggatttttcgtttttgtctataaaattaaaaattcaatttaaattaaaaaatattttttcattaatacccaataaaatttaatgatgtgaacttttcaattcgacaaaataaaatgattaagtccaattcattcacatttgacgactgactgactgttctgcttctgctatgattatgaacagcaaatttccgcccaatttgatcgtcggtgaataatgaaacgcaaaaattgtggccgaacgattcatttggataaagcgattggatggcttttaattaatggcagtagtaactactcaccaaaaacaacagcagagaatgtaaatacgatgggaaaaaattaaattgtaaattactaaaaataaatgtttttaggaataaaaaagttttttaattaaaattcttaattttgctaataattttaagagaatgcgaggaatttaaggaccgaggaataagggcttggtgctggaatagggatttaacatgccgttaacaagacttccggtaaatggctcctgccccccgcccaccccccaacaaaaaaattgggacaagaagcatcgggaaaatcctaccgggatctcgctggaccacgaatgatatcaagattgttgggtttcgatcaacaattaaaaaaattatattggctcaaagttggctcagacaaagttagcccgttccgattccgaaattataaaacttaaaaattgagtgcctaagaatcggaaaaaaatttatgctatatatataaaaaaaaataataagtctaaataaatttccatgtatgtttcgtagattcgtcacagctgtcatcatatttctccccaaccatttaaacggacaagaaggaagttcctagtgtcacaaaattgccagcaaagaaacgacatgataaatagggattttttaagggtgaaaagtccaaaataaggccgtaaataagggcgaaaaattcgcgaaataagggcgaaaataaggtcgaaaaagtcaaatttagggtataatttttaaaattgctgttttttacatgaaataatttcagactaaggcaaacaattttattcactgattgcagttacaaataagctatattttagaaaaaaattttcatttcttagggtctatttttgaaaaatttagtgtcgattcataggggtatattttttcgaaatttttttgggtcgattcttaggggtatattttttcgaaatttttttgggtcgattcttaggggtgtatttttcgtttttattgcatttttgttaataaattttggacaaaacgccaaaataagggcaaaaacttattttaagggcgaacatccaaaataaggatttttaagggcgaacatcaaaaataaggatttctaaggtcgaataagggcgtgaaaacgcaaaattttcagacaaaaaatgtgtttttcgtgtatttctcgttcagttaaagccgcagaaaaaataagtaaaaacttagaaatcccatccctactcataagacccctagggattaataattaaatttaaaaaaatcgtaaaaaattgaaaacatgacttctccatacatttaatagctcattcgtaatcaaagattttcaaaa

SEQ ID NO: 25340 - DNA, 713 bp, Heterodera glycines
taaatgcaaagattggcaccaaaatgccaaattaaatacaaagtgctgatgagaaatttgtccgcaattgggtcgaggaaagtgccgagcagcgaccgctgggaagggaagtgccgtgccacggacccatccaactgaacaaatagaagtcagaaaaaagaagatgaagaacacgaaaacagctattttttctgtcccaatttttttttctttccggtattattttccaaaattagaccccaccgccaaaaaattacatttttggccaaaaatatccattttttgatcatcgacgactcaattatccagcggcggtgagtcaggtacggtcccaggattttggcttggggggagtacctccccccgggcgtttttttcacacccgttttttttgtggcgcggtttttccaaaaaaattttgggggacagggggtccggcggtgccgataggcgccgccgggaaattttttgcggttttaaatgcggtttgttaacagattttgtccaaaaaatgaccaaattttgtgattttgagccatttttagcagattttcatcaaaaatttgtggattttttgaaaaatttagcgaaatttcttggaaaatttgggtgaggctaggcctggggggaggggtaccagcaaggaaaacctaaaattttcaaccaaaatattattttttccttaaaaatttagggtgcggggggccttgggg

SEQ ID NO: 25341 - DNA, 496 bp, Heterodera glycines
cagcgaaattcacagagccaattcaactccaaaagccgaaaatgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcgacaaactgcggccagcaaggagccccagtatttgttcgccggtcaaacggcatggaccacggacggagtgagtgggaaaagcggggggggggggaagcatgagaaaagatcaaaattacaggacaaatatttcaagtttttagaatcgacttatctcttaatgaccattaattgcgtcctcttacctttaaaaagaccgctttggccatgccgagttggacttcgccactggcacaatgaccatcccccacttctccgagaacgacttgggctcctaccccttccccgcttgagcagccccacttcagc

SEQ ID NO: 25342 - DNA, 1018 bp, Heterodera glycines
ttttgccgataatttttgccgttagcatgttcacatggaacgtggtgttctgttcgggtgttcctggtgcaattacgggcattgtcattttggcataaaatccgaggccgaactgtgcctcgcgcaattccaattcaccctcagggctccaactgagcgaatcgggcgaaatttcggcaatttgaacgggcaaaggccattccctaaattaaaatgccaaataaatattttaaaaataatcaaatgacttaccaaagagaaaaagtgagaaaaaatcgctttagcaaaaaagggacggaagcgccggggtaaagcaaaacgatttttgtggccaaaacagagaaagaaacgccgccaaaaaatcccaaaagattgccgtaaatgtaattatctaaaaggcacaattaaaattaataaattaaaattaattattcactcacgttttgcccaaagtttcaaaatgaggacgaattttctgaaagtgcccatgtttttttggttcacttcaagcaatttcagattggattggtaccctaataaatttcaaaggctaaaatattacaaatgtccaatcaccggctaatgatcggaccattctctccgtttgcttttctttttctctgtcctttcgatcattcgaattttccttttttaattgggcagttaatttctcaattaaattggcaatgtgagcactgtccctctcgtcaatgttcacagattttaggccgggaattgaggcgaataaaacgtcgattttgagtccgcaggaaagcgtcactttgagcagaggcacccgcgcgaagggaatgcgctgcagcgattggacattcaaatgctaaacgattggggacaatgctcctctctacagtactcgtttgtgtggttgggttctgtgctgctcgttttgcaatgtgaattaccgtacccttttgtttaccgtattgcttaccgtacaaagtgcgcacagcagtgattatggtcacagttgctcctctcacgcggcgtacagttgcaa

SEQ ID NO: 25343 - DNA, 946 bp, Heterodera glycines
ttatttttaaagtaagtttgtttaaagtttcaagaaatataaaatttgattcgccatcaggaaatgcccaatgttatttagaggctaaattagtgggagcggaggaatttaaacccaaatatgccgcatgaaatgggagcaatgcattccccgcgcacgccgaaattaaaaaaaaataataattaatattgaaaattctgtacaaaatttgaagttttttacgcttttcaaaaaatttttcttttatgcgtttcaatgaaaatttcaaaaaatttgccatgggaggaagggtgaaatggtcccacttgtcattattattattaatagggaccagcgcgtttgggcccccgtttttggtccccctcgtttggtcccccgtttttgggccccgcggtcgtctgggccccaacccaaaaatcaaaaaatgtgctttcataaaaattaagattctaaaaactaagcctgagggatccctctcatctaagcttaagctaggtttaagtaacattcgctcattttttgcaattttacttatttcaactcctcttattttttaataattaaccaatttgatgtgcgggggggggggggtgaggatcatcggcaatgtttttttatgcgtttgaccatttttctccacctgtttttgctttgcatatcccttttccggcgccctttttggcagcggaaaattttttgaccatttttgcccggtgcaaaattagtcaattttcaagcccatttttcgacaaaaccttttagggttagtcgaacgcactgcgcgactttttccttgatctctccaccactttctcgtgttttccttttctcttcttcctttttctcgaccaacccgcctcgtgcgttcgacaccctccgaccccaagcgttctgcgtcacgaccctccccctcttgcacagcgattgacatattccgccggaaaca

SEQ ID NO: 25344 - DNA, 1663 bp, Heterodera glycines
  misc_feature (1564)..(1564): n is a, c, g, or t
  misc_feature (1589)..(1589): n is a, c, g, or t
  misc_feature (1600)..(1600): n is a, c, g, or t
ggccggggtcattacccagccctttctgtagagtttttgaacgaatttgaagtagtaaaaatttagattttttgaacagtccaagattctttgataaagaccaattggggttctaaaaaatggattgactacaactcaaatattaaaaacgatggacgatatatatatttctatacaaaggaatcaacaaattgacataatctatattgattttgacaaggcgtttgattctgttccaattgatttattacttcaaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgtcttagggccattactctttttaatttttataaatgatctgccgtcctttatttcaaaaaaagcatcatcagttggcataaaaatgtatgctgacgatgttaaattatattatgcccatgaaaacgatgaccattcaaatcagttggataaagcgattgaggctttggaaaaatggtcaaaaataaatgggttagaaatttcaactgaaaaatgttttgttctttatttggggaaaaataacaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccgaagtttggaaccctaatttaaaaaaagatatagataaaattgagcgtgttcaaaaatttttcacaagaaaagcacttagaaaatgtggttttgtgtacaaaaaatatggggaaagactaaaaatcacgggtttacacaaattggaagaaagaagaaaaatcaatgatttaacaacagcttttaaaataatcaaagggttcaccagcctcgatgctggaaaaagtttctttttctcagaaaggctcaggaggcctttacttttacgggtaaagcgccacacggccaaaactcaaaataattttttcaatagaatagtaaaaagctggaataatcttccagtggtagcggtgcaaattaataaggcaaaggaattcaggggtttactaaaagcaatgagttctgagtaggaatattcatgtgccatattttacattccatatttaatcacctgtgattttttacatttaatttataatttattttttactctttttattacggtattcattttgtatttttattttgatcaaatttatttgttttgttttctttttggcaccatgtaagagcactaatgtgcctttggtttgctcgataaattaaattaaattaaattaaaattaaattaaattaaaagtaaaataaaattgagaaaaattgagaaaaattttttttggcataaatttctaattttttanaaaaagttacattttttattagaanaccctccaaanatgatttgaaaattttttggtcattagaggcaaaatggccgctttaatagagggggctgtttt

SEQ ID NO: 25345 - DNA, 2097 bp, Heterodera glycines
  misc_feature (2045)..(2047): n is a, c, g, or t
  misc_feature (2083)..(2083): n is a, c, g, or t
ctcgagttattgccttttcagtctcgatgatcggcgggcctccaatttcgcttccccgccttttcttgatccgcttttttacgattccgatgaagcgttgcatccatgctgtggcgcgttgcactctggaccatttgctgcacctcgtaagcaacgaactcgggaattgttcactctcgaggcctgtggatgcttcatttcggacaatgaatgctgattgtccttcttcctgccccgccggagagggtaggccctcttgatcaggctgaaactccaattcgcttggccattcggttctcggcccgcgcaaccattgaggaccattccaccactgatcattgtgttgtaagagggtgggcacttcccctcgagttgccaaatccgctgggttttcgttagttcgaatgtagtgaaacgtcgttgctgtcgcttttctgatctcgaagagtcgattggccacgaattgtggttgcgctgaagccgttctgacccagtggagagcgatcattgagtcgctccaaatgtgttgccccgcgattggatggtggagttgcttttcgatgaatgctgccagcctgacccccaacagaatgcccatcagctccattcttggtattgtgaacgtggtagccgctttcttcggcttgaggcgtgatttggccatgatgaggcgggagttgcacccgctttctcctcccgttcgtatgtaagctgctgctgcatatgcgatttccgatgcatccgtgaacacatgcagttgaagcgggtgacccctgcccgcagttacgcctcgaggaatcacattactttccccctcccaacttgccaaaatgtgctcccattctcgagcttcctcccgggacaaaggagtgtcccattcgtggttgtcgtcccacagcttttggaagaacagcttcgccttgagggtcgccgggcagaccaagccgagcgggtcgaacaggctggcgacgctgctcagcaccgttctgcgtgtggtgctgatcggagtgtcgggttcgctcccggggtacttcattcgtattttgtccgtctccgcgttccattcgagtcccaagactttggccgtcgtcttgccgaggaattccgcgtccgaaaagctgctgttgagtgtctcgtcattgctcaagaattcccgaaggttcatccgcgcgtccgcaaacattcgtttcgcttcttgtcctttaatggctgcttcttccgcagtgtccgccgggatgagcacattatccacgtatgtgtcccgaatgagttcttccgcgaagttggagtcgtatttgcgcaggtggtgtcgtacaacggcggcgagacaaaaggggcttggcgtgagcccaaatgcgaggcgtcgaaatcggtatgttaccaaattgtccgttgtcactggccgaaatgggtcgcgcacccacaaaaatttgcacacatctctgtcgtcctcttcaatcccgaccatgagaaatgctttctcgacatcggcgatcactggtactcggcatgctcggaaccgaatgagcatgccggccagatccggcagccaaactgggcctctgagtaggcagtcgttgagggaaggtgcccctcgtgtgtgtgcgctcgcatcgtagacgacccgcaactttttgggcgtgatcactgcttggtgagggatgaagtgttcgtgtttaccagctccgatcgtcgtttcctcgattattgctgcattgagctgatcggtgatcactgtggtgtactgcttgagcacctcgggagtcttctgcagccgttgaagcattgtcgttagccgtcgataggccatgctgaaattggtggcaaagcggggtggcactcccgccatggcaatcgaatggagtagcgcccgtcgttgagttggcgcactgatcgttcgaattgtatcactgcttgcgcatccgcgtcgtctgtcgggtcgtctcttatcccgattgcttacaatgaccaaaattgttcaactgctctgatcggccgcatttgatcgcgttcatcttctccgcatggcaaggtcatgaacacgnnnacgagcggagttgcccggctactcacttggaaccgntcgccgcacacgat

SEQ ID NO: 25346 - DNA, 1718 bp, Heterodera glycines
tttacaccaggttttgggactttacagagtgacaccccacccagcaacaaattcatcaccagctgaaaagctattcggtcgcaaattgcgtaccatgttggatttggcacgcccaaccgaggagaacgccgatcagaagaagccaaaagatagtccgacatacagagaccgaatcaaaagaaattttgatcggggaactcgagaacgaacttttgaaattggccaaaaagtttttataaggaattatcgtgatgggcctaaatggtttcgcggtctgatcatcacgaaaaacggggtgatttatttcgttcggactatgagaggtgtttggaagcggcacgctgatcagcttaaaccggggatttgacggtcgaagatcatcaggagaacgaatccgtggacagcgactcgaatgtcggtgatcaataacaggagactgaagatgaacagaatgatggcccagctcctcccgaacttcgacgatcacagcggaccaagaagaaaccgagatcttggatccaagcagctgatccttgataaggagggagggatgtgatgtatccatccccttattatttatcttcatttatcgattaacaagataattcgtgggttatgtttagggatattaaaaaggcatgttctcaaaaacattgaaatttaaccaattccaaaaatcgcccgaaatgtcaaaaacgggaacggacttttcggtttttagttaatacgaaaatttttttaaaaagtctcgggattttcggtctcgagtctagagaatagcctagatcagtttgagaatttttttcattaaagagattatttatatatctaattcaggtattgaaactaccaataactttctgattcataagtccgagtaatttgtttagaaattgattcgatcatggaatctaatcatggataaatttgaaaaaaaacctgcttaaggtaccgggtttttgattatgttaatcaggactgttgcatgaattttaaaaattcaaacacttgtcctgactgtcctttgtttttttaaataccaatctccggtcaaaatcactaggccaaatcaaattccaaattgttaactttttgttccactaaatatttgttcgcaaatttccccccccccccccaaataaagttactcacaaatctttgtggtttagcatattttttggaaaatgttcatcggttatattcaaaaagatttgaagcgaaaattaaaaaattgatatgaaagaattaataatcattaaaaaagttattttttccagaactcgataataaattttatagcatcaattctgaaaatttttattatattttcctcataattagggttgcaaccacaaccacgaagttgaaaagtcgggggtcggggattgtaggggtaagcaaggtcgtgatctgagtcgcggtcggggaaaacattaaaaatataaaaaagtgattttattcaaaaaaatccaaaaaattttctggagctcttttttttttacttttacatttatgaaatttttttataaaaacttttttgagttatgtttgttaatagattatgccaataatggtcaattttgtgggcgttttgtttaaaaaaccctattaaagagaaaaaattaaaattataaaggaacaaagcttcaaccagtatcggaatcatgaataaaattaaacagtaaccactattctacaaaaacaatataaattaaatg

SEQ ID NO: 25347 - DNA, 1626 bp, Heterodera glycines
  misc_feature (1585)..(1585): n is a, c, g, or t
ttttttgagttctgtgaaatttttcagatacattttttaatgggtttcaccatgttaacaggcgggaatttttgctttgtgaaaagtgtcatggtaaaatttaatccgaaaaaattgcaaaatttgaatgaaaatggaaccgaattttgctattgagtaaaaaagcaagcaaagagaaaggtcatttcatatttgataaaatgagtttgtaaaaaaatagaaaatatcgaaaatttatgggttttatacgcattgcagaaacaatgaatgatgattgaccgcgctgttttatgcatttcttaaaaaatttcattttccgctttttgcactataaaaatccttcttcttcccttcctctcattcattcattcactcatttttatttttttccttttttatgccgcaatgttttccgttttctgccccaaattcttttacgctttgagcactatttaaaggtctgggaaatttcgatctaaaaatgaaggggttagaacttttaatctttttatttacaaagtccataagagaattaatttaaaaacttatttaatttatgttttccagtgactttaactttggggaagccgtcaaaaatttccaactgttggacgaaggaatttattgatcgggcacttttgcatatttttgcattaacggtcaatggaaaagtcgtaattcggatacacttatggtgtcggtgatgttgtcgctgcggtgttaatttggccactcgacagataatttccaaaaaatggacattgtttgggtatttaaaattttttgtcgaaacattttgttttccgatcatttatttgtttattttctttgcattttttgcatgaatttgtttataaaatatatttattcgttgctgcatcttatcccccacagaggcgtcaaaaaacaatagaatactaatatttggttgtgaaataaatttccttccttttaatttcaaaagttttctcgatgggccgggctcctttttaaattagggatatggttgtaaataggattttatgttttacatatttttttgcggcttaattacgaagagagaagcccaaaaatagcattttctccgaacatttttgatttagagcagggcttccatttgttcttatttataagaaatgttctgatttggagggtccaaatcttacaaaataaaaatgttcttatttgtaagaaatgttctgattttgggctattattcttattttgttcttatttcttaaaattattcataaatttagaaatttatgcataaatgttcttattttccctataaattaaaaaaaaaatttccccggcggcacctattggcaccgccggacgctaaaatactttattttctttaaaaattggctcaaaaatcaccaaaatttgggcaatttttagacacaatctgttaacaaatgcattaaaaattacaaaattttccccgcggcgcctatcggcgccaccggacgcccatgtccaaccccaaaattttttgaaaaaatgtcgcaaaaaagccttttgaatgtaaaaatggttgccaattgtctcaaaatcgcaaaaaatgataatttttgatganaatctgttaacaaatcagaaagaaattacaaaaatttttcc

SEQ ID NO: 25348 - DNA, 1333 bp, Heterodera glycines
  misc_feature (12)..(12): n is a, c, g, or t
  misc_feature (17)..(17): n is a, c, g, or t
  misc_feature (1188)..(1188): n is a, c, g, or t
  misc_feature (1258)..(1258): n is a, c, g, or t
  misc_feature (1287)..(1288): n is a, c, g, or t
  misc_feature (1300)..(1300): n is a, c, g, or t
aattattcttgnccttntaggaacgctttggctctgacgcgggcggcctaattttggactatcattgtgccgaaatgttcccaaagcgatggtaagtgaaagaaacaaccattttcgctttgattgaacactgttttcatgccctccccccctcccaattttgccgcggttcgacctcgtcattgtcctccgttgtgccaccgaatcgctgttcgatcggctgaccgaacggggctattcggagaggaaaagacgcgagaatttgtaggccgaaattttcggcatcatcgcagaggaggcaaagtgggcacatatatatcgatctgatgtttcattttaattccaattgttaagtcctttttttccgattttttagccatcgcgctgaacgcaaaatgggcaaggatcgactcgataacgccgcgccgggtatctcctgacaatttaatgatatttctggctttacctaccatttcggattatctttcattttgaagcctaatcacttccgtatcacttgggtggccatcgtacacaaactgtcaagcatttaagccattaccaacctttgcattcaactttataccatggaaaactttgacgaaaaacattgaatgaggcatttgttgtcacttaaatcggctctgtttgccgttttaaaatcctgtctgatttttctgtgccgtattccggtcaatttggcatttttgcaaatcaaaatgtaccccatagttttgtttaattttctcttctcagttccctccatccatcaatgaaaatctgtgtccgtatcagggatgggccaaattgaaaaataaaaagcgaaatttgcgaaactgaaaaatgcgaaatgaaaaaaaagcgaaatgcgaaaagccaaaatattcgaaaatgcgaaaagcgaaatttttttttaaattttactaatagcttttgaggttgtgatgcaaaaaaaaattgcattttccggttcgatctttttctcagataaaaaatgacaaattctacccattttgtggttaaaatttcaaaaattaaggtaaaatgaagggtccggcggtgccgataagcgccgccggaaaattttttggaaattgtaataaaatatggtaggaaaagttgcaaaattttcaaaaaatttactgttttttcaaaagcaaaaaaatgcaccaaaaagttcaagataanagcttcaaacgaagttaaaaactcgttttcgtgcatattaggctatagcaagttagcaaaaaagtaattnatttagagtgcacgggaccggggaatttnntgacaaagccgngaccggaactttacgggaccagaaaagccggga

SEQ ID NO: 25349 - DNA, 1521 bp, Heterodera glycines
tttgctcaattccgacccccggacccgaattcaaacaaaaaagttgaattttttttcaaaatacgcattaaaatcgatataattttggcgtaaattgcatattttttatgaaattaatagttaagcattattttggatcaaaataaatagttgttaaatgaattcgaagcttttacccagaaaaatgtacctttggaaaaaatcgaaattttttgttcgaattcgtgtccggggttcggaattgagcaaatccgagttcagtttcgtgatcagcaccctcgaaaacccccaaatactcattttgagctcaaataaaaaataataattttatatttgggacccctattctttacgattgccgccttttctatggaatcggaattacattgtaggcaaaggatgttcaaatacacatcgctcgtgaaaatgaccgaaacgggatttactcttggatcttgccgattcaatttgagctcctagttcaaaaatggatggttggcttacaattagtggtttttgtgatagtaaagggaaaaaggatggagattcgagttcgctctacaactttatatttttacttattattatccaaattcttaattgaattgtttcctatcttaaacagttctattttttaaattaaatgtattttaggcacaaaaaatcgcgaaataggcacaaaaatatacaaataaaaattttattaacactttttatgtagcaaaacacataaaaatttaaatatttcaattttaaaagaaattattaaatactttttaaagtttttttttcgattgaataaggacattactaaagatcaattgcaaatgttttaattaggtaagaatagaaagggtttaaatggttattgtgttttttaataaaattccttcagcaaattgcacgtaaattcaaaggatgttgtgaagggaagcagccaacagattgatatccgaacgaagctgaaaatttgaaaattatgtagccataaccctttgtttgtccatctcccgaccaccattttttgacttgaaagcatgttttcgatgtccccggatgcgattcgaacaaagtcgaatttcgcatttatttgttactctgacacaaaattcagtttggtctctgtttgcattaatgaaacgaattactgaattgacggccaacatcagagaacgtttgttgttcagcacttccactgattctgtgtacggattgtagcggacaacgaaggggcggttcatattggaagtgaatgtgctgaaaaggacggaaagtgccaaatagaaattggcacttttattttgagaatttattggaaaagcaccgaagcttttgctgagcttcttcaaagtttcgcgtgaagaagtaggcggtctggaaggtggtgatcagacactcctgctgcaccactctgtccgggtcgaagcgcaaaatcgccgaatttccctccaccgcgtgctgaaagagcggaggaacaaagatgaagctgaagggtgaacagctttatccacctgaagttcg

SEQ ID NO: 25350 - DNA, 767 bp, Heterodera glycines
ccttatttaaagcatttctatcacgaaaaatttctgaaaaattcaaaaaaaattttcacccccagaattcggcattatgccaaaagtgcatagtagtagtttggtccaacatatatttatattgttgcaatgcacgcagggcttattaacacattattttaagcctttctatcataaaaaaatggttagaaatacttaacaactcctcagaatccctgcgtatcccccctaattctgaaggcaaaaatttttttgaactttttgaattccactgcagagcataactcaatttaaatttgagctaaaagtatgcttaatagctcattagaaccgccaaaatgtgaaggtgtgccctttctccaagcccaagacgccacctataacacccatcgcgttagaggccgacaactgcggcacgttcaaaaaatttgcgaaaattttcaaaaattttctgaagaaacttttttttacgcaaaaatttcaaaaaacgctttccaccattcgatccgcaatcgaaaagtgccggaaggatgcgcaaaccgcattccgctatgagcaaccgttcgcttatttttttagcaaacgtcatttcaggctacatttttcccttatatagagaataatttttaggtaccccattttattaagttttgttggggaatgaatcgagttattgccgatcaaaataaaaaatacaaaaaatgcagttaccagtgtaaattttgaatcagcgcgcaaaaaattcgccaattacgctatttggcgtt

SEQ ID NO: 25351 - DNA, 1978 bp, Heterodera glycines
tgatcgcgacaactcttaactgcccgtcccctgaacagttcatccatgatgtgaggcgccgcaaatttttttttttggcattttttcacattgctaattgtgtttttcaacggcacaggtgagcatgacgaccatttggcaactgtgcgaggacgcgaccaatgtgctgcgggaccaggcgtcacttgtcgagacgaaaccaccgctggtcatgtgcggagacatccatggccaatttgtggacctgaagaggattttcaacaagatgggctacccgccgttcaccaaatacatgttcctgggtgacattgtcgaccgtggcaatcaaagtgtggagacgattgtcctgctgctgctctagatgtcgtgccgtgccgcgggagggagaatttgatcattttgcagggccaatttccctccccccccccaattttaaggtgcgctacccgaccgaattctatatactgcgcggcaaccacgaatgtgccagcatcaacagaatgtgagtgctgtggtgccgtcccatgtgtcacattttaactcaatttcagcaaaaaaaaaatcccccccccattttcagatatgggttctatgacgaaataaacgagcgttatggacaccacaatgtgcggcctctgtgggagcggttcaacatgacattcgcctggcttccgttcgtcggattggtcagcgactgtattctgtgtgagttttttgccgttgatcggctgtctgatcgatcggacgaactctaatccccccacccttttttaaggcatgcatggtggaatcgcgccggaaatgaccaacattcagcaactccgcatgctgcgccgtccgtacatcgacccgccagttccgtccctggagctcgacctgctgtgggctgatccatcaaccgttgtggaaggcacggcacccaacccgcgtggagtgagcatcctgttcgatgccgatgtcgtcgccaatgtttgcaaaaagctcaacatcgaattggtcgtccgcgctcatcaggtggggctggagaatcggcactgcacatggacgactgtttatcgaagcgattttttttgttgcgcgtaacgcgttgtcaatttttcgatccgcgttttgcctatttttagagggaatagtgggatttgtgtgatccggaaaatttgtctaaggaatttcattcgccccactttttcagtgtgtgccattcggtgtctcattcttcgccaactcctacatgctgacgctgttctctgcgccaatgtatcagactgaaaagaacgtcggagcggtgctgggtgattgacgcgaagctccaactgtccttcagattcttcaaaggctctaccaaaattaccccccaatattggtccagcatctcgatacgaatgttctttatgtgttttgcctgtatcacttaattttaaaccaaataagctaattttcaagccgcttatcattcgtgccaattttttccgcttttcatccttgttgggaggagatgcgggattgagagtccaaaaatccaatgaattcctcctcttttttttagttgcccccgtccctccccctttttagtgcgtcccgttttgtgtctcgttcttcaacaatgcctaagtgctgatgctgttctcatcgccaatgtacacagattgaaaagaatatcggaaggatgcaaagacagcacattttcctttacccaacacaaataaatgccaaaacaagtggtcgaaagaaaaaaacgggggtttggagggcttccccaatgcggcacccttaggacggatgagcaccgcactggtttggcaccaccaaacccccaaacaatgaaaaataaaaaataaaataacaaaacctgggtttggcgggcctccccaatgcggcacccccagctagggcggatgagcaccgcactggtttggtacccccccaaaccctgcccccaacacaggaaacatccgccccttcgatcacattcactcct

SEQ ID NO: 25352 - DNA, 1628 bp, Heterodera glycines
aatggtgaaatgcttacttgccacttcaaattttggtactgatcaatctctttatcaatttaacaattaaaatgtactaattctgcatcgaatttgaaaagcacaaatttgagttgtgaccatgaccggtcgatgatcgtctctttatctttgatgtcttaatcacatgtagcctgcagtgatcagcaaaatggtgatcagagtgactactcgaaccaatcggcggatagttaggcatgaaaaagtgggttacatttcaaacaaacgtacaacccgataattcctacacaaaaaacgcttataaggatgaaaagttgaggtccgcctaggacccaactaaaaactcgataaaaatgttctaggatcgaaaagtcgggccattgagaacccctttcgactttatttccagaaatcttccattcgcctctaatagtaggcaaataatgcaaaagtccttccatggtaaagttggtactgcccccgaggcaagatacatgacgaacggtttttacctccccttcatttagggataatgacacattcatttttattgatttttctggacaatgtgtaacccaaagggcaccattatcacaaattatatccgccaggggattgccgagggatgccttacaagtgaagttaaaacgacttcccatccgacatccatagcagcctgttaagccccctggtgtgattatacatttggccatatctctcctaatgcttagagtcaaaccctccatttttaaggtcatttgaacgggtacatattcactcagcccaaacctgcctaggtttacgataattaagagttaaagggccgaccgagagtggtaatcgtttagacggatcgttccgccatctttcgatgtccacttccttgcagtggcatcgaacaataccttcgctgtgatcgggacggcattttgtgcatgcgtccaacgaaagggcgcatttcatcaacaatgcatctaattcgtttctacaatgtaaagcgggttcaatgttcggaacgagaacagcactgtccgatccgccaaaaaatgtttcggacattattggagccgccgggttgccaaaaacggctggagtgaccgacaaattagccccttttatgtgaaaagtacgacccgagtaaagctctgtctcttcactaatagtaatgcccccactgaagctaactttaatttccgttttaattcggaattgccatgccgggcatctgaacatttcataaacagaaccttccccagttagggtcggagttgcgtagttacggaaaaacaagcaagcggaattagttccaccgcatccatggaaccaaaagctgctgctgtctaagcagaaggaattacctgggaatgagttaccttcggccaattctgaaacggttccgttgggcaacaagttttcacaggttttgccggaacatgagcccatccctgggcatcttttgctagcgccggaaattttgaagttgcattctttgattctcattgactcattcatttttgacatcatattcatggcagaggaacggcaacatgggcaacaaagtcgggaccaacgggacagatatagttctattttttctgaggcagttgatgcggaaacggactggaatg

SEQ ID NO: 25353 - DNA, 1874 bp, Heterodera glycines
aagcaattttttttattaaaatgcttccgaatttttttgtataaatttcaaaaagaccaaatcaacagaaatagtgattgaatgggcttatttatcgaccaatttgcgctttgtcccttttttcttcaaccgtaaaatcaatggccaatgtcactttgtccccctctttttcataaaatcctttgtccgggtccatcaatttcttaattttacaattattaagcgaataaaagttgttttaaagccactcactgtaaaagtaatgaaatgaggaaatccccagctgtccgattccttattaaaaacatggtcacattttgtcgtcaaatcctccgttccgagattttgcgaaacaattcgaagggttgccgaacattcgcagctccaatttacatctggcaatctcacttgtatgaataagagggaaacgaattttgaacagtgccgggccaagagcttcacgacgattttcagcggaacattcgatggcatttttacggcatttttcgtcggcccaacggagtgcctaaacggaaaaacaaagatcaatttaatacaataaaattaaattacaaattacagcttgccaaatttcaaattcatcgctgatcaccaactgatcacgtacgaataattcacaaagaaaatcctggtcaatttgcaaaaattcctctgattcgaacaattcgcccgcattttgacaaatgtaacgcaaatattggtgagcaaaatcctatataggtattataaaaattaattttttttggaaaatatacattaaaatggacacttaattaaaaaaagggtgttccacctccaaattgaaaagacgagcatgggcatgggccaagaaaacattgggcagattttgaattggaatttgcagacaatgactgaccaatccatcgatgccgtacttatcagctaaacaatcataaaatttctgggaaatattaaaaacaaaaagcgtaagtgatttgtaattattttcataaatgagagcgggtcgcaaaagattaaattaaattaaaaattgacttaattgcatataaattaaaattattttcacccgcgtaaagcactgccattgcgttttctccgttcaattcgctcaaatcgtccgcgtaaatgaagctgagcatcactttaaacgctgctgcttcaacatcgggcacttccatggggcaattagaagaggctaaattaaaaaatatattaaaatattatttaaatttttattccatcattttcggaccattttctttttttggttcctttgggtcaaaacaaaacatcggcccaaaaacgttggaagcgtgcttcaaaatgagtttgtgagctggcagaagctgaaaaaagataattttaaaactccaatttgaatgttaaattcgtgatcaaaaggggacggatttttaggctttttattatttttcctgcggctttaattcattgagaaaagcacgacgctcctgtatgccgctagaaatcccttatgtttgaccataaaaattccatatttttgaattttcgcctctaaaaatgtttgcccccattttgacgttttgcccttattttacacattattgcacgataatatctttcgatgtgaaaagatcatttggcggtgataggccaaacagaacagctttcctactagagaccggacgggatcgggatcccgcgggatttcttcgggatcccgcgggattaaattcgggatcccgacctcgggatccgtcccgagcgcttttttaattcatcgggattgatcggatcgggatttcatcgggatcccggaaccgagatccctccctaccattttaccaatccccgcggggatcccgccgggattgaaagcacgataaattttt

SEQ ID NO: 25354 - DNA, 1691 bp, Heterodera glycines
gaaaatttttttttttttaaattccaaacagaaatttcaaaaaaatccaagagagtttcaaaggaacaaatttttgaaaatttttcagcgatttgtttggaaaagttagtaaaattcatcataaaattttaataagtcgttagaaaattttcatattttttcttataaaaagaaatttctagttatttttttgaaaatttctacttgtaaatttgggcttttgcctccctttggaaaattgttggccacctatttaaaattgtcagaaagtaatattaatgaatatcccaaaacaacaacatggagcaatgccaattatctacaaagaccaactgtgtgaaaaattattaaacttttttaatgcattttctatgtccctctccccattttcaaggagtttggctatcttactcaaaccacacagtcggaggcgctcatcggactcttcaaaggcatattagcccaccaatagataattgatcaatttgacgctttaggacaaaccgagtgcaaaaagaacaaacacggcgaggcgcgcaaaacggagtgagttggccggtggaaatttttttaaattgttttttttggtttaatcgggataatagagaatagaaatgttgtttcggacttttttttgttgttgcaaaaatgctgttttttaatgtttttcgttcaattttttgattgtctgtaataatataaaggaggccgggttcaagtgtttgccagaaatttgatttttttttcctcacgtagaaacaagaaaatatgtgaattttgtagtaaaaaattttttttttggactttttcaggcgtttgggcgtcatcggtgccggtctgatgggcgctggcatcgcaaatgtcagcattgacaagggcattcatacggtgagactgacacacacaaatgggtgggggggggatgggataaatttaatacaagaagaaacataactaaataaattcggtggcaaattttaagtgcgcaaaaaaaatcgcttaatttcgaacgaattaaaaaaacataaaaatttttttttgccgtttccatttcagactcttgtcgacacgaagcaggaggcgttggaccgcgggctgaagcaaatcaccgcccaaatggaggggcagctgaagcgcaggaagatcaacgctgcagagcacgccatctgtctgtcaaagctgaagccggtgagttggagaaacaattgcattccaagaaaatatataatttatattagggcccgaatttttagggacgaaaaattccaatttaaaaatgtcgccaaaaaaggtaaccgctggagaaaaatctttgtagcaatttttagccttctcacttaataggactaattttttgccatttgagtcaaattccaaaaatatgacaaaatgggggttctggcagcacggaaaattttgaaaactttaatgcacttaataaagtgagtcaaattttaaaaaatgttagccttttttttaatttttatttcggcggagtggaaattccctgctctaatgtaatttaaaccaccataaaaaatacaagaccataaaaaatttaacagaactaattctttgaaattttgcagactaacagaggattcttgggacaatcgaatcatattaagatattttgtattaaaatttgggttcaactacaattttaagcgtggaactggcccccagggaag

SEQ ID NO: 25355 - DNA, 1261 bp, Heterodera glycines
tccctcccttgtcttcaggtcaccatccaaatgctatggcctccgttacggcgacgcttttgtgtctttgccgctgtaacggcgcaggataacagcaacagaaacggtgcacaaagcgatggcaccggcacagaagcggcggcggcggtggcaccgcctcagcagcggcaattgaaaacggagttgctgctccgcctttgcgagtactttttccgtgccgcgttggtggccaccacgagtgggtgcaacagagattttgcacggcacagaaatattggcaattcctttcctaatttttagtgctcatcgcgattggcgtaccaaatctgcaacaaatcatggtgggtgagtgatgtcttctttgctagtcactgccctaattagttaagaaatggcaaagttaggcaatgggtgggggaaacgaaccaacgcctcttccaaccattcattgggagcagggatggacgaaatttcgtttcgtttcgtcctacattttcggcactttttgagtttcgttttcgtgtttcgttttcgtctaccaaagttttttcgtttcgttttcggtttttaaattttggattttcgtttcgtgtttcgttttcgtcagagcaaaattggacgaaaaagacgaaaatatttacacccttaagaatgactttttggtaagaaaaaataagatatttattgaagtattgtattaaatctgctaagaaattgtatgtagtttttaaaaattttcccggcggagcctatcggcgccaccggaccagggctggagcgcgaccgcgatccgcgattcgcggcgtttttttttgcgcgatccgcggccgcggcaatttgaatgcgcggtgcgcggccgcggtttttttttttgcgcggtgcgccgcgcatttttaagcactggtaagaatgggggtctggtgagaaaagagaagggaattggagaggaatgagaaattttttagaaaaaaaaatattttttttatttcatttaaagtattcctccataatcttatgtgttgtagtggctaaaccttctgaccttcagtgtttgtctcttgggttcaattcctcaacggaacagaaagttttttcatattttctttacattatttcaattgaaatttaattattaaagaaaatattccaacttttatttttctttaatttttaaacagcctaaaatcacaaattaaccttggtcattttttgacaaattatgttaactaatctcgctgaaaatatcaaaaatattccggcg

SEQ ID NO: 25356 - DNA, 1343 bp, Heterodera glycines
ttttaaaaaaaaatccccataaaaatttttccttaattttttgtctttttttccaaactttttttccccctaaaatttgcccaaaaacgaaagggaagttataattttggaaatttccctggattttccagggcccaaattttgacgatttttcaaaaaatttttacccctttccaaaaaatctggaacgcaaataaaagcgtatatacgtttcagcacctcaaattatgccataaaaatgcattttggctaatttaggagcaaaaaaatttttcatgaaatgcaaaaccatggggtcccccctatggtttttaatttcaaaattcatttttattttataactttttttaaactcatggtaaaaacatgagataaagcacattatattgggcttaaaattctctacaaaaaagctcttagacgattttttgataaaatcaattcctgacaagttattgcgccagaactgaaattgaggcctagcaaccaaaaattttctatttccaaaaaaatttttaaaaatttttctgaaaatgacaccaatcgatagagcatgaaaaacggttgcttgaaagtggtcttcgttttgcccggaaaaatctgcaaaaaataataaaattcaaaaacctcaaaagtgacgagggggcctagctcgaaaatttctgaaaatttcagaaatacaaaaacatggttggatagagctcgtcgagctgtacaaaaaagccgcttacaccgacatcctccctcaaaaccccgacgagttattccaccggcgctgaaatggcccaaaaaagtatgcaatttttagtcagtttttcggaaaaactggtaggccctaggggttcggtgaagaagcaaaaaatgtgccaaacattccaacttaaaatcctatgggagcggatttttcatttaggcctttaaaaaatttttgaatcccaaaaactgcaaaaactgcttcgaaaaaagtgacttttcggcgcctggcgctcagttggccctcggatcggaaaatctatagttttcctgaatgcgccgtcaaaagttacccccaaggtcgaaatttcgaacccctcccggccttcggccgggagattttgtttttggaaatgaaactcactgttgttctaaagtatataaactagcgtgtgggaattgacgggggcggtgtaggcaattggcttttggatgaagagaaaatggacatgctcatttgttattttaaaacatacaaaacattaattgcattagtgtgctgttttaaagcgctatcgcgctatgggacgcggcttcgccgcgtcgctagaaagtgatgtatttagcaattcatcgcagcctcaggacgg

SEQ ID NO: 25357 - DNA, 1193 bp, Heterodera glycines
tgaaggttctgtttttgtgtgtaagaaaaaatttgtagttttgctgtttatcatcatttttttgtctaaattttctttttgttaattgatttgattttgatgtgaaagcttttgttttgcttatgtaaacgataattgagaattgtttgattaaaaaaatgcattaaagttcgtttgaatgaaaaaggtttgttacttaaaaaagttttttgtacttttccttgcttataatatgaaaagaatctgatgtggtttttgatatttgttttgaataaaaagcatgttatgatagtaataaaaatgaaagaaaaagcctttgatggatagaaaaagcaatataaatgctacatctcatgtttttcctgtgttcgagtggaatatttatatgcaattgggatattgacgtgccacttgcgggatcaaatttaggtggaaagttttaaacaggtcagttttaatttgaatttatggggtgggggcaataattatacaccatagtgttttgatttatgggttatatttcaatttctggattccttttaaatagttctgtattccgttgctgaggttgagttccggtgattgaaatgtcggagaactgagtcccggtaattgtgttgctgaaggattgatgagattgagtccagtgatttgaaatgcagaagaattgagtcccagtgattgaaattctggtgaattgagtcccgttgattggaatgttggtgggttgagtcccagtgattaaatgatggtggattggcgcagaaaattgtgggggggccgaaggccccagtacgagcccgcgaagcggccgagcgagtacctttggcgcagaaaattggtgtaaggggagaggggggggggttgggggaccgcaggccccatacgaggccgcgaagcggccgagccctccccaactgttcaacatcccaaggcacacaaaaagttaaaaatgctaaagaaatttgctgaggttgaatcccggcgattggaatgttggtgggttgagtcccagtgattggaatgttggtggattgagtcccagtgattgaaatgctggtggattgagtcccgttgatcggaatgttggtgggttgagtcccagtgattggaatgttggtggattgagtcccagtgattgaaatgttggtggattgagtgccgttgatcggaatgttggtgggttgagtccc

SEQ ID NO: 25358 - DNA, 1998 bp, Heterodera glycines
ctcatttttcctccgctccttatttttcatttttccattttccattttcttttttcaatttttatttttatttttcagtttttcatttgtttagatgcaaaaacctattccttcaaatcgccccaattcttctgtctccaaaacccttgcctgcgggcttgaaaaaatggtgaatgcgagtggaaatgagccactcacggtgccggtgctggcggatcggagtgatccgctgggactcaagtcggtccaacccgacacggtgccaatggaaagtgccgagggcaccaaggaagtggaaataatggaagtggatgaaatgagtggagaaaaagggaaaaaggatgaaatgggtaaagaaaaggtgaaaagtggtggaatggaagaggaagaagaaagtgaaggcagtgaaagtgaactgctaggagaaggtggatttgacaatttgaaattgaaccccagcctgagggcgggaaataaagcagttgaaaaggaagataaggggaaaccctatctggtcgcccaagtgagaagcgacggtgtgatcgcggcacggatgaaacttttctgggatttcccggaattggtctttgtcccttttagcctcttcgacaacgcccagccgatcgaaatcggcgatttgttccgcttacataagtgtgagtggacgaagagcgaaacaggatgggaagagcgcggagattggctgtatgaagcaaccggacggctgaactaccaagccacggcaacggacgtgagccaattgcgccagcgcatccccactcaggccgtcggcattttggtcgatgtgcaaagagcccgtgaccgacacgtcaaagtggccatggtgtcagcacctgagctgagctgcgtgatgcgcgcctaccgtcgccacttcccggccgatttcacggataacgacatccgctaccgctccgttgttcgtcttcaacttcggcagatcaacagtccgccatgggtgctgtattcacagcagtttgcgtatgttttgccatctgattttggtaaaaaaaggggcgatgaactgctcgttcatcacgcaaacgtcattgctggcgttgagcctgagccaatgggctatgagttccctttcagtgccgaactgagctgggcgaaggtccagctgggtgagaaggtcatggcggcggctgtcgcagcacaggcattcgatgtgaaggctgatctgcggaagcacactctgttcgtcgagccggtcgtcatcaatgagatctcgacaagaagcgtgatcatccagttcgtcatgccggtgccgagcatcgaagagctgacggaattgtgcaaaatttgggaggtcgatttggcggtgggttgcaaagtcaatccggcagccaaggcaaagccttgtgcgcatgggtatgtgctaagcatcgaaaagcgggcattctgtgtaggatacgaaattgatgttaaagtgatcctttcctaccaagaagcgaaggatcaggacgcgcaggaggaattcgatcagatgcgctgcggcgaactcgacggatgcgttgaactcattccgcagacgtcagtcagggccctgcaggaacggatgttcacgctgcggtccaatgactgctcgaaagtggcgaaggacgaggcaaaggtgggccgaatcatgtcgattttattgggccgaccggtaaaaccggaaagcccaaaggccaataacccattaatgacttttggggctctttcaaaattgaaagagggacagatcgacaccgcgctgtgcatgctcgacgaggtgccgcgccttgtcttccaacaggccgggcccggcaccggcaagacgttcagcgcggcgtcgatcgtggccacggtcctggccacggatcccacggctcgcgtgttggcgctggccccgccgaatgtcgccgtcgtcaagctggtgctagagatgcaggatgccctggccgccggaaaccacgtagagccgaatgcttgccttgttctccgggacaggtaagt

SEQ ID NO: 25359 - DNA, 1381 bp, Heterodera glycines
tatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaaatgcaagctgatgccgtcggaaaagctccgattttttggggaaagtttttttctttcaagtttcaccactgattgttgaggcgaatttttttcgccaatttcttttgtctacaaacattatttattgcgtttcatcctgtagtgtgtaaaaaattttcgagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgctattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccccttctcttgaaaaaaaattgtcactaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtctcatcctgtagtgtgtaaaaattttcagtaaaaaaacttgttatctgaatattta

SEQ ID NO: 25360 - DNA, 832 bp, Heterodera glycines
aatgtctacggtatatttatttcttcgtttcttcaattccacaacacgacgcatttttggtaaaagtttttttattattaaatttaaaaacaattcctaaaaacaaaaacaaaaattcatcaaagacgaaataatttcacaaaaattaattatttgtattttacgaatttaatttattccataagaaaaattttatacttattttttataaaatggtcatttcgtgatttgagaaaaaaatttataaaaaaagattaatattttttaactaaaaaccaattaagacgcttttttaaaataatttattgaactataaaatcaatgcgaaataatttatttaaaaaataatttccacaaaaattgaattttcattaaagcatttttcattttccacttattattattgataaaataatttttattaaggaaacttttgaaaaatatatttaaaattcaaaatgaatttattcatattattccttttgaatattattttatttttgatcacaaaaattgatcaaattaaaacagtcaataaaaaattagaacagaaaacatttgacgaaatatttggagaaaaatggcaagaaaaagaagaagaaaaattggaagaaaaaagaaaaataattgtaaaatattataaaataaaagagaaaataaaggaaaaaggaagaaaatattcagcgaaagaatggaataaaattgatggaaaaataacgaaaaaattggggacaaatcgaaacaaaatttataaatggattaaagaattgggattaaatcaacgaatacataaaagctataaatcaaaaactgatgaagaaaaattagaaat

SEQ ID NO: 25361 - DNA, 958 bp, Heterodera glycines
gtcggattatccactatcggattgtcctcactgtcggatggtccgggagcccttgcgacgcccaattaaagcgacatttgcggcgcagaattaaaacatccaaaatttattaaattgatagaatttgttatttaacaattatttccaatttaagaatttctaatttaacaattatccttttaaaggtcatactaatggcccggatttcgttaaataaatatttacatggtagtgatttttttatttttattaaaaatatagttatgattttcgattgagctccagtaaaaattgattcaaatttatttaatcaaattattttccaattggcaatttaaaattttatttaatcattattttaccaattggcaattatttgtcaataggataaaattattattattatttctttgaaattaaacaggatttccttattttatgagttaaatcagtagaattatgaattacgtcagattttaatcagaaaaattcatttatatgcctcaaaaaatgaattgcgatttaattgaagaaaaaataaaatcattttaagacgacaaaaatgaaattattccctttattatttttaattatatttttaataattgtcaaaattgaatcagaaaagaaaaagttacagcaaaagtcatttggcgaaatatttggagaaaaatggcaagaaaaggaagaagaaaaacgaaatgaactcaaaaaaagagaaataattggaaaatattataaaataaaagagaaaataaagcaaaaaggaagaaaatattcaagaaaagaatggaataaaattgaagaaaaaatagcgaaaaaattggggacaaatcgaaacaaaatttatgaatggattaaagaatttggtcttcaaaaacaaatacataaaagctataaatcaaaaacggatgaagaaaaattagaaattgttaaaaaattcattggaatgacaaat

SEQ ID NO: 25362 - DNA, 1456 bp, Heterodera glycines
taagggtttgcggggtcgctgaacacgaatcggacattcattttgaccaatttcgaatcccggacccgaatttggacgaaaagtcgaaaacctaaattttcaaaaattctcaattttgttcctaaattgattaaacatgactaaatttagtaaaaaaccattgtaacaataaaatgagtcattcttgcagattctaacaacattgagaattttgaaaatttagattttcgactttgttcgaattcgagtccgggattctaaattggtcaaaatgaaccacacatttttggcccattcctcgacccgacgcgcgacatttttgggcctgttcccttaaaaatctagtttttggattcagcccctccgaacccaagggtctctggctacgcccttggagcgcaacccaaaaaaattgtccgaattaattaaaatttcctaagactatgggaagtaaaaaaattattcgatgatattttcctaattgcactgctttgccccccccccattctcaccgccagttgtggctcttctgtcttgctgtccttgtaaagtgtggtcagtctccgacacgtcaattttgttgtcaaactgaagtatttgtccaccaacgcatcgaaacggacggaaagcaaagccaaaatgaggccgagttggaaatggtccaagaatgggagaatgcgcagccaagaatcgttgctcacatggcttaaatccacttattcttacttaaatttttcagcaaatttttcaaagttttatgatgaattactatgtttttcaaaaaattttccaaaaaaatcactgaaaaatggttaaaaaattggtgctggtgcgtttcttaaatccgccaatgggtttgaaaacaaaaaaaatgggtaaaatatataaattcataacttgactcaaattcaaccaaattaatttgatattatcattaattagctttaattgttttctttcagaatataattttccaaaatttttaacttaagtataaaaaaagttataaaggattgcacatgttatgttttttgcaatggtcatgcatatataaataaatataaacatttaaaattttaaagtctttaaaaaaagttctgaacaaaaaatgctggcttaacactttttgaattgttatgagaaaactttttttatacttaagtaaaaaattttggaatatcatattctgatagcgaacaattaaggctattgaacgataccgcaagaaatgtttccttgttagacaaaattaagtaagtgttgggtcaccaaagttttgaatatatgttcaaataataaaattttaattttatctattttaaaatgattcaatttttaaatatttaatgtataaaaaatcatgaacaggaacggaccgcgtccagtaagggaaagaggcgacgcgttggcagcacagcgggggatcgggtcgcacaggcgtgagcggcggtttgcg

SEQ ID NO: 25363 - DNA, 1812 bp, Heterodera glycines
  misc_feature (1705)..(1705): n is a, c, g, or t
gaaatatttttccataatttgcctcattttggccatccgtttgtccaattattacattttgatcagtttcattctctccgttttcctccaatttttcgtcccatttttggccaaatatttcatcaaagtttttttcatcgtttatctttccagcataaatgttaccaattgcatttatgaaaattaatattaaaaatattattttaattttcagatttctgaataaaaaatcattaaaatgaatataaatctttttataattggttttattcttcaatttattcggatttactgcataacttcactcacaatcagcaaattctgcttgttttataattatgtttttttcaaaaatcctcttatggctttataggattatttttgatgaacatactttgcaaattacaatatttgaataaaatgaaattataattatttttacttattctaaatttatataaattttgcgtaaaacatcaaagtaacttatcaaaatcaatttaatttaaattattgggtaattctaattattgttaatgatctgacaaaaattcaataaaattgaaaaaaactcccttaagaatgaaaagattttctaaaaaattggtcccaaaatttaattattttttattgataaaaatatttggttaaaaattgcctttattgaatttaattaattaatttttctctaaaaatttactttttttggccatatttactcatttttcaaaataaaaataaatatgaaaaattaatttggtttttcaactaaaccaattaaaaatgttattagcataatcaacgatttttatcaaatattttttataagcgatgaaataaggattaataatttcataaaccgaaaaaaaattatttataaaaacatttgtaaaaaattgaatattttttatgtctgaaattttccaaatattcttcgataataatgatcgtcctaattatagcaatttgttttttggtttaatgccaaatttggttttgtatttgcgtaatgagttttttggaatgtttaaaattttggcaatttcatcttctttcaattttggattttgttctttgatttgataatattgtttaatcttttccattttttcagcaattgataacatttttcgctctgtaaattgaaaaaaatacgttaataaatctttaaattcaccttttgaaacattttgattgatttttaatttttttgcccatcttttaatcgttgaataacccacaccaaaaatttgtttaatttctgctctaaattcttcccattccttcaatgaatgttttccattttgcataaattcattttttacttttaaatatttttcaacaatttctcttttttgctcatctttattttgatttttaatcaattttccattttttaattgtttcttccattgataaatgcttctgatatttatgcccaaatgttttgctattatttttttgcatttttctctttttccctcccatttttcattgaatttcatttttaattttgcatatatttgatcaaattgctttaacattattcttttttcttcaattgaatgattttttttcttcatcattccaaattctcttttcaatttgtaaattttctcgtaactaacacccaatttttttgcaatttttctttcaatttttttccattcttttcttgaatatttctttcccatttgcataattntctctttaattttatgaaatttttcaacaatttctctcttctgtttttcattgaaaaatcgattttgatcacaaatttctttcatatttcttgacatttgttccaat

SEQ ID NO: 25364 - DNA, 1061 bp, Heterodera glycines
aaaataagttccccatttgcgcttaaaaggggggaggaaaatttcaattggagccaattttttgggcatgtagtgctgggaatttcagaatcttggaaaactggcatctttgtggggaacggaaaccggttcggggagaattacaaaataagtcccatttagcgcttaaaagggcgagaaatgtcaattggagcaatattttcggtatgtagtgctggaatttcagaattctcgaaaactggcatcttagtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaactgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcat

SEQ ID NO: 25365 - DNA, 938 bp, Heterodera glycines
tagagtcaaattcacttctcaataatctggctaattattaaaaaacctttttgatgctaaaacggaaacattcattattaaaacatggattttctcacttccatcgctggcgggcgtcgaaagattcgggcaaatccaagtccaaaaagcgcgtcttccccaacacttttttggctttggtcgaatggcttaatttaaaacataaaataaattaattaggccttttttaccggacgtggtttacgcccatcattcgccatttgatggcttcgtcgtaagattggaactttgggctgagctcggccttaatccgatcaaatttaatgtgtatttactgtccctttttaaatttcaattttttaaattatagtaatattattttaaataataattcttatttttaattggtccattatatttattattgtcatttgcccaccctccacaatctctgccgacgattcacataatcgaccagcgattgtccgctgatctgttccgcctgcggcgacggacgcgcggcgcgcaattcgtcgcgcgcaatgaaaacgcggcccgtgtaacggtgctgagaattggacgacgacacttcacaaaataacggacaattgaaaacatttttaaataataatttattatggtttctccgcaacgcaaaattatttattttcattcgatcactttcatcggccgaagaaacgaatgccgagggcagaaaatggcgccgttcgtggcgaagcggcgcattgcgagtgcctaagaacaaaaaaaaaggaaaataagcaaaaatgtcaagcttaagacagtcaaaattgacgaagatcccgggatttcaatttctttagtgtcagggcataatttttctttcatctgagagatggcctcgtggttttctataaatgccattcgccaaaagggtaattaccgaaaaagccatg

SEQ ID NO: 25366 - DNA, 1851 bp, Heterodera glycines
  misc_feature (1556)..(1556): n is a, c, g, or t
  misc_feature (1561)..(1561): n is a, c, g, or t
  misc_feature (1659)..(1659): n is a, c, g, or t
  misc_feature (1719)..(1719): n is a, c, g, or t
aataatttactttttctcatttcaatgccaaatttctttttccatttgcttaatgtttttctgtcaatgcccaactctttcgcaaattgcttctgttttccatttactgctgacattcttttaaactcatcaattctttgaataaattcctttcttttcatttcataataattttggtcattttttatttttattcctaattcttttttccatttgtaaatttttgttcggccaattcccaattttttcgcaattttttgctcaattctattccaaattttgtgagaatatttccccgttttcttaattccttcttttgttgcgtgaaatttatgaacaatttcgattttttgttggtcattcaattggttgttgttctgattactttcaatggaaacagcagaatttaattcattttcattttgccaattcgaattttgatcactttgatcagtttcatttgcttccattttttcattttcccatttttggccaaatatttcggcaaaacttggccgaattttttcattctttttgcacaaattatcgtcaactgataaagtttcgtcgaataaattaataattaaaaatattacaaaattcaatttatagattttcatttcctaaaaaatataaaaataataataaatttgttttacatttttattaatgaagtggtgacataaaaaaatttataaattctacaattatatgaaaatatgatttaatcacaatattacgtggaaaatttttattatatgattataattatttaacattggtaaaatattggttttaaaaaattgtgtaatatagaaaaaataaaaattttttggggtcggatttccgatttccgattaaatttcctaaattttccttatttaaatttgagtgaagagaaaaaatcagcgtaaaattgagcaataaaaaaaatctgaaagtgttgggcatagatcagactaatttttattttttcttgctattttatgaattaaaattttagctttaccaaaacaaatttattacgacaaatgcaagaaaccagaagcaagcatttgaaaatattcgcttttcaattgtgttaaaaatgaaaattacagctattaaaagaacggatgattttaaaaagattgagccgaaaaaccaaaagacaaaagaatggacggagtgtttcggggtttaacaaaattatgtaatcagagaatgagtggacgagacgatttttggggataaatggcaatggacggaatgccaaaactcaaaatggcggaggcccgcggatataattcaacgaaaggccaatgcggaaagggccgaattggttgtacagcaaacagcaaacgaccgaaacgatgatgagcaaccccaattgaagacgccagtggccagtggcttgaccattcgtttgtgtgctgcctgttcctttggctctgggggttttgcgtgcgttgccgccccccgtttcgttttgttctttgctgtccgtctgcctcctgctcgcttgtgttgtttctttgtcttgcctgctgttccctttgttgtccctcgggtgtccntcgcnttggggttcgttgtcgtccccgtcgtcggtgtcctgtctggtgtccgtttgtgtgctgtgctgtttgcgtgcttctttttttgcgttctttttgttcngtgttttcgcttgctctttgctttcctttcgtgctttgttgtgctcccccgtctcggcgntttcttcgggttggttgtgctgtgtgctgtcccttttgttctctcccgttgttgcgctgtttgggttgcttgtgtttggcgttttctgttgctttttgcccgcctcttggcctttttcctgctgcttttttc

SEQ ID NO: 25367 - DNA, 1274 bp, Heterodera glycines
gtcaataaaatgtgattgattgagtttcttatttatttcttttcattatttttagttttctgttccaactatttcttaattttttccgaaattttgcacacctgtcaagaaaaatgattgatgacattcgaaataaagaatatccagacgatttttttttgcagttttgaataaaatgtgacagttgtctacggaaatgattgattaccctcaaaattaaggcaaacccagacagtcacgtgactagacccctccccctttttgcctatttcgcacacccggcccaaatcgcaaatcattcaactaaatagttggatttcattaaactctcttcacgctctaattttatttctctccgctctatttttatttgcattaattaaatctattaatctattactatttacctacgtctttttcttttcaaatctctgctctctttaattcttctgtttcaatttcgtttttctttttaaaatgtcttttaaacgcgtgaactccttccaacccgccgtgccaatggccaaaaaatgggatttccgatcaatcgggtaagtgatttttaataaattaaataaaaaaaataatttcttaaacaattataaatacaattataagataataccctttaagaattatttcaaaaaatttttttttgttcagaaataattttgctgaagaaatggaaaattataaattgatggattaccaatcgacaacttgcgaaaaaaagtcacgtgcagatttcagaaataatggaagagaaataaaaacccatcaatcaattttggttgacaggtgacctacttttgaaaaagttttttaaattatttattcattttcaatttttatttttaaataatcaattttattgtgcaattcaataattattcatggcattgtttgctgctaatatcaattaattcacacttcttccaaattccgttatcgattttttttttcgcggcggcggcatcgcgtcgccggacgggcggggagggaggggggaagaggtgataaaaaccgcacggttttggctaattttcaaaaagaatttttaatttcaggatccgaaaaacccatcataaaaaaaaatctcaggatttgagaaaataaaaccggcccaaaaggtttgggatcaaaaagatttaaatttgcaaaagaaaaaattgaatttccttcacctgtcactttggtgacaggtggatgattgatgaccttcccgcggcgctgccgcggcgcggggtgaaaaaaaaacccccaaaaatttgggg

SEQ ID NO: 25368 - DNA, 2111 bp, Heterodera glycines
aaaaaattgtcaattttctgaccccgcggaagggccgatcgtcggatgcaccgtcaaaaatgaaatgcacaaaagtatttgtattgatgaaaacatattcgttcatatttccttttaacagacaatggttaatgtgtccgttacttcgtcaaccgacccggcaaaagtgcgcgacgaattggtgaacgtgctgagaaaacacggcataatgccacagcagaacgggtccgtttaacagcatttgttttgtcaccatcccattccaataaaaaatatattgaattttctgacagatggaaaatttttgggtcgcgaaaaaatgcgacagacggtgggcaaacgacggtggagttggaagtggtggcgattgaaaacatgagatacgtgggggtgaagcggaagagaatgcagggcgacgcgttcacttacaaaaggatctgcgaagaggtgcagcgagggggcggggaatggtgaaatgaccctgaatcaacccaaaacaggtcctcaggatggccggtctcgaatgaatgaatgaaccgcacgcggcgacggaagtgcgagtaggaagcagcaccatctctccttatatttatatcgcaataattaatcataagccctctgttaatcactttttccttatttcatgttatatgcgttctgttgggccataaccatgaaaaaatccaagggataagtttctctgcccagaccaatattattttttatggtttttggcccagcagatgagaatctatggaacacctcatcaattcctattcattgtatttaatttgataataaactacacattttaacatatgacattttagaaatttatgacataaaggtgcataataagtacaactaatttcaagagcaaaagcggaattttcaaaaatatttaaagctgagatgcaattcgatgaggatgtttaggactatcatgtgtaaaaggatgggggatggatgactaggaggggtcggacaagattctccgcatgttcattcgtcctcgtaatactttctcagtctcacatgccatgcgacggaaccacaagcggaaatagttcggaattggtgaatgattttgcgtggcatgaagtaaacactgttttcacgtagcttaaaaattgtgattgaatatggcaataaaaaattgttggcaaaaccataaatctcgcataacgtattccctcacggcgtaaagtgtttaatttggcctcctcaacccattgggtgcactaaaatggcttttataattaataatcgtaagtgttgcaaacctgggacattggcggctcatacaaatccaacttcaaaatatctgtcacccttttgaagtctgcagcatggaagcaaatcacatctttcactaatcggtcgccgattttgctgtttaatttcggtgtaattttagttcggtttgaagctgcttaccctttttccgtggggcttctgactgcctgcagaaggccaactgctgcagttgtgtgtgctttgttttcgtctgtcacatggtcggcatggcaaggagtgcgatcttcaaagagaatttccctccgctccaacgccctaaaaaagaaaaattattgggcaaattaaaaagatgaccacttcaacggaattccggcacttttagtttgtttagtgccagcacttcccctcctgtgctgttttgactttatttcgtcgaatttcgattcgtccgttcggatcagttgctcaccaggacgacaccaataaattggtccatcatcggattctaaagaagtgaatagtttatggaaaatgtcttctaggaataaccggatggccttttatcagaacagatagtccgttcactccatggcagcaaaatcctcagaaatgggcattcctctaatcgttcaattaagtgcttaatttccaaatttattaaggttatgtatacaagtaccgggtacaggctcgaggagatgcacttctttttcccccgtcgtttcccccggaaattaaaatattcacgaaaaaatcttagtaaattcttcctatcttgaaaacggtgaaaactggtaaaaaaaaacttttttaggggggggggggacaatgcgagtggaaacgggggggggggg

SEQ ID NO: 25369 - DNA, 1690 bp, Heterodera glycines
attaataaggtgaaagtttgaaaatgtttattaaaaaatttcatggatgaaatacaaataaaataatcaaaaagaaaaaaaataaatttatttttctaaataaataaaaaacattgtcagaggcagtgcctgccgaaaaaatagacaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaataggcatatttaaaagagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaagaaaaaaaataaatttatttttctaaataaataaaaaacattgtcagaggcagtgcctgccgaaaaaatagacaaaattttttcaaaaagccaaaaaaaattgaaaatttaaataaatttaaaagtgtaaaaaaataaagtaatttaaataggcatattttaaaaaagcctatttttttgccttttcacaagagaatttattaaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaaaagacaaaaaattttttgaaaaaaagccaaaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaataaggtgaaagtttgaaaatgtttattaaaaaatttcaggatgaaatacaaataaaataatcaaaaagaaaaaaaataaatttatttttctaaataaataaaaaacattgtcagaggcagtgcctgccgaaaaaatagacaaaatttttttcaaaaaagccaaaaaaaattgaaaatttaaataaatttaaaaatgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggccagcaattaaagtcatttaaataggcatatttaaaagagcctatttttttgccttttcacaagagaatttattaaaaaaggcaaaattcgccttaaattaataaggtgaaagtttgaaaatgtttattaaaaatttcaggatgaaaatacattaaaataatcaaaaagaaaaaaaaaaaaaaaaatttatttttctaataaataaaaaaaattgtcaaaagcaaggcctggcccaaaaaaaaaaaaaaatttttttccaaaaacccaaaaaaaattgaaaatttaaataaatttaaaaatgaaaaaaa

SEQ ID NO: 25370 - DNA, 1231 bp, Heterodera glycines
  misc_feature (1227)..(1227): n is a, c, g, or t
aggtgcaggtgcaagtgtgtttctttgcagtgcaggtgctaatacagatcagatgcaaatgcatgtgatttgtgtgcgtgatttgagcgcaggtaggtgtgtgtgggtgtgtcaggtgcaggtgcaagtgtgtgtttccttgcaggtgcaggtgcagatacaggttaggtgaaaccccaagaagtgtgggtgcgcatttttgggtgagcaggttgtgtgggtgtgagtcaggtgcggatgcaagtgtgtgtctgtttgcaggtgcatgtacaggttaggagcaaaattcaaaagaataaattcaaaattagtgatttggtccgaaaagaaaagggaaaattcgcaaaaggatactttccaaattttacggcggaaattttttaaatttataaaataattaaatcagaccaaatcgcttatcggattgaagatttaaatgaacataatattaatgggatagtttatggtccgagttggtaaaactttttcagaaaatcaaataaataaaatataaaagaaatccgacaaaaaataaaataaaaatgaataaaataattcttttcgtactttttggtttggtatttggccaatcaaatgatgattgttgttgtctttcgaatgaggagaaacagcaattgaacgctgcgagaaaacccattaaaaaagcatttcgggataccgtcagatttaatattgaagcccgcgatttcgcggctgcttctcatagggccattacggaggcagaaaaaactaagactcgtcaccccgaggcaccgggtatgaaaacatggttcggacgacttttagaaggggtgagaaaagtacaaagcatttctgaaaaaattaacgaagaaaaacagaaaacaatatagacaagacgtgggtagttcataccgtaacgcttacacacagtctgacctcgggatcggggaaaacccctatgctcccgggattcgagaatggttcgtaaaagtatcagattgtatctgggaaatttacaccattttagataaaattaattcagagtctcaaaaggttgagacaatgtggagtgaggtcgatcagtccaaagatttcgaccaggtgaagaagctggaggaaaaggtacttaagggtttgagtgaagcgagaaagctacatttagaatctcgcagaattcacactgaaatattggagctagaaaataaagttcaatctatagtgtgggattttattgggcttcacgangtaa

SEQ ID NO: 25371 - DNA, 1493 bp, Heterodera glycines
ttcttatcccttatggtgaatatttgaaatttgatataatttgataaaattgattaaatgcaaaatcaatttcttcttttgatctagagcctgttaggtttaatttaccacttgaaaatacaatgatcgacattttggggttttggtttctgtagaccaggcctgggaataattcaggagtaaaggagcaacatttggctcctacaaaatcatagagcggcccgaggtgtatgtgaaatcccgcatcagctgtcgcaatcaaattctttaccgcaaattcgtggactcgagcctcgttatacccacattgctttattcgctccgtgacctgctcagcagcttgcctacattctttctcattagttgcccctgtacatacgaattttccagttgagaaaattatggcggtagcatttggattatacactttcataattacagcatgaattttacgtggattatattttgtggagggcgatattaaataaattttttcaatatcgaggggtgttttggtgtctacaacagcaacgcaatttttgattattggaaaaaacatttttaaatgaataataagagaaaattttgctatttatactcgaataaattgaatttagttataatttatttaattatatttttaatttattaattttaattatttatttaatttaattttaatttatttaatttaattttaattttatttaatctgtattatttttattattaataataatttatttttattaacttttgtattaatatttatttaattttaatttatttaatttaatttaaatttattttttaattttatttatttatttttaattttaatttaatttattttcatttccttgatcagttcgctaatcagagatgtgatcgcagatcagatgtattcatacccattgcctactgatctgaactgtttctagcattagaggaacaatagttatccattcattcaagtcccatgataaaaaattatccagtgataattagtgcagaaatattaataaaatgatgataattgttcaaattcattgcgttttcctttcattccgatctgatcaattttccacttattcttttttggtcagctctaatttggtctttccaacgtcttccagctgtcccatttgtacattccctgcattcagactcgacttttcaagtggaaaagtgtatgagccaaagtcgttctcggagaagttcgggatgatcattgtgcctgtggcgaagtccaactcagcatacccatagcgatctgtctaaatgagggccttttaaattgcgttcattaaagaccaatattgtttgtttaatttggtttttagctaggtttttgtccaaaatattggaccagaaggtgtctgtcggtgcgcattggcgataaaaggaaattttgaaaatttaatttcaatttattaacatattttgtccaaaaatcaaccaatttattgatttccgagagcaatttttaaaat

SEQ ID NO: 25372 - DNA, 2128 bp, Heterodera glycines
  misc_feature (1948)..(1948): n is a, c, g, or t
aaaaggaagaagttaagctgataattaaattttggaaaaaatttcgttttgtcggaaaaataattaaattcactgttatgaaaaaggtatttttgaaagaaatataggaaaaaaaatctgcaaatttttccactatgggggtgcctttatttttttatcgaatcgggatcaaattttttattttgcactaattataattctaataacctaattccatagacttaaaattaaaagcccgtatgtcatttttttaatattacaatgccgcaggtcaaggccaaacttaattgatgactcattttatgaatgaattaattgtctaattaattatccatttcaatcaaatttcagttccaactggtgtgttaacaatggaagaagtgaacagcgtgtatcagcattattcccatcaaaatttaagtgatgccactgggcttttcccattgaaatttccaacgcaccgacggaacaaaaacgaaggcacaattgagatggaaattgaaaaagtgtctgaatttgcggtggaggaggtgggaagtcgccgatttagcgatgccatggacattgggggatttccatggaaaataatggcacaaatcgaaacgaaatacggaagcaatgagaaatggttggactttaccctttccaacgatggccttgaaaatggtaaaaaaaagtctttttcataaatctgtccgaatttaaattcaccaaaactaaatatgtataataaacgattatgcagacaaattagacaaagtgtaaacaataaaagaatgcaagaataatggaaattggggagcagttatggtggatttaaatatttcattagttttgcggtgagtgggattcaaataaatttaataaacttcatattttgaaattaaaatttttaaaattttaaaaaagaaagtgacaaaaaattgaatagaattttttgaaattttttggttataactctttgtaaatttttttctagattttaaaaaattaaataagataggatttgataggatatgtaatgcatctcgtaataccaatttttattaattgaactaaatttaagctaagttatggtttcttattagcaataaaattaaaactaataataaatttaaatgtttctatcattgacacttttgtaactttggctcaccatgattttatattacataattgatttaaaattaaagttataatcggaaacattgctgattttcatgttaaaaaaaattaattacaatatttgtcaaatttttgcatctccaaattcaaaattaaggaattgttggatccgggcaaaggattttacgacaaagatgaggacaaagtcacattggccattgatggaaataataattattttttctataaaattggtgtaattaattattgaaaagactcatgtaaacatttaacataaaattagaagtgattttttaaaggaaatgcgttaaaatataaatttgattattatttaatttgctttaagatggaaattggagccgcaaatgttcggcaacatttcgaattgtctctcaaaagagcggtgtggaggattttaagagagaatccagtgaaaaaatgatttttaacaatgaagcgaagtcttgggggaacaatttcatttcatttgcggtgagtggaaattaattagttaatttacattttaatattgtaatggcaaattaaggaattaatggacccaagcaaagggttgtacaacaaagacgaggacaacgtcaccttggcaattgattttacatgtgaatagcgtaaacatttcgagaaggattgaaaagggaaaggaaggaaatcagcaggatgagaagagagtcttggagggcacaaaattttcttggtgcttaaattttatatttttttatagtttgtaaagtattttggtttcataaagcaacatattccaatgatagggatggatttttantgtctaaaaatcgagaaatatatatacctaaaagagttgataaaaagctacttattaagtttaactagtccttttcacatgcattttaaattttgaaaattctatttttgtagaaaattgtctacataaatcgttatttagttcaaatgatttaaataatattaaaaacctctggaaaaa

SEQ ID NO: 25373 - DNA, 1147 bp, Heterodera glycines
tatcaaaaattaataaaatttggaatgataataaaatttgtaaagaaaacaaacaaaacttactgtaattggattattgtacattttaaactgattcatttaccggccatacaataaaatatatttacaaccaaaaaaaggcccgaggctgatcatatcttcgatttttaaatactgatattctacatttctttacttaactatctagcgctttataaaaccgaaatcacagctccgctaatttgggaattttttccaaattaattgaatagcctttttcaaaaatttgggtttttaattttacttttgttgaaatttgcagagagctggcaatgattgagccgataggaaaagccaactttagaaaggcatgcgcacttagagacacccgttccatgtatgcaccgacgtctgccgttgatgcagccagcgttccaaatttggcaaggaactctgccacaatttcagttgctgaacggtaaactagttggttatgagtgagttatgccaattagtcgaagataaaattcaaaaaattttaaggattgaaaaataatttaaattaaaataatttatccgtgtaaaaaatgctaatttgtccatttttagttgaagaataaattttaccacgctgattatcggcagaaccagcttcgttactgtcctcactgtcttcatcactgatttttgcgacgctgagtaaaaaaattgcacttgacagtgccgcaaggaataaaaatgttggcatcataatatgcttaaaatgaatgccattaaataaaaatattatagctgctttaaaatattttccgaaattttttcgattatttaaaaaatataatttcagcgcttgtttttgcgtttttagtcagtggataattaagttgcgctggagagcttctggactagtcagctggcacacaactcagctgatgaggacaactcagctcattttaatttttcttttttttaattatattttaatttatatatatcatttttaaacgttagaaaataatattttaataaaacttcttaatatttcaattagggtagtaaatgatgggacaggcgatgaatgataaatttaatgaaaggataaactttttttttattaatttgattttaatattgttgcttacttaac

SEQ ID NO: 25374 - DNA, 2040 bp, Heterodera glycines
cgacagatattataattacatttaggcacagatttttcttccgttttattataatatgtaattatttactgtattttctcttaaaattgaccatttcttaaaggaaactgataatttgaaaagccaaccgtaaaattaaattagcaatttctaaaggaaagttttacgacactaattcacattaatccgacaataaaatatcattaacggagaatataaaaaatggacaccataaacaattggatgggcaaaaacagaaatttgttttattattttgccttttcaatggcaattccttcgacaattttgtacattttggaaatggtgacaatcataagacataaacaatttgcgcagctgtccttctacaaattgttctgcgtccgagcaattacagtgagcaaaaagcaattttaaaataaattagcgaaaatattttgctgatatttatcataaaaagccctaatttaatgagtaaaaagtatttatcataaaaaactctaatttaataacaaatttggttctattcataaatttttacagcaaaaattcctttaaacatttcattaatcacccaatttttccataaatattttaaaattaaccttaacttatcggaccaatcctttgcccgtggcgcctatcgcctcagcgctttaactttacatttaaatgttatcccgttttaaattcgatactaaaaattattgaataatttttcaaatatgccatgttaaggacattctgtggtttctctcttccagttacggtaaccgtatcccagcactgtttggccaacaattgctgcccttttaccgtatgatgcccggctgggccatcgttctgtgttttttttttgcaacaacagtcgcttaccaagcctcaaatattgccacttttctcattcagatgaatcgtttcactgcaattgcatttcccctcaaacagaaaagggtttttaattattaaaaaattaattaatattttaatttcatccattagatttgggaaagtcaatcatttttgatgatattggcactgattgtgttcgttgtgccattgctaagctgtttgccaattatgaaaatgaacgtcactccaatggcctatgaaagggaaagcgacggatttttcatccaagaaaatgtttcggtatgaaggaaaagcatcggaaaacgcaataatcgagcagagaaatatttagataaaaattctgcatatttccattaaaaaaatattcaagctaaaataactgaattccgaagtaaaagccttagctttggcctctggacttaggcttaagcataagctagacttatgttggttttttacttgactttggttttagcttagaccgtcctagctaagttgattgaagtcggattaaaagccttagttttggcctcagataggcttaagcataagctaggcttatgtcgttcgctcagaccgacttaggtcacttgttaggtctatgatcactgatatattattaaatttttccgttttttagggttattccttccttggctatctcaacggtatgaaatcgcttacttctgttattttcctgctcttgtcgcttttggtcaatttgtcaacgctaattgcctatagaagaagcaaaagagtgcaccaacaaaattcccaaaacggaagtgacgtcattgagaagaaattgctgatttacgcccttctcactttttctggccatgcttttgtctcagtttttttggtttaaaattactaattgctaaatatttatttaattttatatttttagattattatgggcaccggagttttctatgactatccatcgattgtctacacccaatatccgtggatcaacgacttgtgcacttcggtgttgtccagttggatgttgttgttcaccagcagcattttccgccaccaatttgtcaaggacttttgtccaaaatgcatttggccaatgccaacaaacacttttcagacgccagtgacacatttaacacaaaatcaaaatgatcgccgtttatttcaaaagccatgagccca

SEQ ID NO: 25375 - DNA, 1090 bp, Heterodera glycines
  misc_feature (1029)..(1029): n is a, c, g, or t
cggcccaattcggcgcttcctcatcccaccgccaaattgcagtgtccgttctttttccagttttcggataccatggcggcggtggccgggggtttttagttttgaaatttatagaggaagtggcagattctcgggataaaattccactcggaatgcttgctttgcttgtaaattccattctccccccccccttttttagacgcgggtgctccactcggtttgtgccattgctgatgacaattcggcagctttgctcagcctcaaagagttgaagtgcattctgttggccagtcgtcaacagttcccaattgtcgacgtccgctggcgaccgttggatgattttttgttgctccgctgtgaggacagctcagtttatgtgtggcaaattgagacaggtgctgcgcattatttatttgtcatttaaaattgagcatttgtcatcattttggaacattcaaatttgtttacttttttatgggtttgagccaaaaaagtgtccactttggcactgtcaatttcaatttgcctaagtgagctttttgatcatggaaatcaatttggaacggactaaatttcctgtgtttactcttcggagcaggtcgttttccaccacatcgttcccctcttgaaaattttaaaaaattttcaacttgaaaattttcaataaaaaaactttgtttttataaaaaaaattccaaaaagatttaatagaaaaatttttagcgaaattttttaaaataacttggtaattcatcttaaaattctggaaataaacatataaaatattttcaactctgtccattctctgaacttcatctttccaaatgttcagcaaatctcgaccgaattgttgccggactgaccaccgatgaggtgactcattttgccaaaataaactgctggacattaattctgaataggtaatggatgcgactggtgaacaacaattagtggccattagtgcggagaacggcgacgacgccgttgaaaatgggcagcaacaaatgctaaagggtgcctcgtcccaanccgtgcaaatgctcaagtcacagagacagcacagaaacatcgctgcggtaatgtgtggcgg

SEQ ID NO: 25376 - DNA, 1350 bp, Heterodera glycines
  misc_feature (1289)..(1289): n is a, c, g, or t
  misc_feature (1314)..(1314): n is a, c, g, or t
ttgctgcctgcggtctttcacagttccgctgtctgtgttcggctcttctccccttctttctccgccatttgggcgttttttccgcattgagtgcattttgtcacttctgccaaaagggccaaatgcaattgaagtgattttaacatttttgctttatctttgttatcattttgagatgcccaattgttctcaaaatttgtcggacagagaaaagactttaaacgaattgttagccccagcgatgactcatcagaagcgattcattggtaaagtcgagaaaattattcgactgaccaaaaatacggatacacacgacagatatggtcgagacaaaagtttccagcggatggattggagtggaaaaggagggaaacgacgaggagcaaacattggcacaaaatgttgctcaaaaagggcagagtattggcacgaaacagcggcggtttgcgatgaaaaacaatgtcacataaaaaaaaattgtcccaggccattcgaaatttggcacgaccaaatgccaatttcgggcgaaagtgaggaaatgccggtcatggcactgagtccctttctgtacgtttcgcatttcccattccgactttaagaaatgttaagggaacgggcgtattccatcttcgccacgcccgtgtcacctccaattccgccctcatcaactccattttctcattccgcgacttcctccgccgcatcagaaaatgctcagtccgttccgttcccaacagtgccaatgtcaaacgcaccgccggacactccgaccgtatccactgccatagttaacctaattaccgtacccgacatcggaccctcacccgccgtaaattacccggtcccaaaaccattcccccaaacggtgccatcatttgcattctgatactgtatccatcctacagtgttttttacagttttcgcctccttttggccttttcccctcgtcttctgctgcttttttttcttctccatttgttctgcgccataatttttctgagaacgaattggaaataacagcgaaagaagagaaaagggacgacaaaacatttggaggaggaaaagcattgacagaaaaaaaggaggaaataatccgcggatttgtgccattaattgtaggacaaaattcgacgaatgcatcggtagaattgtcagattgttaacaaaaagtggacaatcccttttatgccaactctgcgctctcccacaatttgcccactcggcactgctcatggacaatgctaaacacggcacttctcgtgagtgtgccaatgttcccaaattgaccnaatgccaccgtatgcgcttaggttnggtccatattctcgactttgcattggctttgccttt

SEQ ID NO: 25377 - DNA, 1745 bp, Heterodera glycines
taattttttaaaattccaatcttttcacaacccatagcttatctaggtagcgaagctcccaaagcgcgaagcgctttttcccagctaaatagccgacggttcacgcacccgctagttccatcattagaaagacattacaattttggcatgttattttattttgttttagtataaattttacttgattaaaaaagagattacgaattttcaatattaagtattttattattcctaaaaaatatgaaataatttgtttattgtgatttttgtatttatgttttccttgccattggcttataaactcgggcgttttttagttgccgtgtagatcttttatagtgagtgggtgatctaacgcataaattaaggtaattaactatattatcattaaaattaatctataaaattgcaaaacaaatttcatttcattatcgaaatactgattctttggtttaccaatttaaagaatttcactgttttttgttacttggcctttaaaaatttttttatttaaatataaacatattaacgagataaactttttttaaataagtcaaatttttaatattttaaataaaacaagcttttattttaaaatttatttatttataagtattgaatccaatgctcgcaagacaaatttaattttcatttaattgttcttaattaatttaaaaaattgtcttatttttggtcgtttgtcatttaaatttcattgcaacactgaagctgaaaaattttttgtctgtattttcttaaaagttattgtttaaaaacattattaaaatttattgattttaactgcaggatgtgcgacctcacattccatgcaattgcctgccatatgtataattattccgcaataatgtttgatttagttcagagaatttactttcctgttgtttttattaattttaagctaagtttttttgattatttaaagcataaacatatatttttaatttgaatgggttttttcgattattttgtttaattcttttgaaaattttgtttgaaattatatataatttttaaaactgtttattgaaatttcagattataagatttcaatttttttatttatgagtaaaaaaaatgtttgcttatttatcttttatatatttatttacatattctttaatacttagtcccttatcactttaaatttttattatttttttgaacacatatgaatagggagttccggaccggcacaagtggcgaacttcatgtttttgttttgttttcattaaaattgtagaataaatttaaaaatgttattatactaattcagccagctgactgagcgtcatatttcccatgcacttttaattttatgattgagaaggcagaatttttttaattatttcttttttcaggacgtgaaccacaacacgatatattttccgaattgttcggcgcatcaggaggagtcatttcaaaaataagtttttaattaaaaattaaacacattttgcttaatcacaatttgtaaattagttttttatagagtttgaaatttaaaattgaagaagaattttattattttcgattaaatttttcttaataatcgaattttgacggtacttattttaatagtgcacagccgtttgtataagcattaatgtattgtagtttctatattatatttattctaattatcttagtttaattaaatttaaaaagtaatatttatttatattatttttacattactccttaatgctgcatcatttttttaattg

SEQ ID NO: 25378 - DNA, 620 bp, Heterodera glycines
tcatattcgtgatcagcgaccccgaaaaccccaggaaagatcttttgatgaatttcaaaaaaaaaaattattttttttgaaaatgggggggggggacaaaccctactattaccaaaattggtgcgttattttttcagggtgaaccgttgcctctttttgtgccgctcagagaacataaaatgcatttggtgaaccgtcagttcgtgctcagcggagcggagacgggtggacaacagcaaaacaagcaggaacggtggtctcaaacacagaagcgcaacgcgttcaggcacacttttggcgcggacattgcgaaggtggcgcaaaaaagaggggggggggggtaaaaaatttaaaattttttcttaggaatattacaagaaaaaattggcgctacttgcaaagagcactattttgaaaattttttcaacttttttttggtcaaaatttttttttgtttaaaaagtcctgaaaccaagtacccggtggttttaaaggtcgctgatcaacaatatgacaattatttgggcctattaagcaaatttggcgctagctataaagtgatagattttgaatttgtatcaaaaaccatatgtgggacccgtttgtcttgtaaatttttt

SEQ ID NO: 25379 - DNA, 1246 bp, Heterodera glycines
atcaatcaatcaatcaatcatttatacgcaaaagcgtgacgccgaaaaataaaagaaataatgaaacaatatcaaatataacaaacaattggtcacttttggagctggggtggcaaagaaatcaaaaaattcagatcagatctttcaagaatttagtaatctcgtctctttaggcaaaagtctatagagacgagaggttcgaataaagaacgaattgtatctagcattggttgagcaataagctgttcttatagtgaattcattttttagtgtttttggaaaaagaaaaggattcgttattttgtaaatttattttacctaaaattatttcatggaaaagttttaagtctatttttaacctacgactctcaagcgacttttaatcataaatgtttaacaattcagcataattaggtaaatcagcagcataattgttacgtctaaatattactctcaaaaaagttttttggacattctccagtttttctatatccttttttaaataaggattgaaaattggagatccaaattctaaaatttgtgtgcaataaatattaaacaaatttacaagtattttcgtatcaccagttttgattgactttaatatagcaaaagcagatcgtaatgcttttttcgagataatttcaatatgttgtgcccatttcaaatcattagtaaaatgaatgccaaggtctctgactggttcgtttccgggatttttaggaattggaaagtcatcaataaaataatttattttttggtttttgtgtcccaaatgtaaagttaaacatttatttgaagcgattttaaggccgtttaatttacagtattgattaaatttgttaataaaattttggagtggagaaaaggaaatatttgaaagaacatgataggccttaagatcatcggcaaatagtttaattttaacattttcagtttcgcagaattttggtaaatcgtaaaactgtcctggccacggatcccacggcacgtgtgttggcgctggccccgccgaatgtcgccgtcgtcaagctggtctgagagatcagacccgatttcgccgaaaaacattcggttttctaagtaattctgaatccattttaataaggaattatttataccaatgctttggagcttagatattagccggttatgtggaaccgtgtcgaatgctttagctaaatcaaaataaattacatcaattgattttctattttctaaagcaaaactgaaatcatccaccact

SEQ ID NO: 25380 - DNA, 1325 bp, Heterodera glycines
cagtcactttctgctcaactctttcaatccgaggggatcgtcgtccgtctcatatattttcctcgctttttttggctttttcaattttctcccctttttcctcagttttgcccctctttggtggtcacttttgtggccaaagtgtgcggcgcgccagcggaggacaccaaagttggcttagtgctcaacggggagcaatgctttgtgttggccctttacgttttggaggcacttaattaattaattatctaattggttgcctaatcattttgcatcgtttaatgaacgcgtttgttttaaggacattgaccaacaattcacgcctgacatggtcagttcggatggtgtcatttctacaaaaaaatgaataataatttgctacgatattttcattgcacttttcggttttatgaccactgaaatttttaaataaaaattcatttttggggtaatttgtgacgttgatcatatgacctttattttgcaaaatttctaacctgaattcgaacaaaaattcgaaagcacccaaaaattaccctaaaatgactttatttgaaaatttcagggggtcacaaaacagaaaaaagatgaaataactcaaaaactatggaaaagaaagtcagattttttgtagtttttaaattaaattttgccaaaatctttcttatgccctcctccgatcggcattgctgaatttagcccaaaaacctcaaattttgtcgttttggtctcaattttttaaataaatctgctacaataatgccaataatttcctctatgccccctcatttttgaactttacagaaggaaatggcgttcaatgcgttggactccgtccgactgttcggctccgtcttggccaattcgctcaactgccaaatgccatcggcaccgcggggtttgtgtttacaattaatgccaaatggtggtgccaataaaaaaagtgccaaaaatgaacacttttttccttttattggttctatgcgtcataatttaccccctccccccccccataaattaggtccctcctccgccgatctgttggagacgttcacgcgctgttaccgtgcccatatggacaaactcatgcacgccaaattgaccaagtcccttttctgtctgtccggcggtgaccgacgacggcacggactgaacatgctgtaccaaatggtgtgccgcaaattccccagtcagttaacaaatcatcgaccaatttttgggatttgttttttcttttaagaaaaagtacttgtgcccgtcctcctcggcttggaccatccccgtgtaggagttttagaaaaaaaactcaaaaaaataccaaaaat

SEQ ID NO: 25381 - DNA, 958 bp, Heterodera glycines
agttttgcaatttaatttttatttatattttattaacataataaaatgctatttatattttattaacataataaaatgctgttcatctgtctattattgtaataataagccttcagaaattggtaaaaatttagcaaaacgcaatacaataatattcaaaaggagaaaaaattaaattcctttcacaactcataaatcaaaaattgggtatcttttaaaaagaattttatttttcgatgacattttattaaatatgaaacatttttaaaaagtttaattttagtttgtttctaaaaccttttgacaagtgtaaacaaatttgtaaaattacgaaaaataattagacatctaaattactaattaacctttaataaccagtcggtcgaaataaagatatattttattttttcaacaattatgaaaaatccctaatacgattgtttggcgagaatgaaaaaattaaagcataagctcattacataaaattatttttatatattttaattttgtaacaaaccatttcttactcgtttttaaaatttttggctaattaattaaattcatacacccctttcatcaggatccaaaaatagaaaaatttgaaacctttacaaatattttgtgaagaaactaataaagtgttattataaattggcatctagggccgaatattcgatatttagttggtggtaattcctattaagaaaatcccttatcaaaaaaatccaggaattcagaaaactaaaatgtatcccttaataggtggaatcaaataaaatcattaacatcaatttttggccagattttgcgattttaaagcttttagggttttacttggataattaatagcgcaatgtcgtcccgatatttttctatgccttaaacattgagaattttaaaaggtctaggttatggggaagtgttttcaattgtctagacattttcaaaagctgcatac

SEQ ID NO: 25382 - DNA, 888 bp, Heterodera glycines
atgtattataaattttaatgagcggcattcaaagcagcgacaaatacttgggatttggtgtacaaagaattttgggtgaaattatttctagctgtcacacttgtggcaaaggaatgattgattacctttccgcggcgtggcgcggcgcggcgcggcaacttcgcagcgcaccgacggagagtgaaatgggtggcaaaaaaacacccgcacgattttgtcgagaaagaatatccatgaggcgacaccttcaaagggttgcttaagagttagggaaaaatctcgaggcggcaacttcaagagtgtttaatagatgcggataaatgcctcgagcggcaacttcaaagataaacaaacacccaagcattaggctcaggattttgaggtaaaaatcccaaggaaacttcaaggataacaaccctcctccaatacgtttgggcttttgtaggagcctatcccgggcggcaacttcaaaggaaaacaccccttcaataggctcgggattttgcgggaacatgtcccggggcggcagcatcaaaggaaaacatacctggagatttctgaatcatgccttatttcgaaagtcatcaattattttctgataatttcattcaaaaatgtgcaaaaatcgtctggatattccttatttagaaagccatcaatcatttttctgactagtgacctaaataatgcgcatattgtgaaatagttaaacaaaactaaaaaagtcacgtgcacatttcgagataatggggaaattgcgaaataaggaaccaatcaatcatttttattgacaggtgggcaaattttatctcatattgcgaaataattggaacaaaaagttgcgtattgcgaaatcaatgggaaataaataaaaacgaatcaatcaat

SEQ ID NO: 25383 - DNA, 907 bp, Heterodera glycines
cggtgtcatctatgttactagatcggggatcgatccccgggcggccgctcgagcgggacctgcagaagctagcttgatggggatcagattgtcgtttcccgccttcagtttaaactatcaagagagggaggagagggttggagaaggaaaggaaaaaaaaaaatgaaggaggagaaagggtgggggcaatgaaggaagggaaaaaagttgaaagaggggatgcatataattaaaaaaatatataattattattttaaaattattagactgtgagtttcttatgggacaaaaaatgatttaagatcttaaagtgaaatttatgtttgagtaaaaaatttataagatcttgagactcacaagaaggtgtttaagattttaatttgaaatctctccatgcttagttataagacattttttttaaaagttggttgtctctttttataagttgtttttttaatttttaaatacattaattatttttttcttatatatttttatttaattattttttcttcaaatattaatgaaaagtaattaaatggatataaagataagaaatggatttaaaataataatataagtaattaatatatttaatgtgattaattaaattaattatttttttaatatacatgaattaattgaaaaaatcttataattagagaccgagaaagacatacttgtctttcttttcttctcacctctctttatattgtaagaattgtgaaaaaaaaaatgaatctaaattatattactttaatgtaactctggtcccagacaaacaaaccggttcatcccgtaacttatcagcatgttagtgacaatggagttcaggatgtttatgactcatttcactacatccttaattttaactaaaactaaataacatttccttaagacagatctt

SEQ ID NO: 25384 - DNA, 2069 bp, Heterodera glycines
cccgctgtagaaagacagtcagacagtgcactatttcccccttttcccttcctctactttttttcaaattcatttttaacgcataactcaaacaaaacgccacacaaattcaaacactggacacacacatacagacactcaactttattatataagataggatgtttttatttttgaccctaaaatcttgttttttggccttgatgttcttattttaaaaataatctaataataataaaaaatatattttgttctattacagtttacacgattataaaaaaacagacacgagcatataataatttgacaaatttaatgcgtcataaatttttctagaagcatccaaaattaacattcttggtatcatttgaaagccctaagtgtcctctatttgcatgcaaaatttcaaaaaatttcgttgttcgctcttctccacgacacacttatttttcaaattgaataataacgagtcaaaaaattaaaatataatttttatttatttaaacattggaaattgtatggaaaaattggaattgaaattttgtgcttttctctcgcactctctttttcttgcatagtatttcgatctttgatcagtgatccgtctactgctatgtgccagctcagcaacacttgacaatttgaagccattcggctgccgtcccgggataactttggccacgacgtacagagaaaatgccattggctgagcttcgcggatgagctggactaatgtgtggcaaaaatgaaggatctgtcattaaaaacaaagataaatttaaaattatttaaatataataataaacaaacaaccagcaatttgttgccgatattccatgttgtgttggagaataccaagcaaactctgatcttgacgatggcatgttaaatttggagcagttggcgtgtaaatgcacgccttcgtctgtccaattggcaccatacagtcgggctcggcggcacaaagcaaagccatgcaaatttaaattattttattttaactttcatagggagaaaaattctatattttaaagggttaaaagggatcggactcgacctttattttttgaaaaaacttgacccaaacatgaaaatatccgaatatcgggcccagtcctatggaaaatacaaaccaaacttaatttcgacactctgtcaagtcgacactttataccgcctgtcgacaacagttggccgatcggttggaatgaaaccgcaaaatctactcaaagtatccattatcataataataccggatattagcccaaaattgatgtaaaatggacgattttttaatgaattacaaaaaagttcgaagttttaattctcaatttattatccttttaccatttcatcatttgccgcgtttgctcggatttgtgcataatcacaaagtttgtttcgaactgtggcgggtcaatttttgtgctttgttcatatattccagtcaatgtgtatgttctgttaggctcaaaattggtgtacattggcaaaaattcgtacattcctggaaaaatgcgaattaaagtgccggggaatttttatgtgtcttgcagatatttttttgagttttttgtaattctgtaatatattcgctttcagaattttctaagattaatgaagaatttttttttttcaaaaccaaatgtcgtatcaattaaaaattttaaaaaaagttaatttttttttgcttcatttgaattataaaatgtttttacccgggtgagtcgaaacgttcatcccatgcaatgcaactaaagaaataaaataataaaattttgattaaatttgctttttattttcacaattaaacgtttattgggtaatcaacatttgcgaaccgaatttacaggatgaattattaaataaaaaaatgaaaaagatagatacagttaaataaaaattttgaagataattaaaatgaaaaaagattatggaagtaattttggtgtaaaatgtgataattttcttgacccaaccccataatatagctattagaaaaaattaattaggtgtgttaatagggtaaaaatttggcgttaaattttcactatatctttacccggtac

SEQ ID NO: 25385 - DNA, 1740 bp, Heterodera glycines
actggaaatgttgctataaaagaaacaaatgtgaattaccggataattattctgacggcgaacaccgaatgatttcacggctttgggtcgacctattaatcgcgtgcaaattcgctttttccctcaatgttttttacccctcatcattgactgtctaccgaaactacggacaccatttccgcgtccatttgttttgtttttgctgtagggacgctccataagcggttcatcgcctttactgtgtgacattgaagcgaagtcttggtacggattgacaaaggcgtgctgcccaagtctttcccatgccgctgctcctcttattgccacgcctttgtattcagcaaaattttgatagttcatctcagtggggcggtggtcaaaaatgagtggggctgttaaataaaacggttaggtagaataacactgcgtttcaatgtaaatttgaattagcgaaatgattaattttatccagagttcccaagtgtccttatttctaagatttgtccttatttggagatgccagatcttagaaattaaaaatgtccttatttctaagattttccttattttggtacgacctccttgttttgtgcttattcttggatttgaaaataaaaatgcaaaaattgaataatttttgaattacatatcattttttttgaagcgaaattttccaaaaagctggtttttgatcccaaaagatgtttttttgttcggcctatgctgattttgaaaattctcagttggcagctctggtttttactagagaccggacaagagggtcggtcggtcggtttcggtataaaacccgaaaaaaaccgaaacccaaaaaaaccgaagaaaaattttcggtataccgtttcggtttttttgaattttttaaatcttttcccaaaaaaaacaataaaccatttttatcaatagaaaaagcgaaagatcacctctgaggtgggggaggggggtgtccggcgctgccgataggcgccgccgggaaattttttgaaaatgagtataatttgttaagagaatttgtccaaaaattgtcaaattttgtgattttcaagccaattattggtaaaaaaaattttggagttttgggaggccggcggttccgataggcgccgccgaaagtttttcggattttaggaatttttaacaaatttaaaaattttcaagagtcctcaattccccgagttagtgtcgtggggtcgggggataaaaagtcggatgtagggggctcggggtcggggagcaaccctattataaacccccaaaataggtgctaaaaatggaaatgagataaatattttaaaaatcaaaaatgtagtcaagtaaataaataaataaattttgaatatgaatttttgataaaattttccatttctcaggggtgtatttttcgtttttattgcatttttgttaataatttttttcaaaatagcagaaaatattttacaaaaaattcttcaaaatgaaaaagagcacaaaaaagcaataaatttattattattaacaggttatatcgctccaatttgattcggtttttttcggtttttcataaaagtcggtcggttgtttcggttttttgattatttcggtcggtcggtttcggtataaaaaccgaaaaaaaccgaaccgaaaaaaaaccgaaaaagtcaaaaatttctcggtcggtttttttcggtcaaaaaccgaaaccgaaaaccgaaaaataccgaaaaaaacccgaaaaaaacccga

SEQ ID NO: 25386 - DNA, 2210 bp, Heterodera glycines
ttatattaattttttcatcagaaaaaattaaaaaaatagttattaattttagtatgtatatttaattcatgtattttttaatataatataaaaagaactttactttatcggaacaaaacaaaaaattcgaataaaaaattttaaatattaagaatttataaaaatggttttatttaaatttttattctttaatgtgtgaaaatgatgttgtaagtcataaaaatatggtatttaaaatgcatgtgttaaagttgcgagtaaccatgatttttgtcgaccaagaattggaaacttcctccggcgggcggttttcggaagaggcgcttaagttttcggtcgactgattttttattgtggtattttaataaatttcctttaatcttttttgtcaacatttttggcctccccacattaagttgagcaaggtataagtagtgacccctgtacttttgtcgccccttttggcgctaaattcaaatttgaattttcgcgtcgatactctgtgggtggagggacgcttgctgggggttgggccatagggtgtaagactttttattattatttaaatattgttatttaaatatatatttttaaatttaaatgttattatttaataaataaatataaatgtgaattttcacaccgatgctctgtggggagctggggagggacgcttgctggggttgtgctgtagagtgtaaggcgtatttaaatgttattttaaatgtaaatagatattttgttttctaaaatttaaataaataaaataaatgcaaatgtgaattttcgcgtggatgtctgcggggagggacgcgagctgggaggagagggctgtaaaatcaattaacgtgtgcgaattgtttatcggtggaaaagtaaaggataagcggaaatggtataatttaggaggtaattaagagcacattggttggtgtttgatcggatagaaagacataggaatggtgtgatgagtgggagtattggaattgattgtggggagggaggtcatttcaaaaattgctcgcacgcctgacagctcgggtcgcatttttgtccaacgtgacggattatttctatcattttttttttctctgtctgatcgcttcccggacgtggacgatgtcctggaaaaggaagacgacgacgacgacgacgaggaacacgaactggcggttccaggccgcgacaactcacaacgcgcttgcacctttcgttcggtgctgatcagtttgtatgctcggcggacgcaatcgcggggcacacgcaacgaggtggaggaggagcacggttggtccgcggccgtcttattagggaaagttttttacatttctagttaaaaaaggggggaggggcaaccgtaagcacaacatcgcacaacggctgaggtgccggggcatcgtcaatcgggacaggcccaatttggagtgccggaggcgcaaattgctgctgctgctgctggtgttgcagatacggttgaaaagcgaactgtagcggaggaagtaccaaaggcattgcgaatggtgggaagacgggcagtggtggcatgcgcatttgcaaagtgctgatcgcctgttggacggcagctgaaagcatcggcggcggttgttggtgctgtgttgccggtacgcaatgtgtcaattgttggtgttgctggtgctgctcctcctcgacatgttgctgctgctcctcctcctcctcgacatgttgctgctcctcctcatcaacaggctgcgccgtcgacgacaacctccacgtccggtgatgggacccgggcgaaaacctggtcctaaatcatattatttttttaaatttttttttttctaattttttttattaatttttttttcttaaagtttttttttagaataattggtaattttttttttttaatttttttaaactgcctcttgattattaattttaaaggcacctttagcgtgattggtctaaggtagcaaattaattagttttttaatggattcgagaatgaatgttttttattttatttttttaatttttttaataatttattaaaaaattaaaaattattttttggctgttgacatgtcatgactcatcattaccaagggcaacctttcttccctcaatcaacccaaacaaagcaaaatcctctgcgtgcacgtccacagaggcgatgacgctaaaatgaattgtctattacttgttcatttatcgccaatttccccaca

SEQ ID NO: 25387 - DNA, 1391 bp, Heterodera glycines
agtaccagtttctttttcttctttatcagttaattcttcttttctgttttgttcatcatttggttcgtcttcatcatcatcattctcatcatcattttcatgttgatcccctgaattatttttcttatttctttttaaattttgaatagctttctttacctctaagttaagcgattttaattcatcgataacactatccgcttcttctaaaatttttaaatagtcatgtttttctgtgtaaattttatatatttttatctcagcatttttatcttcagtatttaatttgtttcgtatctttttccattttttatccaattctgttaaactatcaaacgttttttcaaaattaaatatttcttttttaataaattcatataattttaaacaaccaggtaaatcattggaatcaaattcatatttcccttgttctatttgttcataatatttttcaattttatttttcaaacttttaaccaaaataggaattcgggttctaatagttccggacattttcgtaagtttttaaattatatactctttgtggactaatgaattaatagggtgtaatactatacttctttcagatcttctccacttttttaataaactttttctttctcttgataaaacttttagaatgaatttgacaaattttagtcgtttttcagggttagagttgagtgtttctcttacttttaagtaagcttctaaaattacttcctgtgatattctttccaaagaatcggctttatctaggttatttaaaatgcagtatggaaaaatagttattgtcaaagtgaatttatatacggttttgttttggtatgggaagggttcagtttttaaaatttggttcgttactttggaaattcctgggtaaatatgcactattggaaagggaaagtttgcccttctttcaagctcggtaacaatttcttcgggtgttaaaaccggaatttctacaataggtacaaattcttcaacttcttcaataatttcttccaattgatcaaaattttcaaaattttcttcttccttttccagttcagaaattagtttctttggccgacacagtttgacgtttatttggaatttttttttttttattaacaatacgatcacagtatcaacaatagtgatcaaaaatcttggtatctgatcgccttcaaataatgtcaaaaaaaatcaatcttttttctccaaattgttcgcactagtggacggttcgtcttctagcgggattttaaatgtctttcggaggaattcagctgttttttgttgtccaatcaaaaaacggtggtgatgtgtaaggttgtcctgcagtttattcacaatgattaatgctttgtcctttccagcgcgactgttgtatgaaggactgttgatgg

SEQ ID NO: 25388 - DNA, 1268 bp, Heterodera glycines
aaggaatttatcattaaaattatatatttggtcgaaacggatccatcgggggcaaaaagggaatgagtgaaataagcgggggggggggggaaggcacgaaaggagcatttctttctcctcaaatttcattcctccgctgaaatttatgaggaaattaatgcttaagcttgcgaagacgggcttttatttattactcagcaaaaaacgaatagaaaataatgcggaaaagccaatttaatttaaaataggtaatgtttaaaatggaaaataatgagttttacacaatattagtctaatcattagtcaattccaaaatgcaacactttcctttcgcaaatgccttcttcttttcctccctctgatcacttcactctcactgatcatcgccgccgtcgaattttgacaattggacgcgcaactttttcgtttggaacactctaaacattaaatatttcagatggaaatcccggctctattgcactttaggcgtccaatcagtgactgaccattttcagtttttacattcaataatcaagattccttttcataacgaccaatttgccttgttgctcaatccctaccccaaacggactgatcactcactgtttgtcccaaactctgatcagttcccagagatgttcgcgttctctcacagcgatcagaatgtacgagcatagcagcacgttcggattcccactcgggtcattgtaattcgtccatttttctttctgatcagtgcgatgttcgatctttgaggacataatcgacaggccgggcacctaaaggaaacaaataaatttttaatttaaaacgttaaaaaaattgagaatgaaaatgtgtaaatttggcttttgggtcccgcgagaaaaaaaagtaccaaaaattgtttactttctgaatgcattccgccaaaaactccacgcgcagcaaatccaaattcaaaacgggcggcagattccaaacgagcacaatgtttttgggatttatttggtggaagtctaattcttggcttaattcttcaaacgataggctcagtgccgaatcgtcaaaagtgccatcttcaggaaaaatggccgacaaattgtttcgttcgaaattcattgatggatttgcaattacttttgctaaattgctaatttcaatcattaaaaaagacacttttgatctttgtgttcgttgaggtggaaagagagaacaaatgcggcaaaagataaaaaaggcacttaataatcccccgggggaacgaaagagggcgatgaattcccagc

SEQ ID NO: 25389 - DNA, 1146 bp, Heterodera glycines
aaaagcttctcacccaattttagcgcatcccaacccttctacaatcgcctttatacatcccattatgaacgctaaaattatcagagtgccgaaaatcgcatttgatctaagcctagaaaaaatggtctaagtaaaaatcgtattacgctcaaaaagcttctcaaacaatttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacaatcgcctttatacagcccattatgagcgctaaaattatcagagtgccgaaaatcgcatgtgatctaagcctagcaaaaaatggtgtaagtaaaaatcgtaattacgctcaaaaagcttctcaaacaattttaacgcttccaattccttctacaatcgcctttatacatcccattatgagcgctaaaattat

SEQ ID NO: 25390 - DNA, 1824 bp, Heterodera glycines
ttaagcctccccctgtcatttccaatgtttatcgtcagactaaaaagtcttctttgctctcatgccctcccccttttcctttcattttcaccgcaaaaggaaatcccttcaaaattagaaatatttaactgacaattgagaatgtttgtactctacgctgaattaatcactttctgatgaggaccagtgatgtgttgggcacttttatgcaaaaaaaaaaatttgtgagggaaataaggcaaatgatgagagcgggaggagagagggcggagaaagagagagacggaaaggagggagagagagagacggaaaggagggagagagagaaagagagaaagacggaaaaaggagggataaagagaaagagagagagacggaaaggagggagagagagatggaaaggagggagggcggagaaagagagagacggaaaggagggagagagagagacggaaaggagggagagagagagagagagacggaaaggagggagagagagaaagagagagagacggaaaaacgagggataaagagagagagacggaaaggagggagagagaaagagagactgtggtgatgcgatggatgggcggggatgtccatcctttgccttccctttcatccaccgtccgtcctcttcgttatcctcctcttttcatcactgctggcctatttacccacgcctcatgcatccatcccatcttccccatccagcaaatagtacgactgaattgctaggcaaacaatggaagtgaggaaggaatttgaggaggaattgaggggaagacgaaggcgggggggggggggaagggacggccgattaagaagaaggcattggatttttatttccccatcgcctgcaacacatcaaaacaacaaacatcgccaaaaaataaaaaggaaaaaaggagggctcggaaagtgggaaaaagacggatgaactggcggatgagaagggatggcataattggggggggggaggaaaaacaaacggacggaaatagaaaatgaagaaaattgggaagaaaaaaagggatgaagaaccaattcaaaaagaaaagtgacaaaaaggcctagattaagacataatgccaaaagcaaagaaaagtgagcactatgggtcaactccactgtgcagagaaaagcctagtactatctcgtcgtttctctttttctttgtaatttctctcgctttggcgtactgtctctttattttaatggtgtaaaaaacaacactcacttcatcctgtttaactttttttctgtttgttaaatccacaccaaattttgcatatcgattgagaaaaaaaattctgcatcgaatgttctataaagttttaatgaatttctatcctattttaaagttaagggatgatgaaaattttgcatttcttttcctctaattttggcgtactattttcatgtctctaacacatgaaaaaacatcaaattcgaaaattctaataattttggtttataggctacaaaatcactttgaacatttagaatcaatagaaaaaagaataaatttagcattttggttaaaatcagcagtcaatgagctgagttttaacgtgataaaaatttgaaactctcgtaacttttttatgagatgtcaaattacttaacattcgtttagaaaaagtttctccttttcaaaatctttttttagataccaaatttgttcggtttcgttaggaatgaagcgagttatggctgatcaaaataaaaaatacaaaaaaggcatttaccagtgtaaattttgaaataacgcgcaaaaatttacgccaaatgcgctatttggcgttatgagcaattttgtct

SEQ ID NO: 25391 - DNA, 1114 bp, Heterodera glycines
  misc_feature (1055)..(1055): n is a, c, g, or t
  misc_feature (1064)..(1064): n is a, c, g, or t
tgcccattttcctttgatctttttatagtgagggaattacctgttcgaatttccatccgtcggacattgccgaaataacattggtcagttcgtcttcgtggcattggagcacgcggtagacatgctttgtctgcaattcgattttcagtttttcgtttgtgccaaaaaacgaacccccatctttttttgtttttctctttccgaaattcgctcgttgcataaacttatcagcttcggaagattgtaaaattcggcttcctcgcgaagtcctaaatgcattaataagacaattgatcctattcaaataattttcgaacgcacaaagcaattctaagccgtaaataaaaaacatttctggtccaattcaggcaagggattcaaagaggccaaaaattgtaaattgtatgaatgtatgccacattttaatcagcgacccgaaaacacccggaagaatgtcccaggaaatgccaaaaacaaaaccttcttcagagagtccatgatcaaggattaatttgccatggcgcatgtaattgagaactgcggaaaaataatcggagtcgcggtcgatcaaataggaactggactcatcctggagaagaaaaggcattaaaacgaagtgaagaccccgtttttgtacaatattctgctgatattcaaatgacacatttcgaaaaattcaaaatttgggttttccaattatacaataagcagtttgtttggaccaacaaaaaagctaacccacagaaatacgctaatttgaaaataggtatctaaaaatcataggtaaaagaggaccctaaccggagaaagtgggagaaactccctgccttttgtgactacgaccttttcgctgggcaacgaatggtcctcctgggaaagtcgggcgaggaaagagccactttcacgacacaaagtctgtctggtggtcagaaacacctgaagccggccaacagaatgggcattaaatgaattgcagtttggccggtggatgaacctttccccccacgttcagtttgatccacgcgttcgttccctcgcccaatgggcttcctccncttcgttcntgaactctagcctggaggtgtgagttccgctcggtgtcctattcctgtcg

SEQ ID NO: 25392 - DNA, 1009 bp, Heterodera glycines
aaaattaaatttttaaataaagatttttttagtttaaattttttaataaatttttaattaaattaaatattatttttaaatttattaacaaattttatttaaattgaattgaaaaattataattttataaaatttatataattaaatattagtagctctaatttattataaattatttttaaatttaattaataaaatttttaattatttgaaagacaatttcaaatcataatcataatttccattaaattttaaaaatatttattttaaatttattctgaaataattttaggtatattaaaaatctttaggaaaaactgaagaaaagtgtttcagtagaccgtaaaatggaccaattcgcatttttatgttggcacatgtcaaaaaaattggattattcggaaacggaaaaattctttggccctattaacgcaccaatgactaaacacataaataggaaaactaaaaaataatgttaatatttaaattaataattattctataataattggatttttttcaatgatttaaattcattcaaatattattaattaataaatgattaaaattaatattaaaaaagaaataaaaaatattgcaatttattagtgggatgaggattttataaagatgggatgattcaaaaacagctgaaaattagtaaaataaataataaaaccatttaaaaatgtaaaacatgggtaaaagaggtatttttaaaattgttttttttcgagaaaatttttaatctttgaattctgaaaattggaaatatattttttcatctatggatataaatggaaattttagtggtaacaaaatttaattgctattttaggaaaaaaaactttatatgaaagctctcatcctgaactttggcattggcgttatgccccccgatggcacatgtgctgcggcttcaaaacaatggcacatttttatgcccacggcagttttctcggaatggcattggcacgccattgaaaagccttctaagggtggcacgcaa

SEQ ID NO: 25393 - DNA, 911 bp, Heterodera glycines
ttgtgcgcaagacgggaatcatttgcacgataggtaaccccttaaaatggattaatcgcttcgctaaggctttctctttaattgtttccctgttcagggcccgtttgtcgttctgtggaaatgcttgtccaaatgatcgaaaatgggatggacgtcgcccggatgaacttcagtcacggggaccacgaagtgagttttatcactaaattttgagaatttgaactttttattttaaagagtcgtgaaaatagttttcctggagtctttagcgtcgctgaacataaatatggcatttatttttgcccatttcgaatcccaaattcgagcaaaaagtcgaaaattattatttttttttaaatttcgacttcttgttcgagtccgggattcagaataggccaaaaattaatttctatgaaattgcagtatcacggcggtacaatcaaaaatgtgcgtgaagcagctgccaaatgcaccaagaaacgcaacgtggcgattgcactggacacaaaagggcccgagattaggacgggacttttggcaggggtaataatttttgtttgtatttccgcaaaaatgtcatacattttaaaatgttcgctatttttcttggcgtattacctttctttcaatcgctttatcaatccgatgtgccaaattccagggcggttcggctgaaattctgctggagaaggacgcgtccattcgcctgaccaccgactcggcatttgagaagtcgggcaccgccatcaacctctacgtcgactacaagaacataacgaaggttgtgaccaaaggatcgcgtgtgtacatcgatgacggattgctgtcgcttattgtggaagaattttgtgggtttatttttaagtccctacggcgacgtttttaggggcacccaatggggggggaggggg

SEQ ID NO: 25394 - DNA, 2160 bp, Heterodera glycines
tgtcatcattagaaattggcattttcctttggcgttccgttggtccctccaacttttttagttcccccaaaatttgtttcaatccgttggcaatgtctctttcggtgtccaacaacaaattggccaacatttcttccattgtcccattgccaaacccatagcgaagacgaacgcgctccagggcaccactaatgccacctgaaattggccaaatttgtttaaaatatgcattttaacattaatttaaattttgtttaaaaccgaattacccggcaaatcttcgactcgaaccgcgcgtccgccccggtcgcgcagcactccatcaaacatcttcctgctgctcccctgctgctgatcgtctgcttgtctcgtcccgaattcgtccgaattgccccgagggcgatcattgatccgctggctttgatcactccatcttctcccataacttcccgcattctcttcttcattttgctgatcaaactcagataattttggtgccttcgctgattcctggaattgatgcccgtcattttgtgcgtctgctgctggcagtgatttgtccagctgatccggaatggcaccactgttaattgtttgctgatcagataaaggctggtcaatgccgtcgttgtcatcttcccttatgctcggccttcgttgatcaccaaacactggttgatcactgccgatcacttccggcatttgttgttgataggtatcctcttttccctgatcaccagcttcttctcccgcttccttcatttttggcagtttttgagtcccctgctgtgcttcttcgatttgattctgttcctcttcgccatcaaataacacatctccaatttctttcaaaactgctctgatcacttccgcaaatgcctttgttccgtccttctctccttttaacagttgtttctcaaccagttcatctaccatcccttctggtacgtctccaaatggttcttccctttctttctgttcttcttccaccaatattccgtccaaaatttcttcttcccctcttaattttacttcttcctcttcaacttggtcggctttctctccgatttgtccagtaaataattcttcaaccacgaattttgcttcctcttctatccctttttcttccgctttcttctcatccggtggcttctcttccccagggcgctcccgaaaatcctgtcccgtaattgccgctttctgctgacccggcaacggtgcctggccctgatcagccaatgactgatcacttttctgatcactgatcatttcttggccgttttccgttattctccggccctgtttctgatcagcaatcttttcggctgatcgctttcttctccgtcttcgtcccgtcccataatttgccaccgcctctttggcaattcgcaaatttttcagcaattggagaatccgttgcgaaagttcgctgtttcccgcttttgtcctcatgtcagatgtccgctgttgtccccccgggccgtctttcttctgtccgtccgatttcttttgctcatccgtcggcaattgtttggatgaaaatggccgatcacccgacaaatttctgagtgatcgcccatccgttgtcggcagaatgttttccttatcagcagaatttgggagagatttgttgcttgcggaagtctgaactggtagaattttggtccaaaggattcgtccgttcggcatttttttgccgcttgatgcttcttcgttccgattgcttctcgtccaatcgcttatccgatcgctcggctgctttatcgcccccattttcttatcagcgatcacttccctttcattattttgatcattcgattgctttttctccccttttgctttttctttcagtgtgcttttcctcaataatgaagtatcaccttcaattctgttgttagtctgtccttttgcagcggtgaattgtccgacatgaagctgttcactgttgatcctttggtccgttgttttgttgctaacttcgaccatcatgctgtcgatctgtctctcattttctcgtattctttggttgtctatctgtctctcattctctcgtgttctttcgttgtctctctgtctcccattttctctgattctttcgctgtctgtctgtctctcattttctggtaatctctcgttgtttttcagtcttgctcccattct

SEQ ID NO: 25395 - DNA, 1102 bp, Heterodera glycines
  misc_feature (1023)..(1023): n is a, c, g, or t
gctcttaaatttttttgttcactcatttaataacaaatcataatattttttcttatgcagtataatcaaatattcttaattgccttcttttattttttcaaattgttttttatttagtagttgactttaattatttaaaattccttttttataattttttcattaaatggtttttaatgatttatctcactaaaaaaatttgtttaatcaaatcaattttcatgtatgatttataacatattcttatagccgctattttaaaataatgatttttttaaattttcataatgattttttaacatatgtaaatttaaaaattaaattattattaacaatttctaattatataaaaaacacatataaatttatttttctaaattccttttaaacaaatttatttattattcctaattaataaatattaatcaaattgttttaaagtaaaacttctcttatagttcatgaatttaattttcgggtttaaataaaatcaattttatttcttttgatatgaccagaacgctaattttttggtaattactagagcacggacgggaccgggatcctgccgggactctcggtcccggtcccgttttcttaacaaaccaacgggaccgggagtaccgttaaaaacgtgagtcccggtctcgggatcccgtcccggtcaattttccaagccctggtcccggtaatttcaaaattccgtgctcttttatttttaaaatatttaatagttatatttatcattaatttccattattttcttgtttaaaatatgtaaataaaagtttttcaatatttaaaagaattaaaatttaatttagttgtaaataatcaaattttatctatgtaaaattattcgctataatccaatattaaatatttttatttgttaaacctttgagagttttattgtattaatatttttaataaaagttttgcttatttgaaaattttttattcgtaattgttttatgcaaaaaataaatgaatgactttttggccaaattttactaattttanagaattttccctacatagcgatgcgcgaaaaatattttgcagattatttttctcagaaaggatagaattttaaaatctg

SEQ ID NO: 25396 - DNA, 1643 bp, Heterodera glycines
gatcatgctcaaaagccattaaggggagaagtgatcggggaatacgctaaattggacggagggtaattaatgggggggggggggatgagcgatcgaacaataaaaataaatggatttgggacagataaacgaagggaaccatggcacagagacggatggattccggagggaggggggaagggcagcccttgccaaaaaatgccgaaaatattaggcccctctatgccagagggttcttcccgttttgacaattcccatttttgatggggagggaggcagctaaatgatcattttaatggccaatgccagtttaataatttttggccaataaaatcaaactgagatgccctcccacttttgcgctgcttttattttgccatgccaatggaatttccgtctccgtccgttcgccgcttctcattcctaccaattaacaacatttaatctccactcatatgcgcatatgtgtccttttatgacttgtttttccatttaaaatgtgccaaataaaattaagaaaaagtgccgtgtcacgcgacacacaaaaataatgcgatttgaaagagccttttaaggaaactcagtttcgtttccgatttttggtgtgccttttctcaaatggattaaaaaacacgtaaattcgttcttttgataaatgccacagaaataaaagtgccaagatccttaatgaacaaacatcgtcaaaataatccgaccgaatttaaccgaaaaatggcataaattggccgacttattaggcacaatttccagacagttgttattttgccgagaaattttgtcataaaggcgaagaatttgctctgttgtgtttgttggcccgaaaatttcttgccctcccccaaaaagtcgtcggggaaaggaaaggtgttttaatggggggaaggaaatgcccgcgggggcggcgacaattattttctgctccgttgactttggcacattttttggccacatccaagcaataaatgctttttttgaagaaaatcggtcatggatttgcatttgcctttgcgagaataaccaaggatttcgaagaatgtttgggacggcggaaaaattaagaattaattaattagtctttaattaggccatcctttgttcccccccccccctctcttttggcccatttaatccgtcggccttttgtccgtcggataaaaaggcacaaaaacggcttcttccttcagaccaatcttctaaatgattatgcaatgtgtgcattaattgtattccaaatccccggtttgtatgtgtgtgggtggtgggaggaaatcccgcgtctttcctttccttttcctttccgtttgtttccctcggcgcaattcgtccggcaaataatcgttttgttttctccccgcccccgggggatgtaaattacaaaaaaaataaataataattgtgttttccgtgccattgccttcccggcgaagacagaaaattgtgaagtgattttgcaaaaaatgcacaaaattgggggggggggggaagaaagagtttggaagtgccatttctgctgatcaaatcggtggagaaagttcaaaaagaaaacaaaaattaaattaattcaactaaatttcacgagattcgaatagagttgagcgggaccgggacctgaacacggacaa

SEQ ID NO: 25397 - DNA, 940 bp, Heterodera glycines
tggcacttctttcattgcttactttttcaaaattaccaataacataaacatatttgcaaatttcaattgcttaattttgtacaacatttttttgatcacttcacaatctttcccttgtgtaaagagaaatttgagttttaaaaaaatatatttaatttaaaaaaaaaatagataaaaactacaggggaagacacaccgaagagaaggtttcggtcaaaagccaaaaataagagaatttgaaaattttcaagtaaatttaaaaaaaaacgtcaataacgcggatttcagatggcttttcaaaaaatttcggatcgaaaaaaattgtttcggataacccggaataaattctgacggcacaccctctgcggcactcactcaatatgttcgtctgatggatagggaagcatcgaaaatatggattttccatgacaaatcttttcagataaagaagctactgcctaattatgccgaaaattaacgcctgtcatattttattataaaaaaaaagtttggcatttattttttaaaggtaactgcaaatattattgagaaaattggtgttgtgcatttgtgcgcacgtgaaatgcttgtaaaatgttggcaattttattcttattgatccattaataataaataaattggcatttaaacaaaaaattatatattaaaatttaaaagcataactatttttatttcttattttataaaatgtgccaaatcactttcatccaactgtcccttcttctagtcgttatggtcgaaattgttaatgttgcgaatggaatgtacaagcaagatgaaaagttgaaagaaccgttacctccaaatgagcacaatgatcagctgtgccaatttgaagtgatcgaagatggcacaacggaagaaaaagacatggaaaaagcaataaaaattagcaaaagaatctattggcatcttatga

SEQ ID NO: 25398 - DNA, 1597 bp, Heterodera glycines
gcggcgacgtttcggggtgtacccggggaattctcccccccccccctatatacgccctcggaaaaacccattccaacaaacacagacaataagcagcacttaaaaactgttcaaattaccatcaaaaatatagtagcacttctcgttgaatgcactgacattgaccactgaaatatattatttttaggatatgaaaattaaaaaaaaaagaaattccggcaaaacactttattaccatgcttaatgaaccccttgagaaggacggcggaggcgaatgcccttgcgcactttctgtccttgaagccctgcacattggacatcagccagtccaacatgtcatcgcctgaaccaatttaaaaaattggaacccacataaatgatggggacagctcgttccgcacctctccgtatcggtgactttcattttcccccccccccccccgcatcgtatcccccttagaaatttttttcataggaaaattctaagaaaaaaaaaattttcgagaaattttcagcgattttttggaaatttttttgaaaaatcttagtaattcaccataaaaatttctcgaaaaattttttttcttagaattttcttatgaaaaaactttctaagatttttttcttgaaaaatttctaagttagcaatttttaaaaaaaaaattttctcggggggaaacgattcgggggggaaacggcgggggggaaacgatgcggggggggaatcggcgggggggaaacgaggtgccctcggaattggcggtagggaattgaccccaacccctaataaaacctcaatttaggggtgtaaaatacaaaacgtattcaaaaaagtaaaaattaagccaattcagtattgagcatgtttttcgtccgtttcagaccatatagaggtcaggaaaacaaatagaacgtatatcccttctcttattcttacttttctgcaagaaaattcaaaatctggcgaaaagttattaaaaaaggcagaatttcgaaatattctcattagtgcaccacagaaagaaaaaagaaatagtttgaagtgaatgaaagggacaaagaagaaagtgatgtgccgcggagatttacttcgctgcattttttttctctgtctgctgaaggcgacacgccattttgcgatgactcatcctttcctttttccctgccgccgctccatgcgaccctcgcatttcctcccctccccctcgcccatctgctgactctgactgatcgacggtttctcttatgttctctctgctattagtcacttttccatgtcttccttccgatttcgaaattacttttgagtaaactattttccctcattaagatttagtatgtttttttattatgcccataataatagttttttcgtgtttttttggcagtttcttaagttgttaaaattaaaaacataaaataattattttttatttttaccacaggaaaggaaagttgtcagatgaccatgtcaaatcacaacagaatgatgaattttaacaacgtaaatattagaaaatacgacaataaaaatgagagaaatggtgctgggtttggagcaaattctgacactgcggcgtttgaggtttaatctctt

SEQ ID NO: 25399 - DNA, 1775 bp, Heterodera glycines
tctgtaaatatattaggctaaaatcacaaaatgtagtcattttcttaataaaatctgttaacaaatcagaagtaattttcaaaaatttttcccggcggcgcctatcggcaccgccggaccctcctctatgtttcaaaaagtttttgaaaaaagcgcgccgtaaaaaacgtgtaaatagtcactccttttcccaaaaatgttcgaaaataatgccaaaatggcataaaagattttgataaaatcattgaataatttttcaagcaaaatattcaaataaccgaaaacattttttaaatcaccttttaatggtaagaattaaagaatttacctattaaaatatttgaaaattttttttattatattttatattttttgaaaaatttccgatttccgaaaattttttgacccccggaattccgatttccgaaaattttggggcctcggaatgccatccctgttccacaccattgccggtaatactaccgatggaccggttgtggatttcggaatgactctgaccatccaaggataatatttggaaattcggattggaccatgggtgggaagtgtgagaagactttgtttatcatattacaataataagccagaaacactcagaaagatggcaagactaagtatttcatggatttgttgcataattaaatttgtaaaaattgaagtttcgaacttccgagtccgggtccagggttcgaaatgggtgaactggatttcagagtcgggttctccgaccctgcaaacccataaaccactatttctaaaactgccatttgttagttttattctttcttgtcattttcctatgaatcattgtttgtttctttgactcccgttcgaatcttcattatataatgcaattcattttttagcttcacacactgaatttatttttccatataaaaatacaatgactggtgagcaggaggaaacccagcaggtcactttatttatcattttatcaatttaagggctaatgggcaaattttgccgattataatagctgtttaatgggttttcttggtgtcgtctttttgggcatggtctctatatagaaagggtgtgtaagacgtggtgattggttttttttcgaaatttttagtttttcaaacattcaaatccgctcatccaatttacaatttgtggagattgtcactgtcatcacattgccccggcgtttgagtggggtgggaaggttaacgtgggcaaaacatacaccgtaaaagctccgtgggaaggcgcgtccctacatttgccgtataaaacagcggcattcacatctctgactcactctaacccaaaccaaagtccatcccacccctgattttgctctaatggcccataaattgctccccactgaacttctttttgaaatggtactttttacaaacccaaataatgattttacgaatatttgtacctcctcttgggttgtccgtttctttatgcttccccgcgtcgtcaaatggagaaaagcttattttgtggtgggaaataaagaactaactgattttactccttttaaggcgttcgataaactgagccgctgcaccgaagcgttcgaaaagtcaagggtaataaaaatgtgtagttcgattcgaggttgattaagaatgcataaaattcaaaacatacacaattttcgaaattttggcactttttgcatttgagaaggggacctttaattaatatttctttattagcctatggttcaggtggttgcgtttgatcaatggcacagcggcaacgaattggtcgaa

SEQ ID NO: 25400 - DNA, 1848 bp, Heterodera glycines
  misc_feature (1817)..(1817): n is a, c, g, or t
agttatgaattttccatattagcccaaatttccaagggccaaaaaattgccaaaaaataaagaatttttaaaaaattccaaaaattttgaaacgaaaaataaacatcatattcgtgctcagcacctcaaaatagcccagaaaaatatttttcacaccctttttcgatcccaaaaaaatttttgaaaatttctagggggcctagctcgaaaatttttgaaaattttacatcatgtagtacaccattcgatagcatttaaaatgctctacaaaaatgttctaagacaatatttcgctaaaatcaacccctgacgagttatgggcccaggactcaaatgtcccgctgaggccaaaaattttttctatttccgggaaaaaatcgaaatttttccaaaaaaattaccaatcgatagagctcgaaaaactatgttttggaagtggtcttggtttttctgggaaaattcgttaaaaaatcctaaaattcaaaaacccgaaaaccgttttttaggcctagctcgaaaaattttgaaaattttcgaaattttaaactttggaaaaatcgggcttttaaagctctacaataagtctgctggccaccctgcgctcaggtcaaagcctaatgagttattcaacggggactgaactggacaaagttggtactgaaaagttctagaagcacccagcccagggggttagagatagcggcctggaattttttttaacttttagccaacacttcaacttaaaatcctaccagcggaaactttttggtcagggttttagaaaaaaagttaggggccctcaaatgcacgaaaaaatgataaatcagccgctgggactcagttggccgcgctgaatttttctctatagttttcccagatgcgcctcaaaaagttgtaagacccttccactactttcagggcgctcccggccttcggccgggagaaaatggttttagcaacgaaactccttgtcaatataacgtatatactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttggttgcacatcatggccctcctccctcccttagtccaggcgttggcacgttattgggttgagcgctaaatggcaattcacctgtaggccctaaagagggctgacaggtccatgtcccggatccaagcttctcaccattttcgcacccaacatagtgcagatgggaatgggattggcatctctccaaaaaccatgtgcccaactgctctggactaagccatttattgtaacttgagcatattagtagctacaatattcagcactttggctcggccttgggcatcaatttcccggttgggagcatgaacacggacattgtttccgtctgttgcccgagagaaggccgtttacaattgaccgtgggaaaatacttccctttccagatcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatctcacttggccgccaatagcattgctattgataacacgaccaatgaggcgatcatcgcccagttcttccagaactatgcgtgtgccattgatcagtccttcctatcacttttattngatagaaggacgacgacgcatccgactttaa

SEQ ID NO: 25401 - DNA, 2161 bp, Heterodera glycines
tttataaatattataaaaatcattttaaattttatgccattttatagaagttaaaaaatagataattggaccacaaaattttccatacaaaaactaatgaagaaatctaaataaaggggattattccgtgaaaatggtttaattgctaataaaattgttagtagattaattacatttctatttggaaaacatatatatatatatatatttttttatgatattttccatttatataacttcttggcttccacctttaacttaagtatcaaaataaaatgattcaaattctaaataaattaaaaaagatacttttctaaaaaattaggcttttaactatttattttagggttttagtaatttttcaataaattttgaaagaataattttaaataatgtttatataaaatgttttatgtatataatattcaaagaactgttgaaaatggacaattatcacacagttattaaggattttaacattaattattttttcctgcaaaattttaacaaataaaatacataattcattcttggaagtatgttttcctaaggatgtcatttggcttatgatttcaaacaaagataataataaaattaatttttttgtcgattaaaaggcaaaaatattagtaacacaaaaccttggattaataaagctgataattcaacaaccctaaaaatattaatgattaaaatttctgtttttaatttaaaaatataaaacttaatattttattacgaataaatttttccgaaaaagccattattaagaaatgaaaatttatgataaaaattaacaaaaaatcatatctctttattttaattaattgaaaattgtagtttctatttcacaaaaaaatcaaaaaatatatataagcataccataatcttcattgttataaacaatattatttaataaaaggttccctgataataataaaaattttaatggcataacagcttgaattttaatcattgcctttatggattacgaacatttaaactagtttcggatcagagtgaattaaggcaaaataaataaataaagcaaaaggatggttacattataagaaatgaatgaaacattattattcaaaattgtggatgcaacacatagtatttattcgtgatcaaaaaataaataattaaaattcgatataacaaaaataacagaacttgaaaaaaattaattaataaaacaagattatttaacatatttataatgaagctcggctttgctgatgaattagatggaagataacaaatgtaaaaagaaaaaataaataatttatatctagcatttattaaggatcaaaaaataaaatataaaaaacaataattaatgcaaaacgaatgaaagcatcttgctttagagaaaatgttaacaatgctaagacaatctctaattaaagatataaaatcaaacaataaaaaagactaacattttgaaaaacaacaattaaaaggtcaaacaaattaacaattgtaagaatttttagaaaaatttattccaacaataatatgaaaattctaagtagaggttgatctttttgcatatgaatagctaaaatgaataaaaatttcttataagtagggaacagattttgagtgaaaatttttctcaaaattgatcgccaaactctaatttttttttagctaaaaattctagatttcaaaattgtcctattcgaaaaaattataaatattttatttaatgataatttaaatgatcaaaaataagtttttttgataagttttacgtggtttgctccctaaaaatccttaataatttttttaaatgtacaaatattgttattttttgctgcctttttccaatttttacaataaataaataaataaataagtttcttatgaagaaattgtaaatttcgtatgatttaacatataattaagtaaaatttttgggccggtcacagtaaaattggttgttcttgttgggccttcctgtggcacatttaaaagggtgctaagacgttcatggtgctgcaaacactggctgtttgtgcaagaccaaaacgatgatttgatttgaaattggaaaatttattaagccaattaatattttgctcaaatgctaataaaaactgcctgactgtataataatcaaattagaaaagtctacagaaactgttaatctaaa

SEQ ID NO: 25402 - DNA, 1105 bp, Heterodera glycines
cggttcagaattcaataaaaataacattcacggtgcgaaaaatggggtttgacaagtttattaggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaatttttcaattttttctagtctaatctactcaaaccggttcagaattcaataaaaataacattcacggtgcaaaaaagggggtttgaaaagtttatttttgaaaaaaagaactatacaaaaataataccccctgggaaaaagggagtggggaaacatgatttcaaaatttttcaatttttt

SEQ ID NO: 25403 - DNA, 977 bp, Heterodera glycines
ggaaaaccatccttcgatgtcgactgtgacgccgcgtttagagccattttttcatttttatttaatctgtatggcaacattttacaggcgctaccatcagtccggtgatcggtggctttggtcggcgtcgtaaataatttgttggtgtcgtcgacagaaaatcgggcgtaatctttgatcatcaattgttgattatctttattcaataaatacctatatttaatgcccaaaagagagataaaagccatttaaactcttgagaaactgtgtcatgtcagaagacatcattttgttttgtttttttgttgaatagaaccgcggactgggacactatagatagtctgagccaagtttagagcatcctaacttttttctttactgaccaaatccaacaaagttgatatcattcgaaagcacttaacaagctctatcagcttcccaaaaatcacaaagatatacccacatgtaaaaaagttataaattaaaatatgaaaaaattctaacttttgtgcagtattaatgttgcaacttttttataggtctttcaatcgcttagaaataacttttaacagcttctaaacatatagggctttagaatgatgccaaatttataaaatttggccagctgagaaaaaagttatgatactttaaacttggctcagactataacggccagactatagtgtcctccacccctgaaaccgtgaacaacattacggaaaattaatctgttgtttccgaaacatcgaacacagaatttattcagctcaagtccagtttatgcgtccaatcaaattttcaatacatgcatgttcagatataccataaacacaaaaatatttagcatattttggagtagataatactgtcaatgcgatgcaattaattagatgttaaaattgattggatgcataaaaatttgattggacgcataaaagtcgattggacgcataaactggactagagccatttattca

SEQ ID NO: 25404 - DNA, 717 bp, Heterodera glycines
tttgggcccccgcgtttgggccctcgtttttgggccctcgtttttgggccccagggtcgtttgggccccaagtacagaaaaatgaaaaatcacagtaaaaacaactttttaaatttcagcataaaaatgtaaaataaacattttaaaaataaattcaacaataattttaacaatcaaaaatgtaaaaattaacagaaattgacgggttcataaggtaatttggacaataaaacaaaaaatcacgggttcattcgatagttgcgagaaattccccggagaaactccaaaataatgtgaaattgattttttgaactcgcatctccaaaattttgtcatcccatcagaactcattttagcgaaggtgtaaaggtggccttcgtaagacaattttactttttgttttttggttgcaattgggttagccatttctgaaaaatgtccaaatcagaatgtacatcaaattggttaactattaaaaaataataggagttggaataagtaaaattgtaaaaaatgagcgaatgttaattaaacctaacttatgccaagtggcgagagggatccctcaggcttagtttttagaatcttaatttttaaaaaagcacatttttctatttttgggttggggcccaaacgaccccggggcccaaaaacgggggcccaaacgaccccggggcccaaaaacgggggcccaaacgcgggggcccaaaaacgggg

SEQ ID NO: 25405 - DNA, 1723 bp, Heterodera glycines
  misc_feature (113)..(113): n is a, c, g, or t
gctgaacagcgactccgtttcggaagttcgcattgtatgatcatccgacttcgctggtgcgccacactccgaagggaagcgccctaattaggaaatagcacttaattgaaatntaaaaattgtagcaaattcaaaaggacaacccgcttccatgtcccatccgttcagcaaaaccttaatattaatccttccaatcaaaagcgtaaaaatgtgcgtaagctcgccctgtcgaacacatccgattgattcagttggcttctgaaccaaagtggcgccgtgccgttgggccgtcttttctgaatgctttcgccggccaaccaactgagtcggtgctgattgttgttgcaaattgcgatcatcggaaaagctaacgagacggggtaaacagcgacgatattggtggcaacctaatgagaggaagggataagcgtcattagccaagccaattagcgggagagaaacgcacaggtgtaagccaatacatcattgcttgagcaccgatttggtagaagcaaaggccgatgaacagaatgatcagcaccagccaagtgtaccttaagcaaggactaaaacagtgccaacagttctcaatcaatgggttaattcaaagtacgaaccaagcaggggctaatgacctaattaacgctacaaaccaagcagtgctaatgacccaatcggtgagttaactaattgcctaccagtggcattcgttaaagtaaaccataccttgtgcagcgattttttgaagacaaatgcttaactccatcgatgttggcggcttcgaagatcgtaaagatgaccggtctgtccgtcccgtcgtcctccatcaaaagttgcatcagttcatccgccgtcgttggcgcattctcagcaaattgcgtactgtctctttgtcgaaattttatttggtaaaaaatgctgctttaaaattgcttttcccggcataaattgcacttttttttgctgtcctccgtcgcttcttcttcgcttgcaattgaaattgttggcaccggcgatttttgctgctcattggacggcatttggttgatggaatgaactgccggatcggttgggggagagggcggccgatgggacgcgactgacgggggccttcaaccgaattcggggctgattggacatgcgaatgtgccgttggactggaccttagcgggactctgttcgtcgtgtcccggttcggccgcgacgcgcgtcgcacgatggagccgacggggcgcagctgactccccgtggcgttgcccaactctctcgccaatgaaagggaccaatccgtgtccgtctccgtggaggaggctaaagggggaagaaaagccgcgtaatcagtccggcccatccatcgacatagcgcgtggcggtagacgaacaccgcgttggacatcggccgctgtcgccggatgggtctgtctgcggagttctgcgccgactccaaactgttggccgcaaaatgtcgcaaaagacggtccgcaccccgcgtcatttcttttagttttattaatttgggtaattagagagccaattaaacataaggaaaatgatcaaattaaaaataaatttttatccaaaatgttaaaataatccaaatgcttctgttctgctgccgaaaaatgtgcgaaagttttctcgggaaaaagccatccgttcttttacgatgattaaggcacgcggctttccccgggggaagggaagggcgaaagtcggccgccct

SEQ ID NO: 25406 - DNA, 1594 bp, Heterodera glycines
gctcctcctcacccgttgtcgatgatggtgaatggcactggctcgccttcgccgcccacccgagtggccacacattcggtgaccatcatattgtggggcccggcctgctcgctgttcaccaccaagtgcagctgatcaccgatggatgccttctccagcggttggttgtccttgtcgaggaacgacagttgcgcagtgatcggcggcggtgtgccggcgctcagcacttggggctcggcctccctttgatgggtggacaaacaattaataggattgttaattaattagtagtcggatacaaaaaaataaaaataaacacaagaattaattaatgagtttgggttggaattggacattgaatggaaatttgccaatgtagcgctcaattaattaattaaactaattaataagttggtgggtgtgaaaattgtcgtatgagttaattagttcaggccatttttcagcaagctggattatacaaattaattaaattaattattaacgaatgattttgggatgaaatttgccaatgaagccagtgcttattaattagtcaactaattaatgagtggggttaaaaattgttatgttaattaattaagtattaaattagttaattcataataactgggctggttccccgtggcccaattcaaaatattctaaacgcactatcgtttcccgactgacagacaaactttgtctcgaatatggtggttacgatcactgtgccctcaaagccgggttcttggccggcggcatcgccacctccggcaccaccgccgccgcctccggcactgactacggcaccgccagcgctgttgctggtccgcaccaagcggtcaatgtccatgttcacgtcgcatgacacgcggtagaagcggtcccactccgtggtgacctggtgcggcaacactccgtccaacgagacgaccaccaacgcctccaatttgccgtcctgtggacagaaagatttttgataaagcaattcgttttgataaaaaaacagaggaggtctgatcagcttttaccggcaatgattggacaaatttatatctgattttgatcaagcacccatttcctattggtatatttatttgatcaaaaaaagacaatgggtctgattggcttttgtccgcaattataggacaaatgtataattttatgatctggttatgatttatttggtcaataataccctcccccaatcagtgaccaaatgatttattggtatttaaattcaaatttatcaacaagccacaagtctccagagcgcattgccagaaaaaggaaaaagctcattgttgctactaaataggctcttcttgcaaaaagctgaggctatttaaatcagaaactgattgattgtatggcttattcagtctgatcaaattcaaagtaatgctttgaagagaaactgatcaggagaagagcaataaactaatttccttgcttttggaccttaattgtagtgccacatgccggcgacacatttggcggcgggaatgtgatggaaatttgctttgcattctcgaccacttgggagcacgtgctgaacttctccgccgcataaatggcacccttaaatggagcg

SEQ ID NO: 25407 - DNA, 1272 bp, Heterodera glycines
atgcgattgaaaattttctaaatcagaacagcaggctcaaaaaatcagattttagggtcgaaaatcagaacatttgcgaaattgcgtcaaaacagttatcgatcaaaaatgtattaatattatattttccacctcccataatcgattttaacaattttggggaggaaatacgcaaatcctaaatttcagtgcattcgggatcaaaaacgagatttataacaattttttgcggcgcatttttccaaaaaacttttggtgaatgagcgaggggagagggtccggcggtgccgataggcgccgccgggaaaatttttaaaatttttaatgcgatttgttaacagattttcatcaaaaaaagcccaatttttggaattaaaagccaaatgacgactttttttcgctttaaaaaacgcttttttacggcgcgcttcttccaaaaattttgggagacagggggtccggtggcgccgataggcgccgccgggaaaaatttgtgattttaatgagattcgtcaacagattttgtccaaaaaattgtttaaattttgccaaaaagcttattttcttgataaaatagtgacattataccataaaatttcaaaaattatgagtttatttaagaaatcagaacaaattttggtcgctaccccaaaatcagaacatttctgacaaatcagaacatttttattttatcagatttggaccctccaaatcagaacatttctgacaaatcagaacagatcgcatccctgatcttacatcaaaaaactcataaatcgcgaccatgaaataatgctaatcgttacgaataaatacaccgagaattggatcttcattggtattatttaatgagataataggaaaatttcatgaaatgcatagaattcccgtccaaattccgaattctttttcgtcccccgaacccgaaaatcaaagaccaaaaaatatactgtagtgcttctttttcaagtgcctcattagcatatacgaaaaaattatcccattaattacgcaaccccccgggggggatttcctactaattgtccacgcgcttgcgcatgcattcgttcataggcatcgcctccatcttcacgttgcgcccgaagcaattggtcagcggatgcgcgtcccgctgtttgcccgcggccggcgtcggcgcgtacgcgtccagccaatgtgcgcactccaacttgcacccattctccacctgcttgaaaccgtcgtccgcgcacttggctgcctgagcgcacgtgcacagcaatgtctgcaaaa

SEQ ID NO: 25408 - DNA, 1412 bp, Heterodera glycines
  misc_feature (1388)..(1389): n is a, c, g, or t
  misc_feature (1403)..(1403): n is a, c, g, or t
taccgtatttgttctttttatatgcccgggtatattatttttcaaccccctcagaaaggggtagattattagagacggtcagactaatggggacagggagattatttttcgacagatttatttagtggaaatttttgaaatttattttgaacatttctccaaaaaatgtcatcgtgtcaataaaaaaaatgcttaaatatttacaaagaaattaataaaagccccaaaaatattgaaataggaatatgatattttgcgtttcagaattttgaattttttaataacatattttttcttcgcatatgatatgaagaaaggagctcaaaaatagcatttctacgttaagattttttgatttggtgaaggtttttagtccatataaatccatattttgaggggttttcgagaataaatccatatttcgatcatttttggcaaatttttaaaagatgcaaaaaagcgaaaaatacaccccccccctaaaaagagaattttttcgaaatttcggaaattttttttaggtattttgtccactccaaaaattttcgctgacaacaatgaagttattacaaaaattttgagacgtatttgatttgcaactgtgaagcgtgaatttaataaaaattggcatttttaaggttaaatccattttttggcattatttttaattctgtttaagcaaatattgtagaccttttttggtatttttgagggtttaaaacatatattttggcagtttttagtccatattttggtccatatttgtgcatttttgagctttttagtccatatttcgggctttttagtccatataatttaaaaccctatttattacacatttaaacgaatttcaatttagtattaattaattttaaaaatagaaaagaagttttttagaaaaaataaaaattttatttattcccccgggcagaaaaaaagaaacggggagattatttttcaacctacttcgaagggggtacattattggagacgggcagattaatggagacgggcatataattagagaaaatacggtatcttatctttcgcaaccaacgctttcgcatctaattctgctgaggaccaatctgccgtttcccgttgaaacgaatttagccctaccgtaactttcaaacaatgtcgcggtgacaaatatttattatggtgtgaaaattcgaaattgaaaatgacagcaatattttaaatcgagaagaaaaaatgttgaaaggagtaaacatttgctttttgtctccaacgactttgtgccataaaatgaattaactggtcaggaagaatgtaagatatagattttaataatgagaagaaatgaaataaaatttaaattgaaaaatcattaaatgtatatttgttaaaaaaaatatttcctnnccgtacttcttctngttttggcc

SEQ ID NO: 25409 - DNA, 1389 bp, Heterodera glycines
tgataaagggagacgaatgccgttcacaaaaatgataaatattgttctggtggtaaactgcacaaaagcacagggagcagcagcaggtcaataaaattcatagcttccttgggcctacagcagggatggcattccgatttccgagaattccgaggctcaaaaatttttcggaaatcggaattcgacccaaaaacgtctaaaaccggaaatttttgaaaaatataaattaaaaagtttttaagtcattttacattgttttagaacatttttgggaaggggacatagggggggaggggcgtccggcggtgccgataggcgccgggaaatttttaaaaaagctagtgtaatttttaacacaattgtgtaaaaattactaattaaaaaataaaattccgaaaaattccgactttttacaaaaattgtcggaaatcagaatccgtgccatcactggcctacagtttcatttatgtttaatttttttttataatttcacctttcccctgacccgaacaagctgcagttttttgtaaagcaattcttccccaaaagcatacaaaaatagcaaaatgtacaaaaaaaaacatttttttcccgaaaattgcccaaatttttagcaaatctttcctcgtgggatttgttttgaaaatggaaataagtcatttttcttatgcttaaaaggcattaagttaagataagaaatcaaatctcacatccattttgtggttttgtgctgctgatgaaaaaaatgccgaaaaatgtgctgaaagttatcaaaaggatggttcgttgtgccagtgccaatacggtggggagggaattgaccatggcaatgagcagttcattccaacgcctccgccggttccttcgagtgagaaaggtagaacaaatgttcgtaatgttccgtttaatttgtctttttctccatatttcctccttaagtttcaatttccgccctatacataaataataaatatttttggaccattttaaaatatcttacataaaattaggcattttttcattttattttttccaataaatcgtaaaaaatttagatttaaaaaaattttacttaaattggcaaaaatatttaaagataaatattttaattattttaagtcgtacggtgcaagtatggaatgatctatgaaaacaagcttggctttgcctacccaagagtttgcgaagaagggtaccattattgctttgcggcaaatatcaccaaaaagggtacggacaaaaaacgcggctattttttgattttttcaaaaatcaaattttttaattgaaaatgtattttttgaaagtagcacggcaaaacgcaattatgatttgattttattatggatatgagtatccaaacacagagaaaagttagctaataatgaa

SEQ ID NO: 25410 - DNA, 1328 bp, Heterodera glycines
ttttaactgccatttccttggccccattctcgccaatctttcagcaaatgtccatatagtcgagcttccatttgcgtgttttgaagtgttcgtccactcgtccgtcaaatcggcggctgagcagcgcaatgccaaggccgagttgagaaggcggcagcaaattgaacacggcgtgccaatcagcaggacaaatggaacagaaaaagaaattgaaatttattgaaataaatatgttaaattattatttatattaaattacatttctttgtccatttgtttctcctcctctttcggattgtccgacattttcagtattaaaaatagtttaagatccatttttaaatgctaaaaaaattaaattgcgcatgttttaaaacaattttggtcatttaatagcttaaagattaagcaattttttagcaggtcaaattcttttttttcaaaaaattggaagaaaaatgccaaaagcattcaaaactatgggcattttctccaaaatggtaaaataatgctcaaaatgatgccttcttcagctccaacagcagcagatggacacacaaaaaaaggagtgagtgaatgggcaacgcgcagatggaaaatggaggagcctaaaggcacaccccaagggcaatcaatggaagaaaaattaatgagtgaagaaagtgattattagttgcggaaaaaaattaattatgtatttgcaaaaataaagaaaagttgaaaaaatagtgaaaaaatggtgtaaaattttaaactatcagttttacaataaattaatgagtgagtgtactttcacattgaattcattaaaaagttttattttattccgtacctgcaagataaattaggatgagcaatttttagcaggtcaaattctaattgttttttttcccacttttatgacttttaatggaattaatgccaatttttcattagaacaatatttttattcaaaaaaagcttaaaatttttctgatacagaagactcattgaaaaacttatcaacaatcgattctataggtattagaaaaattttaaaataaacagaaatatatttgctctaactgttctctattagcctgtaactcaaaataaatctggcaaaaattacaaaagaggaggtttttttcttataacatttctcatcgaactttttcggaatcatcatttcatggtctcattctccaacatttcagagggcaaattgaaccgggatacaatagcctaattataaaaaaacagaaaaatttcgttatctttatagtccttgagccttaaagagtttaaagatgattttttaattcatgcaccgggtcgggtctttgaat

SEQ ID NO: 25411 - DNA, 1063 bp, Heterodera glycines
aaaaaaaggcggtttacaaaaattatgggggaaaaaaaggctttacaaaattatacccctgggagaagggagtgggaaacatgatttcaaaattttcaattttttatagtctaatatactcaaatcggttcagaattcgataaaaataacattctcggtgctgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattgggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaaaggagtgggaaacatgatttcaaaattttcaattt

SEQ ID NO: 25412 - DNA, 1953 bp, Heterodera glycines
tattttcagtatttctagagaccggcgcgggacgggatcccgcgcgggattttgcaggatcccagtccgcaatcccgcattttttggaaaatgcgggattaatcccgcgggatcccatcccgcaaagaattttgagttccggtcccgcagcggcaaatttgattttttgtgcgggattctgcgggattttattgatttttttgaaaaattttatggacaaaatgccaaatatttttgaattaattaaataataaatttaattaaaattaactcattttcatcgaaaatttcattcaaaatttgtgaatttcccggcggcgcctttcggcaccgccggatcgccttttacttaataatcctgtagaaattgagtcaaaaagtgcgacatttggtcaattttagacaaaatctgttaacaaatcgccgtaaattttcaaaaattctctggcggtgccgacggcaccaccggacccctcgtgttcctggttttttttttgaaaaattacgccgcaaaaaagctttgaaaagcaacaaactagtcaaatttatggaccgttaataatttgaattccgatcaacttttaccgtccgatccattcgaaaaatcttagtcgacccatcagccccttttattgcatcccgttttttctggtgtgtttttgtaccaattttcaaaaaaaaaacttagagaggttccggtagtgcccgcccgaaaatgttgattttttgtgatatttattaacagattttgccaccatataatagcataatttaataaagccctgctggtttttattgttttaaattatttttaattaattccactcactttctttcgggacggcacataaaaggtaaaagcccaaacatttctcatcatcagcgcttcggtttattttggccacaattttccacggaagtcctttgatgagcacagtttcgctttttcgctcacttccaatgatttcgcaaaaaaattcggaagctttttcaatttccataaaaattgttttgtctgctgtttttggagcagaaaattggcccattttagcatcttttaagataaagtcaactgtcaatgtcactttgtcctcttctctgttgtaaaattcattgttagggtccagcaattccttaattaaccataatggatcaattaaacaataaacaaccactcaccgcaaatgaaatgaatccatggaatcctgcttgatccgctgtgtgatcaaaaatttgtccgaaaaatttgccggtagaattcttcacgtcgaacttttgcgaaacaattcgaaaggttgcggaacattcacagcaccaattctcatcttaatttaaattaagacaacttttaatgtaaaataattagcatttgatttactttaccttcttctgctgctgcacattgaagataaaagcccagccatttttcatcagcttttccatttatttttgccacaatattccaaggaagtcctctgatttgaacagtttcactgaatcggcaactccccactttttctcccacaaattccgacactttttcaatgtcaaaaataattttcccaaatgtcaaatttcgccaattgctcgggaattgcaatgggccgtacagtaatccttcggaagtgccacacattttcgattggctacggtatttttcaatgccgaccacttcttctgcaattaaaaggccggacggaactgtaaaaataagagttagacggaccgggaatggcattctaagcaattaattttaagcaacccttaaaatgtctaattttataaatttttactaactaataaactataaattttaaacgatattctaattgcttttctgtatagttaataggtaatttatgttaaaattgatatcccattatttactttgttttaatattaaatccactgttggccaatttgaacagtaaattccacatgtgagaaaagcgg

SEQ ID NO: 25413 - DNA, 2110 bp, Heterodera glycines
agaaaatttaaatttaatcaatattttcgacaaaatttgctaaaaatgtctttctgaaattttttcggtccttaggggtcaaagctaatttacctgatgggggccgttctaatagaggttttttggaaaaatgccaaaatatggacaaacatgcaaatatgcacataaatcgcgaaatatgtaaaaatatggaaaatatggatatagaaattcatcctagaatcttcaaaccaagttaaaaacatgtttttcgtacgttttaggcctcccacagtccaggaaaaaagatgggaattccatataattcccagccctagtaatagttaataaatttccaaaaattttattagtttttttcaaaagttcaggccaaaaaactggaaaattttcaaacttttgaaaaactagtaaattattttaatttaagatgagaataaagagaagagaaaaagtgaaaagacaaattaaagaggtcaacaaacctaaaataaatagagagacaaaatccacaatgttttaaacgaaaacaaatatcaattaattaaattaaatctccaacatttattctattagaaataaactgctattgaaatgaaataaaacaattttccatcaattatgcgagattgaactgcttgctcagttaaaaatgcattgaaaagttgaataaaaatgcttgtgcctttaaatcataatacaattttttattgtttgctcggaaacttctggaaataaataataaaagtaaatgaaagtttttctttgttaataagcgaatgaattttttaatgcttcgtcgctaccgtcaacttttttgacgaccagaatcggtgctgcccattcggtgtgctcaacttttccgatgacttccattttctcacgacgattcaattttccgtcaactgcatctttggcgttgtacgggaccggacgaacctttctgtatattggccgtgcgtcggagttcaattctaagtacgcttttatgcagagtcccaattcattttaaaaacattgatgaactcctgctttagctgactgatctatttttcggcgtccttgtttcgcttgccggcatctttttgaaaatttgtgttggctaaatcactaaatctgattatcgagtgacccaaatgtctgtttttacttgccaatgaaaatgtcgcgtggtgaaattgtcaaattgtacgcgaagcaagcgtcgagatggcacagtacaaatggatcagtgcaaaaatcggctaactgggaagaagcgaaaatagttatgataattagattttcataaatagtgcggacgtcaacatcgtagacaatacgtgagcggtagattatttttctcaacttaaaaaatataactaaattataaaatgtgtcaaaactattttacctcttcacgcactcgtctcacttcaatggaagacattttttcaacagtaaaagcaacatcaaaggcttaaattctgtcaaggatatcgcgccttgcaaatttgttgtgtggacggtggcattgagggcaccaagctgaaaaattattcatttttttaacttttggcccctttttggctcttaaaataaacttttttgctcgaataaaaacaaaatttgaacgtcgtgaaagaaaaaaaatagcatttttgagcaaatacgtattgtgtcttactttttcataaatattaatttttgatttcttacggggcgacgtctgcttcgaaagcgtaacgtttttcattgaccattttactattttaatagaaatatatttttaatttattgaatatttttctactttctcagacgtctgctggacatcgaattctgacattctttggataattcgcacaatgtctcattaaccaattttgatacttcatctttggttcttttgtccaccagactttcattattgtagagaataggagtctttgtgctatatcctttgtttcgcagctatatagagttaataaatatttgcacagtttgaattactttatagaaagcaaacacttacgaacatatagactatgtcgcttgcttcaattttgtcaagtatgtagccccttgccttattgtacgtaataatttcttgtaccggtctgcctattgaaga

SEQ ID NO: 25414 - DNA, 760 bp, Heterodera glycines
caaaatatttttgaaatcaccttttatttggttaataattaaaaaatgtagcctattaaaatatttagaaaaattttattattttatgttttttgaaaaatttccgacttccgaattccgatttccgacgtttttggggtcggaattccgatttccgaaaaaattttggtcgccggaattccgacttccgatttccgaaatttttgataaaaaatcggaaatttttttttttaatttttttttttcaaaaaatatttatttttgtacaatttctattctctaaaaaccttaattttcttgaaaaatttactcaaaatcgctaaatttggtcatttttgtcaaaatctcttaagaattcgtattaaaaattgcaaaatttttcccggcggcgcctatcggcaccgccggccgccctgcaccccttttccccaaaattgtttaaaaaacgagccgcaaaaaaacaatgtaaaatgacatgaaaagattttgatgaaaattattgaatacttaacaaaatatttttgaaatcaccttttatttggttaataattaaaaaatgtagcctattaaaatatttagaaaaattttattattttatgttttttgaaaaatttccgatttccgacttccgaattccgatttccgacgtttttggggtcggaattccgatttccgaaaaaattttggtcgccggaattccgacttccgatttccgaaatttttgataaaaaatcggaaatttttttttttaatttttttt

SEQ ID NO: 25415 - DNA, 1202 bp, Heterodera glycines
atagaaatgggggaaaagagagggcagaagcctaagaaaaagcgccgaacagcaaaaaagtaaatgacaaatggacgaaatgtttacgataagtgaaaggggaggaggaaaagcggaggaaaagtccaaaaagttaatagaagaaatacaaagagttgagagagagtatcaacccaagtgagagagagagaggagagagagagagaggagagagagagaaaggagagagaaagagggagggagagagagagagaaaggagagagaaagagggagggagagagagagagaaaggagagagaaagagggagggagagcgagagagaaagagggagggagagcgagagaaaatgaggaaagatagttgacggagggagaaatatagacaaaaaagagaaagagaaataactttatatatttttactcatttttctataattaaaagtcattaaagtgattttcgcccccaggtgaaaccaacggacaatcagccggaaaacggacaaatgctgaggggggcggatgcgcggaaacggagggtgccgctctgtctgttcgtcagacgggcggaagaatcaccacacaattacgaatgtgcttgaggggagggagatgcaaaggaaaaacagtggaaggaagaggaagaaggaagacaaagcggaagagaaagcggaagaagaagaagaaaaaggtcgagaaagcgggaaaagaagcgaagcgcaagcaacagaaagaggaagaggaaaggaaaagaaagggaagagaaagcggaagaaggaagaagaaggaggaggaggaaggggaacaagaaggaagagagtgggagggggcgggggggggggggtaaataagaaaagtgatgtcaaaggagtagagatcgacattttgaaaaatgcctggacctggacctggattccatgttggacctggacctggatttcctggacaaaaatccaggaaaatccaggtccaggaaaaatccaggctcctcgagacctggatccaggcctggacctgggatttttttaaaccaattttaaaaatcaaaaaaatgtttgaaaaattcaattaattgcttgggaacatctaaaaatatctaatttacaataaataatttgtttttaaatatatttaatcattttttgaaaacttgaaaaaatatcggtcacttgaaataataaattctaaaattttgtccaggaaa

SEQ ID NO: 25416 - DNA, 1375 bp, Heterodera glycines
  misc_feature (1312)..(1312): n is a, c, g, or t
tgactttttcggactatgcccgaattttcaatttttaaagttgaaataaaccgtttatttctaaatgaataataataattctcagcagttaaaaattccttaatggtcaccgctcgtaattttttttaatttccaaattaaattttcataaatgctttttagagtttgaaaattcattgataaaacaacattttttaattgatttgttgaaaaatgagaaaaaaacaaaagaagtgctggacattttgggaattgatggcttaacaattcacaaattgcaaaacgaaatcagcgaaaaaattgatcatttaaatagcaaaaacaaaagtaaaaataaaacaaaaaagaaaaaatatataaaaaggaaaaaagagaaaattggcgaagtgttaaaagggacagaagaagaaaacacggaggaaattagtgaaaatttcgatgaaaaaaaagaaggaatggaagaaaataaagaaaaaacgataaaaaatctggaaaaggaagaagagattggagaaaaagaagaaaaaattgaagagaaagaagaaaaggaaggaaaattagatgaaaacattgaaaaagaagaaaaagttggagaaaatttagaaaaaaaagaaaaaatgaaagaaaaggaagaaaaggaagaaaaggaagaaaaaattgaagagaaagaagaaaaggaaggaaaattagatgaaaacattgaaacagaagaaaaagttggagaaaatttagaaaaagaagaaaggactgaagagaaaaaagaaaaaatgaaaaaaaatttagtaagggaagaaaaatttgacgaaaatgaagaaaaaatcaatgaaaaattagaaaaacgaaaattggaagaaaaagtttcgaaatcaaaagattttgagacggaaaatggcacaaaattgaagaaaaaagatgaacaatttgccacagaaaaattggaagtgaatgaatttgcatttatcaaattgggcgattttgaggacgaccaatttttggcattaaaatacggtgaatttttgggaatattaagtcgaaatgacggagaaaaggcgagaaaagcctggtccccggctctgaaacaatttggggaaaaggaaaatttggaaaaatgtgagcattcgttggcacatctgttggacattggcattttggcgaacgaaatttggcattacgttcagacaatgaaggcactgaatggaaaaagcaaagatttggcaaaatttgaaaaggaatgggcccagctgaagcagctcaaattggaagaagaaataagtccaaaaaatttggaacaaacgcttttttcgcttatganacgaattgtggtggagggaatcactgcaaaaaatgtgcaaaatttaaaattggaaataaacga

SEQ ID NO: 25417 - DNA, 1643 bp, Heterodera glycines
cgcactaattcaaaaatacactggtaaatgccttttttcatatttttttgatcagccataactctcttcatccctaacaaaaccgaacaattttagtatctaaaaaagtttattaaaggtagaatctttttctaagcaaaaataagcgattacgttgtgtgactttcaaatttcagtcccaccttaggttttgcaacaaaaatcaatttttcgaccctaccatgattttgtctaccccctaccctatacagacaggtgccacaattaccatcaaaattacaaatctatcgcgataactcatttattggtcaaactttacatacaatatgaaacggagttacattggaccagatatagatagatacataaataatgtgtacacacatagaacacatcaatacaattagaacaatatgatcactggtatggaaatcgcaaaatttgcttacagtgataaaacacaaatgatatgggcaacaacatataattttggggatagcatcggtttgggaggggaactgtttgtcggcccggccattccatcgttcgtccgtcctcgtgtactgcggcggcatcattggctcttctcactgctggagctcttcgatcctttgtgcttcttctccttcttggccccactgccgctcgctccatccgatgactttttgccgccaagtgacatgccaacgaactgaaaagggaaaacaaaaccgttaaaatgattgatggaagaacagatttggaacgagcaaacgcaccattccaccgccgaacagtgccacagcaacgatcaggtagaagaagaagcccatttggttgattggagaacaagcgcggtcgaagttgacgtgtgtggaagatgtgtgggttgaaagtgtttgcgcaattatcgtcgttgagattattttattattgggaagtgagcgaaaatgcgaatgtcggttccttttattcaatctcagccacgacaattcttaaacccaacattttgccaaatttcatttgatatataaggggatgcgttttcatccttttcaccttcgctactaccatttgcccatatagaagtgcacccgttgcaacatttttgtgagttttttctcttttttttcgtgtgtttttttgtcttctttttacatcccctccatttgtgttcagaaacggcctcgacaaacccccccccccctatttaatgttagtgctcaaaaattcatatcctctgctattcagtggcacacaatgcacaagtctcgccaaaagcaatccctacgaaattgtgatggagtgacaagcccaagccagaatccaaaaaattccaaaatttttattaaggacatcaattgtgtaattgatattaaaagtgtcattccagaataaaagaaaaacccaattttattttcttggcaaaatgccggcacacatttccttaacacttttttccagaattacccaagtgtttttttgacaaaattcttttttttaaatatggtttttaattaccttcgactcatgtgcaaaacggccattaactttgaatggcgcccgcctttggccctgataaattctcacataaattttgtccgtccgtcctaaaaaggaaaaaaagtttagaaaagaatatgtaatttcgactaaaatgagga

SEQ ID NO: 25418 - DNA, 1028 bp, Heterodera glycines
ctgtatttgtctgcgcctagttcaatgtaattacattttttatcaagtgtatttcgccgaatatttctaaccatacagtgccacgtgcttggcatttttttaaaggagtacaccccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacacccacaaattaaatcctactgtatttgtactgcccctagttcaatgtaattacatttttttataaagtgtatttcgccgaatatttctaaccatacagtgccacgtgcttggcattttttttaaaggagtacacccccctgattctttgcagaaaagtgcacgcatttcgtcatttccgatcggtactaatttcaatggatgaattaaaactttctgggcattaaataacaaaatttaaaacattttaagaaaagaatcataaactggaattttttaacgaaaagcaacacccacaaattaaatcctactgtatttgtactgcccctagttcaatgtaattacattttttataaagtgtatttcgccgaatatttctaaccatacagtgccacgtgcttggcatttttttaaaggagaacaccccttgattctttgcagaaaagtgcaagcatttcgtcatttccgatcggtactaatttcaatggatgaattaaaactttctgggcattaaataacaaaatttaaaacattttaagaaaagaatcataaactggaattttttaacgaaaagcaacccccacaaattaaatcctactgtatttgtactgcccctagttcaatgtaattacatttttttataaagtgtatttcgccgaatatttctaaccatacagtgccacgtgcttggcattttttttaaaggagtacaccccctgattctttgcagaaaaggcaagcatttcgtcatttccgatcg

SEQ ID NO: 25419 - DNA, 961 bp, Heterodera glycines
tttcaaaaaagtgttcgaaaaaaaagagatagtcgtttttccatacgaatatgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttcctgaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggacattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgg

SEQ ID NO: 25420 - DNA, 2215 bp, Heterodera glycines
ctagagtccggcgggatcgggactcccgcgggatttttcgggagtcccgctcccgactcccgcttttttcggtgaacgggatttttaacgggagcgggatttttacgggattcccgttcgggacttccgtcccggaaaattttgaactcccgatcccgctcccggaaatttttacccaaaaacgggagtaaaaatgcactggtaagaattgagttttttggtaaaaataatgattttttattgaaaatctgttaaatatatagccaaaatttcaaaaaaattttcccggcggcgcctatcggcaccgtcggaaccttaaaatccttaattttctttaaaaaatgcctcaaattttcaaaattggctatttttggacataatctgacaatgtattgtatttaaatattcaattttttttccctgcggcgcctatcggcaccgccggcctctctcttccaccctggtcaccaccaaaaagttttttcaaaaaataagccgcaaaaaattgttaaaattaataaagggagtcaaaataaattatttaaaaaatttatttgaagaaatttgaaaaaatttctgattttcgaccaaaaatatgattttttaatttcaaatttctgcttactaaatttttctgtatttttttctctaaaaaaaggattgcccttcaaatttgtgcattaaaaatatttttgtgagtatttaattaaattttcgaattactcccgctcccgcccgggactcccgtaaaatttctgcgggattttaacgggagcgggattttcacgggattcccgatcccgatcccgctcccggaaatttttttttaccggactctattaaaggcccaaaaatggcaaaaaaatagtcactttttggcgaaaaatggctacactcaaatttttaaattaacgcaggccaaaaaatttttgcccttggagcaaaaaaaagtattcggattcccgccttcggaatttttttctggctatactaaaaagtttaaaattaggggtctaaaatgataaaatttattcgaaagtaacaacattaaaccaactcagtaagagatacataattttaaaaatcaaaaattcttatcaaggattaaataaataaattttggagatgaatttttgagaaatttttcatttcttaggggtgtatttttgaaaaaattttaggtcaattcttatgggtatatttttcgtttttattgcatttttgtcaataattttgggcaaacgccaaaatagttgaaatagttttttaaaatttttttatgttttaaggttctaaaaataaaaacctagaaaatcgcactaataactcgaaaagtagcttaaaaacaaccgaaaaaaacatattttcgtgcgtttcaggccataggaagtccagaaaaaaaggtaaaaaactaaaaattggagtcctattaaaagaaatttgtttaattaattattattcattaaaaaatgagtgcataattaaaataataataattaatttaaatatttactataattgatattttatgttcgccccattaatattttttaggttcgaccagcaggcagcgaacaattgtaaatttcttcgatttgctaacaatgcattgcgaaaatatttgctctaccttatatcgaagaaatttttaagagaaaaagaaggtttttaaaatgtttaaaatgccaaatatttaataaaaataataaatgttcactttaaagataatagtatagtgaaacaatttaaacatcaaattttaatgatttaaaactttttgcggattataaagattttaataaaattcaaatacttttttagggttatacagctccaatttatagcatagaaaattgccaaaatacgttttgaaaatagaaaatagggttagtccccctaaacccgtccgatttggaaattgcaaatgtggtcgattgcactccaaaatgctagatgtttttaaaattaatttctaagagatttttgttttttgaaaatttctgttacctatcttttctaatttttatgactagagctcccaaaaatatgcatataaaatcgcaaaatatgcaccaaaaattgcaaaatatgcatataaattttttcaaattgagaacattccaaaattcttcaaattcattacatttatgctagaatctcgaaaaataactaattatagtattacaataatttttagaagaaaaaatgaaaataa

SEQ ID NO: 25421 - DNA, 898 bp, Heterodera glycines
  misc_feature (20)..(20): n is a, c, g, or t
aaaatggggtttgaaaagtntattgggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgattcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaatttcaattttt

SEQ ID NO: 25422 - DNA, 1003 bp, Heterodera glycines
accatacttccagggttctcacttgtgcttcaatgctcctaccttcatatactctacggggcatttccgcgaacagaggtggtcaccgtttccgctggtggcttgccgtgggcttagatacatacctccttccatctaccggtgtacgggctgtcgacgtctgggctacgactaagtctcggactcgctcctaggtacactcaagtgcgcccggataacatgtccagaaccaattatcgcagcacgctgtatcgactcaagcaaactcgggattcctcgtttaggtatcccaagttcactcaacctcttcgttatatttggtaatacctcgccgcacgacccaactactatcgggaccaccttcactgttgggaaactcgtaccgtacgcaaggcctaacgcatgtttcaggttaggtcccggtatttcagcttccgctagttccaatggttcgatcatagaatttatggcatatttccgccactttatgagctcctgtttaaccaggttctctctccatggcaccgaaatttccacaataaggatcgtacgtgcttttttatcgaatattaccatatcgggcctggtgctacgcagacccgtataactcgtactcccatcctccctagggaggacgccggcaggcgaagtatgcaacgcgacatcgtacaggattttggcatgttcattctcgattaccgcatgcaaaggaacgacatgagaagaaacgggcagtccatatttcctgcataaagccgtgtgtacttgccgtacaacaccgttatgtcgatctaacatagttccggtccgtgaccgagcacaaccactaaggatatgctgctcggtttcaacacgaccgtccccacgtcgtcggcaccactttgctttcgcgtttatatgtggacacgtaagctcccgcgctttcaactgtccctcctgtgctgcaatgcggtctcggaacgaacgcctgccaattctcgcacggatcaacccagtggtagct

SEQ ID NO: 25423 - DNA, 1013 bp, Heterodera glycines
aaagtttgaaaatgttataaaaaaatttcaggatgaaatataattaaaataaatcaaaaagaaaaaaaaatttatttttctaaataaataaaaaatattgtcagaggcagtgcctgccgaaaaaaaagacaaaaaatatttcgaaaaaagctaaaaaaattgaaaatttaaataaatttaaaagtgaaaaaggaaaaaagcttacaacaccttcgattcccaggacgtctccgttccaagtactaagatggcccaacgttgcttaacttgccagatcggacgggatggcgtgctttcaacgtggtatggtcgtaagcgaaaggaaagcaattaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaataaatttatttttctaaataaataaaaaacatagaggcagtgcctgccgaaaaaaagacaaaaattttcgaaaaaaagctaaaaaaattgaaaatttaaataaatttacaaaaggaaaaaagcttacaacaccttcgattcccaggacgtctccgttccaagtactaagaaggcccaacgttgcttaacttgccagatcggacgggatggcgtgctttcaacgtggtatggtcgtaagcgaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaaatttatttttctaaataaataaaaaatattgtcagaggcagtgcctgccgaaaaaaagacaaaaatatttcgaaaaaagctaaaaaa

SEQ ID NO: 25424 - DNA, 1593 bp, Heterodera glycines
tttatttgtttttaatgaagcattttgtgcacaaaagatttaatggtatcaactgagtatgaacattataataagtttatttatccagcacatttttcggtaaaattacggaattcggtgactacataaaaaataatcctatcaccgggccccgcagtcaaccgcctgtggcgctcgtcagactgcttcctccgccctccgtctcgccccactacttgctccgtcttcgcatgctcccttttgcgaaagtaggcttaattttgaattttgtcgaaaattaaatttcggtttttttgttcgagtcagggttcggtgttcgaatttggtcaaatggatgtcataaccgtgttcagcaacctcaaaaccccttaataatatgtttttttatttataaattttgagtttttgttcgattgggttcggggttcggaattttgaaaataaaggtcatattcgtgttcagcgccacaatttaccctagaaaaattatttataatgtcttttgagtgctttatatagcacggtcacttgagtcccagctgagtttggcactccattttcggcacttttcatcctgaaaaaggaaagcgcgcccctaattctatttttccaacccatttcaaacctttttacatcgattctgactgtttttaagcatttttgagtttggggcctatgatcaatatttacccaaaaatgttgctaataatcagacgaaagcggcaaacttcggatcttgaccatctttgcttatgctcccaaaatttatcattttttccaacaattatcaatgccaatgccgttgcttccatttagccaatgttggcctatgcaaatgcaattcaattggaggacgaatttgccggcccaccggcggatgcgttgggcgtggcgcctcccctcccgcaccatcgtaaggccaacaaccatcgccaacacttttcgctccaaggcggcgctgtgttccgccatttgtgcgcactgtacacaaatttcaatgtgagaaattgaataattaatcacaaaaaatatgaaaattaatttttttttattttttaaatttatatattatttttttagattttggtgcatttttattcaaattcacagttcaggaaaatttaatgaattccgcgtataatttcactccttttttaggaatagtgatgcaatttttaggttttacctacttttttcctgagctccctatggtcgaaatgcatgaaaaacatatttttttgggggttgttaagctacttttcgagttattagcacctaaatgaaattatgaaaattaaaaaaggttcggataaggcaatttttaaaccaaaaatttttatcaagaataaaacaatcaaaatttggggatcaaataggcaccaaaaatgacgaaatgggcataaaaaataggcgcttaggcattaagcataaaaagtccaaaataggcattagaaaagttatcgtaaaaaccccaaactaagctgaaaacaaagtttttgtgctcatctgtgcgtatcaagtgctcagaaattttaggcatttgcctaaaaatggcagactaattataattgatttatttcaactacttgataa

SEQ ID NO: 25425 - DNA, 2249 bp, Heterodera glycines
  misc_feature (2229)..(2229): n is a, c, g, or t
actttttgttcctatttttgtgtctattcgaggatctttttgcttatttaatggcctattttgcgattctatttatttttttggcattttagctgacactttgcgctaattactcctttcccatatgcagtcttcttcctcatcttgttttttctcctcgtcactcttctttctgcacaataatacccaatcccattatgataatggggcgagccaacaaatgatcattagtgcttttggccatgcttaacaatggccaatgcccggcttcaaatgtttccgcctccattccgtgttgctccgtctgttcggaaccgtccaatggcactttttatttttacttttttacctttgagtgtattcaatttaaactgaaattattttccattttggatagttgatttttatattaataaatttattaattttggcattttagctgacactttgcactaattactctttcccatatgcagtcttcttcctcttctttctcctcctcctcttcttcctctttctcctcgtcactcttctttctgcccaataatacccaatcatcccattatgataatgggtcgagccaacaaatgatcattagtgcttttgaccatgctaacggccaattcccggcaccaatttcaaatgtttccgcctcctttccatgttgctccgtctgttctgaaccgtccaatggcactttctttggtgttccatcgtgccgcgcttgcagctcattcttccgccgatcggtgcttgccaaacggaactatttgtgccgtaaggcgaataattgtgccatcattaacaaaggtccggagagggaggacaaattggcaatcctaaagaatgggggtccattatttaagattttttattttgggctcaaaatcagtttctggaggttttcgaagatgctcattacgaatctgctctcgtgtttgcccaattccgaatcccggacccgaattcgaataaaaaaagttgaaatttttttcccaaaacatatcgttaaaaccggtcaaattttggcacaaattgcgcatttttatccaattaacaatttcagcagtgttttacatccaaataaatagttaactaaatgaattagaagtttttaccccagaaaaatacatcattggaaaaaaaattgttcaactttttgttcaaattcgggtcggggattcggaattgggcaaatctgagttcagaaattcgagattagcgccctcgaaaacctccaaatactcatttggagctcaaatttaaaaaaaaataatttaaatttaggaacccccattcttaagtactgccgacaaattgccatttcgaacaaatttgtttttttgttttgtttttttgtagaaggaatgcgaaattcgtgccgcgcatgtcggctcaaacggtgttttggagttggcatggacatttcgcaaagacactccaaaaagcctggccaacgttaattaattgtgaaggataaaatttaatattttgccaaatttagccgaaaatatagcaaataaattggccaatttggaaaaaaaattctgtccccaaacaattgcttcttgctcattgtcagcagccgtatcagcagaagcaaaagcggaatttgttaatgtcgatggagaaaatgcgctttttaaaatgaatgtaatttaaaacaaatataatttaaaaaatattttttattaattttatattagaaaaaatataattaaaaaaatatatatatatattttttattaattttatcgtccaacaactatttagatgaatgtgaatttgccaaactcattcaaatttatgcaatatttccgaaatattgacaatggacaacgggcgtttgtcaatgttttgaaagggacacacaaaatcattttggatgcccagcaagtaaattaagcaatttgtattttaaaataatcaaaaattcgatttttaggcgtgtattttccgtttttcattcgattcttagggggtatattttcgtttttgaaatcacgaattagggggggggctgtattttacaaaatttttagccatttttcgccaaaaaattacctattttttgccattttggtctccatttttcaaaaatatggtaaaatgggggtccgccggtgccgtcaggcgccgccgggaaaatttttttgagaattttaatgcaatttgttaagaaaattgcttaaaattcaaagaaatttgctgaaattttttactttttgnggtttcgggggggggggggg

SEQ ID NO: 25426 - DNA, 2467 bp, Heterodera glycines
gataggaaaaggaagggaaatgggtttgagtcagtaagggatcaattcgggtgccatgatgccagcccagtataaattcctcagaaagtttaaagattgctccattgttgcattaatcttacgatttagatagcgaagttttctgtttgaggcatcctcacagccagaaacgacgtaatacattttcgaggtcgctgacttttgcttggacggatgggtttctacctgagaagaggcgacggtcaatcgcaacgatatcttagtaaggtgaattctctaaaggattggccatgttagggtaaatggaatatgtcggaaagggaactggactcgcataccgaagagggaaagaaataaaataaaagttaattgtatataatcactggatatcgcacaataaccaggatttaacttgctttgctgtatttaattggggataaatctggggcggatatgaatggtcaatcagcaaaatatataaatgagacttgagtattagaaacggaaaagacacaaatatttaattgtcttaaatcactggctaccgaacttggtaaccaggattttacttggattgctggacttaattggggttaggacctgggctggggagtaaatggttcaatgcgcaaaatgtgttaggtgttgaaatgtgcgtaaatgtgattaaaaatgaaatgctgtgaaatttgtgaatgtgttaaataaatgtgtgtgttttttttgttattctccgccacaccttcaagattggaggagtgggatgtgattgactgggggtgtcactgatgaaagtgggaggcgggtgaagggcagtggaggagcgagggcaagaagttggatgggagaagcgcgaacacgagttcgaagtgcaaccggtcggcctgaatgtgattcaaatcttataatggggctgagccatcgcagaccaatgtagaaagagaagaaggagagagaggaagaaagaaagtaaaaaaaaattgaacgtggtttaaaatttttgtatttaaataaatttgtttagttagacggttttcagtgaatacgactgatcagaagagcagttgactgagattgatcagaaaatttgactcatatttggaatttttgtgatcgttaaaaatgcaaaatatgtaattttgaattttattaatttaaaaacaattttggctgattcggagatgtgtagtgaccagaagcaattaattaattattatgagtgatcgaaagaaaaagttacagatttaaatgtgaaggccattgatttgagtaacagttagcagaatatgatataaattctaatttgcgtgatcaagaacgtttgtgatttgggttaggtgatcagaatgtcattgatttgaataatataaactgactgtgtttgaactgagttaaggtttgcaatgtgtttatgatttggatttgatcaattcagagaagcgtattaattatggcaaaagtgtacaacaattggacttagttcaaacaaaatttgatacgaatccgtacaatcaatttatgtaaccaaattggaaatttaatatgatcaaacagaatgccatgaatttgaatttgtcaaaaatattttaaatttgaattaatgtttccgaaatttatttagttttggtaagattaatcaaaggtgtcattgatttgaataaaatttgataaaaatggtcgaattgcgttaggattgacaataattgatttaatacaataattttagaaaataaaacgtattggaatcaaattaagcattgtcataattatttatatttaccatgtgtcaaaatttgttctgtttttggaaaaaaagaagagagagaaaaaaaatatatattaatcaaaagttccattgatttaataactttagagaaaagaatcgaatttatgtgaacaaaatttaaattaaatatattcgaacagaatgccagaaatttgagtattttgaacgagaatgtgtcagtttgaatttaggaactcaaaatttcgttgttttggaaaagacgaatcaaaataacattgtttgaattgtattgcagaaaaatgtgctagaatcaatttaggcatgtcacaaattatttctgtacagttttgtttgagagattggcgaaaatgttataattgaactgtatgatcagaattagagtttgaatattgaacaaaatgccagtaatttgagagagagagaaaagaacatggactggaaatttgttacacgatttatgtgatgagtaatgttagtgaattgtgttagatgatcagaatggcattcatttgaataatattttaaaagatttcgctgaaaatgcgttaaatttgaatacaaaatgatcggacagaatgccaataatttgaatatttttggttgaaatgcattaatttgatttatttgctcaaaattttgtgttttggataagttgatcaaaatgtcattgatttttgaatattttgtttgcatcatgct

SEQ ID NO: 25427 - DNA, 1422 bp, Heterodera glycines
gaaaacccaaattttcgtatttttgtggtgtaatttttaaaaatttccaaaaagtctatctttagggttgtatttttcgcttttttgcatttttcttgtgaaaatttgccaaaaatagccgaaatatggactaaaaaggcaaaaatggcgaaatatggatttattcccgaaaacccccaaaatatggatttatatggactaaaaaccttcaccaaatcaataaattttaacacagaaatgctatttttgagccccttcttcatagcatatgcgcagaaaaaatatgttaatccataaaattagcaagcctaataattagcaaataaaaatttttatttttattaataaaatatgaattcaaaataataaaattaagattaagaattaaaaagggtgcattcaattctttaaattcatttacctaacctaaattccctaattatcaaaatatcattcatcaaaaacaagcaaaaatttaatgatattgagcatttataaaaataataaaaataaataaataaatattattaaaaattaactttagacaaacaatcttataaaaacaagatgcaagtgaagaacacaaggccacacttctttatccatggaataaatgaaaaattatttattaataaaatatataatttaaaaaacctaaaaacctaaatactagagaagatcatggtcgtttaactcaaagtttaatttaactaattgcataataaatacgaacaaatgttgatttatttgttatttaaaacagattgaaatacatagagatattccaaaataaataaaatgaattaaatacaatcatttacatatgacataaattaaagagattttttgatatttattaatttttaataataaattaaaataaatattttaattttttttctaaaattgaaattttacattcatcaaacaagactaaatcgatttcacaattgcacgtgtgagttagttaccttaataaatgagacacatatttaatcaaattaaatctaatatttataattaattaataaataaaataaaataaattattttttattaataaatacgaacaaaataataaaaataagaataagaattaaaaaaagatcggttcaattaattataaatatttaatttaaaaaacaaaaaacctaaagcaattaaagattattaaatatccctctgacaataaaaaaaaatgtttaagttttaaatactgaaaataattatttccttaataatcttgattttgaaatagttgaaaactttaaaataaatattaaatctgttatttttgaatattttctaaaaatattccataaatttgtattatatatatttttcaccaaaaaactcttttttaaactttcctcaaatgtgcaaattttgtttttttttgccaaatttgtcaattctattgtt

SEQ ID NO: 25428 - DNA, 1310 bp, Heterodera glycines
ttttcagaattccaattgccaacccatcttcctccgtctcatcccctgccgatggcactgccgattatcggaagcgatgccttcatccggaatatttgcacctcgcattggacagtgccaacttggaattgcccaatttttctctggccgacttgtccctgttttggacgctcagtttggagtgcaaaacggcaacaggtttataccatatttggcacagcaaatatttagtcaattgatgtgattgatgtttcagtaaaatttaaaatttttttttttaaatttccgttcggttgggcttatgatttttaattctctacattaaactttgaatttgctttacgcaattacaattttaggttggacttgcgctacgatgcgcggaacgctgtggactcacccccgtctggccgcgactttcctgaaactcatgccagttatccctttcacccagcaaggagtcggctaacaacaacaacgatgcgcgggacaaagtgttgagcaaagccatccaccaaagtgccaacaacaaaaacagtgccatgtcaaatgacgacgggatgcgcagaggttgttggtttgtggtttcaaatgaaacgcggaattttgtgtgcatttttgggggcttaaaggaaatttgggcacattatcaatgtgaaatccgggttgatttacatggatcgcaaattgttgccccttttcctcatcccttttccccattttcaaaaaaaaacaaaaaaatttttttgatggggggggggggggggtggacgagttgatccaatgaacagaatatacaataataaatagtctcgattatgcatttttcaaaatctctttcaagggaccaccgccaacaacagcaccaaccattttgacgatccatcgtccttttttggtgctgatccatcctcggcataccatcatcggtccgcatcacatgacaatgccaaaaatgccggcggcggtgactcgcatttgctgaccgtcgctttgcatgtggcgaagacgcagttgttgctgcagaccaccgttgacggtgcaactgctgctgctgctgcaccaaataatgaagacaatgcacaggttggagaagagacaaaaattttaaaatcgttcactaatttttttggaatatgcctagaaaaaagtttatattcatcataaaattttaaaatatccctagaacacttttcattttttctcatgatttatttaataaaaaattttttagatttttttttcgattttgtccaaaaactagcaaatttccgaggatttttgcttacttttttcggagggggggggag

SEQ ID NO: 25429 - DNA, 887 bp, Heterodera glycines
ttattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggatagcctcatcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggttatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggatagcctcttcaaaattttttccattaccctaagagctgctgaaattgtgaattaattctcagaaaaatggttatctctttttaggacaattttctatctcgtaaccccgatgctaatccgttccggatagcctcttcaaaattttttccattaccctaagagctgctgaaattgtga

SEQ ID NO: 25430 - DNA, 1433 bp, Heterodera glycines
  misc_feature (1357)..(1357): n is a, c, g, or t
  misc_feature (1376)..(1376): n is a, c, g, or t
  misc_feature (1379)..(1379): n is a, c, g, or t
tttttatgaaaatttagcaaatttttttggaaaatttggatgagattttcgttttgatgctctattaaaaacccatactgaataattgccaaacattatgccaacttatcaaaattaatcaaaatttaaaagatctgacgattttccccaaaagcctcaaaaatcctcaaaatttctcaaaaaactacaaaaagcctcaaagcctcattttgaaaagctcattgacctatcaaaaaaccacaaagaacgataaaaatataatttatatattttacattttaaaatattaattttaattaatattatatttaagactgacgacgtattataataaaaaaaatatgaaaatatttgccaacattaaattatagccaaagcgaacatatttgccaacattaaattatacatttaaaaacgattggtaaatgaaaattttatctaaaacatatatcccatctttaataaaaaatattttagcaatttcttttaaaaatgaggatgcaaatatatttattaactatattattatgttcaatgctataaagaaaaatggaaaaaacgatatgattgcgacaacagcttttgtaaatgtctatatgaaagttctgagtgttttctaacaaaagtctgtatttgttttttttgtttaaactataatttttagaatttgttatgttggtctgttaaaatttttggtgaacaattcaaagaacaatgaaaacagaaacaattttttcgcatcaaattaattacactatataatcaacaatttttgaataaatattatattaagcgagttctttctgtaaatatttttatcgttctggcagttttaacaaacgcgctagcacctaattttggatcagcttcatcgcttcttcattttttataaagttctcgaattctgactttgtattagctacaaagttaataagactaaggaatgaaagaagtataaaaagtaaaatttcattctaaaatatatatgaataaaataaaataatttttattaggagataaattttatggaaatattatagagataaattggccacctcacaagtaatgacatggcaaaaaagcttattctatcaataatatgtttacattataaaatatataaaaatacaattgcgaataaaataaaagtgcaatccatttaatggtgtcttcaaatattctaaaaaattttaaaaattaatagattaaaataattatattattaattaattaaattcatttattcagtactgaaatgacccacccctctgaaagtctctcactgatatttttgtcacttcgtcctagcaccttttgatctttttaaaaaatatagaaataaactaaaaacagtttngaaataccttttacatggntanaaaattaaaaattagcctattaaatattttaaaaaaattattatattttatttt

SEQ ID NO: 25431 - DNA, 1275 bp, Heterodera glycines
  misc_feature (1250)..(1250): n is a, c, g, or t
aaaaaaaaaaaaaattaaatttttaatcctttgtatttaatgtttagtcgtaattttcggaataatcaaaacggatgcccgataagcaaaagagagcgcggaaagaaagaattattctgtagtttcgtccgcctccgccttttttgatttaaaaaaaaattttaatggcataaaaacgggtgcattacgtttcgcaaataaagccccccccccccctccgtttttttggaaactgccgagggtcccccctttactttgttttagagttgtgaaaacatatctatttaggttttttcgggtcgcttattatgatttggcattcattttggccaatttctaatcccgaaagtaaggtatttataagaattgagttttctactttttgttgaaaattctggtccgggattcgaaatagaccaaaatgaatgtcagtggcagtttagagattaatatttttattgtcgtatatttttttctttgctaacctgtgaaaaatccgaggcgggggaagaggcaggcgatgttcagacacgcgtaacgctccgccaccaccttgggcagtggctgtgcccccaattcggcaagcgtggcgtggcggtggccgtgcagtccgatggcgttggacgtcggcggcaggtggtcgtccgcaaacacaatgcgaccctcggcctcgtcctgcaggaatttgcagatttagaaaatctttaatttgaaaaaaaaatcctcaatgggcttttggtaacagtttcatctattttatcgccccttttgttgtaattatttcgggttattttcgttcgagtcggagtcttgacttcgaagctggacaaaatggatgcccatactcaggagatgaaaaaaaagtcaaaaaaggaaggagaataagtgtttcctggagacataaaaatcgaaaaacgacaaatctcactcacaaatcaagaaaattttggggaagaactgaaaacactaaaaaagtttaaataaacaaccagagcctagggcatagcatcaattgaataatcaaattataattttaatcaattgcatccagcagaacagcaccttttggaccaaggtacacagcaacaacagcagaatttcgatgaaataattcattttttatgttcgaagctgaaaattaagcttgagtaaaataaaggaaatgggtgatttgaagggtctgaatctggtactcattcagtttgttcggcccttttgggacaaattttttagaagcgaagccagacagncagacagtgcactatttccttcttt

SEQ ID NO: 25432 - DNA, 1659 bp, Heterodera glycines
gtcaccctcatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtatcggtttttttacaattaccgattaccgctcaactctagaaaaaagcgaaaatttttctgttatggtacaccgccaccccgcccgctgcgaatgttttgttttcatgtaaaaaaataattcaattaaaaatacgctaaaaattcctcccgaaatattgttaaaatttggttggagggaggcataagggaaaagtacaaatggacaattatgaggtataaaagtctcaattcaaaccaacatttttatttttgtacagttcttaggcaccatttgttgactttttttaaattttaacttttggggtgaaagaaaaaatcgaaaagcatctttgctttactgaccttccacaatcgaatcgagcggctttttcaacgacactgaaaattagtaaaatttacagtttatttcagttttcagaatccaggttgaaaactcgttccagtccggtatttcccttgtttttcaggttttccctaatgaccggtcactctctctctctcgtaataaatcaaatgaaaaatgtccatcaattgttgccaaatcaaacataagtattgaaaatgctcaaattagcaattttccaaaatctgacaaaaaaaaactttctagtaaggctgtgatttctagacattttgtgtgcgaattttaaatcccaggcattataaagcccatcttggactgaacgccgatttgaccctggaagttttgcatttagcaaatcccagcctttctcattagtagggctgggatttttagggttttacctatttttttgcggcttagttatgatgagagaagcccaaaatagcagtttctcctaacaattttcgatttagagcgactttttagcacctaaaaacacctatttttggcgttttggcacctaaaatagtttacaacctattttggcatttttcgaatttttagcacctattttggcatttttgagaaaaattcttaagaaaaatacaaaaattgaaaatagacccctaaatatcgactttctttccatttcttacagcatttccttatttcttaatttattcaaattccaaaaatgacaaaaaattatgcgccggtgactttttgtgacgttgaacgagtttttcaatttacaaaacaattttatcagaaaaaagaacccgttttacccccgaacacctcgaaatgtatttaatttgcaattgtgctggcgaaatggataaagaatgagacttaaataggattttttgcataaatacacttggtttttcctatttttaacacctattttggccttttttgaggtttttggcacctattttgcacttttttggcaccttttttagtacctattttggaatttttagcacctaaaaaccctagctctatttataatttttatacataatggaaaaattttggaaaattatattctgaaagagatcaattaaagctattgaat

SEQ ID NO: 25433 - DNA, 1348 bp, Heterodera glycines
acaacttttcatatagcgccgacaattctatgcatatttaaaaacgctaaatgttcagagatgctgcgcatcgtgtccatccgctggcggggcaaggcgtcaatttgggtgggagtttagtgtttgttccattgtttctgcccgggggaattacgacttgagtcaattcgtagcactccaaatcgaaaagcgtgccttcagaagtgttttctattgttacagaaaaaaatcttatttttacgactttcataaaagtttactcctttttaaattttccagtcatccccgacaaattttcgtggaatttcctcccaatccccgacttttttgtttattcagcaacactcatttgtctttaaaatgctttacactttttcttaggctggtccgatgttcgcttcctcaccgctgcgcttcagcgggctttcgacgagggaggcgatttgggtgcaattttcacatatttaaattaatttaaatttttgttttgttttaaggttcgttgacatatttgcgcgactttgacagtgcgagccaaaggcgaaatgggccgattatattcgcaattgactgtctaaaccgactttactcgaccgaccaccccttttgcacgttgttccgttccgttgggctcaacattttggaccggattcttccggccaaggtggttttttttcgtttgttgatgtaaaagaatttaatttcagtgatttcagtcattattttttgaattttcttttccttatcaatgaatgcttcgttcttttcaggatttgattgttcatctggcctcatgatttgatttggtctttactcgatttatgacgaatttcgttgatttgtactgccttttttattttcagtaaatttttttatttcaaaatgatttattttgtggagcactagtccatttagaacagaaagaatgggaaaataaggggacaggctgatgagagcgtttttcttatcaatgaatcaaaaagttgacaatttgaatgaattttttcttttggtaaacatcaccatttttattttcatttcagaaaatggagaaattagaaaagagacgaaaggctaaaatagcgtatttcctaaaatataagcccccagggcttctatttttcatattcttcaaaagtgggctcaaaagaatgaatgaggcggcatttgggctcttattcagtttgtcccccataaaaaattttttaatttctaagtaaaaaagtcaaaatataggttttcggggtcgctgatcacgaatccgacatccatttcgacccatttcgaaccccgaacccaaattcgaacaaaaagtcaaaaactcaattttcaacaaaattcacatttt

SEQ ID NO: 25434 - DNA, 1352 bp, Heterodera glycines
  misc_feature (10)..(10): n is a, c, g, or t
cgctcgaacnggaatattcaccgtctgccctcaaatgtgaccttggcacattttttggccgaaatctctcccgcagagaaacggcaacaagttcggcatacggtaagtatcgtaatgctcccccaacaatttattagaaattttaagttaattaattttttaattcctcgcaaatcagctcgaacaactccaaggaattgtctcggccgatgatcggcatgacaatggttggcactcggcacaattggcccattgttttgccaatgccaatttctcttctccgtcggttcgtcccgtcgatgacgtcatttgcgatgctctttatgtgagtaagttttttaattgcttatttttatgcttccctttgctaattaggtttttctgcacaaacacaacgcgccaagtcaatcggaagtggccaattggcgattgctcagcgcaacttcgtacgccttctgcgacgattcgctcaattcgctgcgaacaatggtcaaattaaagggcagcagcagaagggcatttctcagtcattgcttttcaaaatatttttggattggattttaattgggtaaatttttgatcaaaaaaaaaaaatccgtccgtccgtttatttctgatcactttttttctgctcattaaaaatgctctccgtcttcttcacagatcgacacgaagcgttgtgatcagaaattgtccaacgtggcgcccaccgccacaattttcctcggccttctcattttgggcgttggccgcacaatgccattttctctcggcctgccgctgatcgacgacaacgtgcgcaaaagcaatttgccgctttatttcggttggcttttctcccatttcttacaatcatttttgggttatgttttcagcgggaatgttttgcattcgaataatgggaccgatgctcggctttttgctcggctcctttttcaacaaaaattactacactttgggaaagggtgagttcgtgctgtgatgctgtgcttggctatatattttttatttgtctattttaattcaatttaattaattcggttttattttttaattttcccagtgccctacggaatgactccaagagatccgatgtggatcggcagatggtgggctggctttttgctgatcggctctgtgcttttgctcccttcgttggcactgtttttcttccgaaacccaaagcaaaaagcgtcggctggcgaagaaaatgaggacgaaggagggcatcgcccccggggattggcactagtggaccggcatttggaaaagggcgaagacggcgaagtcggaattggcattgacattacaaatttatccatggaatggcactcaggcaattgtgccgaagg

SEQ ID NO: 25435 - DNA, 1024 bp, Heterodera glycines
  misc_feature (149)..(149): n is a, c, g, or t
  misc_feature (154)..(154): n is a, c, g, or t
caaaaataagagatagtcatttttcttgattataagataatttaaaaaattctctgtgaaataaaatggcgattgcgcaccgcacttcctatcatgctcgagagcatttgtaacgtataaaatttctcaaaataagagatagtcatttntctgngatataagataaatttaaaaattctctgagaaattaaatggcgattgcgcaccgccctccctctcacgctcgagcgcttttgtaacgtataaaatttctcaaaagaagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaataagagatagtcatttttcttggatataagataaatttaaaaattctctgtgaaattaaatggcgattgcgcaccgcacttcctatcatgctcgagagcatttgtaacgtataaaatttctcaaaataagagatagtcatttttcttggatataagataaatttaaaaattctctgagaaattaaatggcgattgcgcaccgccctccctctcacgctcgagcgcttttgtaacgtataaaatttctcaaaagaagagatag

SEQ ID NO: 25436 - DNA, 1345 bp, Heterodera glycines
agcgccaaaaattttattaatgccattattacctctttttccatgtttaggccgaacaaaatgccccaatattttctttctaaattatgtcatttcggtcagcagcgtcattagggcttaacgtggtaagccaaacaaacaaaaatttttttttgaatttctccgcctgattttcgccaaatttcagcgttacccctcctctctctgttccccctctctttccctccctctcccctctctccccagtcttccccgcttttccccaactctgtccaattgttcattcgctgtaataacacacatttacacattgcccatcatcagtcagtcagtcagcaaccgtagatgaccctcccccctcccctcccaactccgacaacaacaacaacttgaccgaccgaccgaccgaccgaccgaccgaccgactgactactgagtgaatgtctccccccccccaattcgcccccttttggggctgtgcttagtgcaaacactcgccaattcattcaatccattcgatgcctcatccatcaccaaatttgttcacatttcgttgctttcctgttccattgcacaaattcattcattcgcctcattctcccaaatccattaacaaacccaattagcctaattaggcttaattgttttggccaatcccattaagttggccttggttttctttctctttgcccagtgggcttctgtttcggtaagctcaaagtatctcgcacattgtgctgttgaactttgtcacaacactccgtccgtcctccgtttctccattctctgctaaaaatggcatttgcatttcccctccccccggcaaatcattgcgtcagtcattttccgctgctgctgactcccacaaacgctcatcagccaatccgatcgaaaaaacaacggccggggaaacaaattgggcggggcgggggggagaaggaatggaatgagtcaccgcccggcccaacgacggaacgacggactaacgacgacacattccgtcgttttttccatcgccgtcggtcggtcgtcccgccattggcccttttttcaatttgcattaaaaatgcgtccgatggatgcgatgccttagccgtgattaaagcactgaagtgaataatttctcttcatctctgctacttttttataagccccctttttgatcattttctaaattttccaaatgtttttgttcgtttaactctcagaattgcaaaacttatttaatggccagaaattatacttgaaaaaatcattgtaattttttgagctttgcgaaactctgaaactttaaaatctcaatctttgtgaaaattctcattatgcttgcccaaaatgatcaaat

SEQ ID NO: 25437 - DNA, 1146 bp, Heterodera glycines
  misc_feature (88)..(88): n is a, c, g, or t
aaattcaaaacttaaatttcctctgaagttttaactgggctctaacctgcttttaagtcccaccgtgagggccggacagttccaaaanttgtaccacatttactgtgggaaagtccaagtaccttaaggactacagaagagccaattacagcagtcaccttggaccagttatgtaaaagaaataaggaaatatccgatggggtgcgatcctttcaaaaaattactctcgtcttctaccctccctctctttttgtgcactgtttcgttttaaaaattggttccgaaattttttgactctaagaaattaaattgtaaaaattcaaaacttaaaattctcctctgaagttttaaacttggctttaccctgcttttaagtcccaccgtgaggcgggacagttccaaaatttgtacaacattttactgtggaaagtccaagtaccttaaggactacagaagagccaattacagcagtcacctttggacagttatgtaaaagaaataaggaaatattcgatggggtgcgatcctttcaaaaaattactctcgtcttctaccctccctctctttttgtgcactgtttcgtttaaaaaattggttccgaaattttttgactctaagaaattaaattgtaaaaattcaaaacttaaattctcctctgaagttttaaacttggctctatcctgcttttaagtcccaccgtgaggcgggacagttccaaaatttgtaccacattttactgtggaaagtccaagtaccttaaggactacagaagagccaattacagcagtcacctttggacagttatgtaaaagaaataaggaaatattcgatggggtgcgatcctttcaaaaaattactctcgtcttctaccctccctctctttttgtgcactgtttcgtttaaaaaattggttccgaaattttttgactctaagaaattaaattgtaaaaattcaaaacttaaattctcctctgaagttttaaacttggctctatcctgcttttaagtcccaccgtgaggcgggacagttccaaaatttgtaccacattttactgtggaaagtacaagtaccttaattggacaattacttgtcaacgaacacagtcgcctctggcctcttatggaacagaaaagggtgaatatcag

SEQ ID NO: 25438 - DNA, 1545 bp, Heterodera glycines
tttttggtaattgggcagaagcgtaccaaactcttgctgggatactccccggtaatggactaacttacaccgaaacgagcgccgtgctagctcggctcaaaaaaattttcgaaaatctcgagtctttcgtttttctttattttttgcaaaattaattcttaaatcttttttcagaatgggttctcgaaacgcaccaaattttcatttacatcggttagtttcaggcacttctcgacgcttttttctcatcaaaaagggagatgaataaaatttttaaaaatttttaattcctttttaaacaggccaaaaagtttagggctttaacttttttttttcagaaaactgatcagaagcgcaccaaactttgcagggatactgaaaggaagagaaaataacctatttttaaatattatctagtcagttcatttaaataatttttaatccaaaaaatttttttttagggttttcggggcagtccccctggaaccgataggcgcccagaatttatcaggggatgaaccgaattcctttccgagaaatagctttcactctatagcctgtactttaattctgcgttggatttttgcttccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaatcgatttatttttgttttcggggcagtccccccgaccgatgcgccccgatttatggggagaccgaatccttcgggaaaagtttccctaaagcc

SEQ ID NO: 25439 - DNA, 1385 bp, Heterodera glycines
  misc_feature (211)..(211): n is a, c, g, or t
aaaagcgcattattttttcactacttcgacatttttttaaaatttctaaataaaaatgcaataaaaacgaaaaatacacccctaagaatcgtcttaaaaaatttcagaaaatacacccctaaaaatcgcgaaaaattttcaaaaatacactcctaaagaatgaaaatttttattttcaaattcattttcttggcaagaatttttaatttanaaaattatttttttaggtaactattttgggtttttgcccttaaaaatcccagtcctactcatttgcacctgcaactagtgaataaaaattatttttgctcaatttttggctaaaaattatgtcactatttcgcactttttgccactattttggcacatttcgtcactattttagttaactattttgagatttttcgtcactaaaagtcgcggccctacaaatcagtattaagataataaatgattttttaaatcagaaattcttgtcaagaaaataaataataaattttggagatgaatttttgagaaagtttttagtttcttagggatgcatttaaaattttcgggtcgattcttagggttaaatttttcgtttttattgcatttttggcttacatttcaggaaaaacgttaattttggctcaggcgccaaaagttataaaaaaaattgaccagaaatctgaaactggataaaatagaacaaattaattaaattgaagcctatacaagagctaaaatctttttttttttgtttttttagataccagcaaaaatccttacccattgtggccatttttgttctgagctaaaaagcgtactggtgcatttcgtaaaaccgtataattttaaacttttgttaaaaaacaatcaattgtttcatatagacaattacaaaagtatttgtcacaatcatagcgtttttgtcttttatttatgtagcacagatttttttttatattatataaatattagtttatctcataaataacaccaaataattaatttatcttttgtgattgtataatttattataaattatatttgattaatttaaatttatttacgtaaaattatgtaatgaatattttttataatgacgtcagtcatattttgatgttggaaaaaatgttaattgaataataatataaatgtaaaccaaaaattgtttacgtcaggcataatgtaaaataaaaaatgcttattctcataaaattgttaaatattttatctattaataatattttttatagtttttagaaaaaaatgaaattttcttacattttctcgctgggttttcgtttctggattttgcctttttctctatttgatgctttcgaccgatggaatgcgtaaatttgcaacaataaaacacaaatttaaataatatttaatta

SEQ ID NO: 25440 - DNA, 1175 bp, Heterodera glycines
  misc_feature (67)..(67): n is a, c, g, or t
cagaataattacgccgatactaattgttctggaatttgtttctcggcgcgtttgtttgggaaaaatntggaaaattggctatctcattttctgctcaacagtaataggaattccaaccgcattctcagaataattacgccgatactaattgttctggaatttgtttctctgcgcgtttgtttgggaaaaatttggaaaattggctatctctttttttgctcaacagtaataggaattccaaccgcattctcagaataattacgccgatactaattgttctggaatttgtttctcggcgcgtttgttttggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggatatctcattttctgctcaacagtaataggaattccaaccgcattctcagaataattacgccgatactaattgttctggaatttgtttctcggcgcgtttgtttgggaaaaatttggaaaattggatatctctttttctgctcaacagtaataggaattccaaccgcattctcagaataattacgccgatactaattgttctggaatttgtttctctgcgcg

SEQ ID NO: 25441 - DNA, 1480 bp, Heterodera glycines
ttgcctccagatcagatgaaaatgttcgacaattgagttcatccgcaactgatcgtggtgcaacagtcaaactggcgccagtgtccattaagcagcggacgggtgtggaattaatcaatgtctgtaccacggcgtgatgcggcgaaatcgcattcagatttgggagcattggaaggtctgaattccgttttgagcagagcagtactgaaatagtgataaaaatcagaaatggaatgataagcagataaatcattgatggagaagtgaattgaattgaaatttggttattcacatcggggtttgcaaaagcattgggaagacaaactactaaaaacccaatgagtacttttggcgcccgaaaactgaagcgagccctttttaccggtctctttcgttttcctgcaattttgtatgcctgggtttgggcgggttcaatgagcttaacgggactgagttcaatttcgttaccaaattctacagatgcattcagatccatcatattgaggcgtgctggagatttcacaattttctgcgttttgtttccaccaaaagtcatgcgtcgtgttgttcctctgccaacgtattcgtctctaatcattaatccaaaccggatcaaaaagtctgtaaaaacaatgattatcattattgacaggacaattttgccaatttgttcccagttcccaatcattttgctgcgaatggactcactcacctgctcccattgctcggacaaagtctttgtgactatagcgtcctcacttttgatttggaatgtgagttcgctttctcttgccaaattggcgtcgtaaaattggccaataaagtcagacacattcacaagggcaaggtggagaaaggaatggcgagcataagtcggtgccaatgacagattcaggctaaaaccttcaatgcgattggcatttacctgctttacttgagcatcgatttgatcaatttcgtaaagcgaaccgcgcacaaaaatgagttgtttgcggtattgtgagcatggtgccagtctcgcatcggagctcaaaatcattgtccttgggtcaataaatgccattcttttgttgtccttcactcggaatttaattggaattttgtcaatgcattcgaattcggagtccgctgagtttccaattttggcaaattcgtaatcgtgtgcttgcaattcgatgcatggccacactttaatcaattcaggcccagccactcttgccaccagtttaccagattggaataattttctggcaaaagttgttggatctgagagaagtgccgtcgctgcccatcttctcgtctccaacatataatcacaaatcgatttaattgtctgagaaaaggaaagagtcagcatttctcttacttgttcatccaaatagcccaatttggagttcattagcgattcggtgacccaactttcaagtgatctcgtcttagagatctctttgaggattcgttgctatcgtcggaaggcaag

SEQ ID NO: 25442 - DNA, 1104 bp, Heterodera glycines
ttattttgagcttcacccattattgattattactgatcatcacttattctttacactatttgtccatttgctgaacaaaaatcagaggaacataaaaaacagtaaaaagtactaaattcggatggaattcgtttcggtgtgtaatttttaaattaaattcccataaatttgcgttggtttttggccctgaaatatttttgcgattattccccttgatcagtaaataaaacacttcttattgatcagtggtggcatatgaatgggggctatcaattaattaattgttgtaaagtgaaattatcaaaattatcacaaattgggagcacgagggccattcacttggtaattgacgacgaaatcttcgccatttcgaaggatgtttagcgtaatgaccccgcaattggtccccccgctgctgcccctgccaatctcccttatcagtcactcactttacataaggcccccctccccctgcaaattgctgaattttctgccttttgcccttaggggctctttttgtgtccgtacaatttatttctcgtgcaattcattccttttccacctctccggccacccctcaccacaataagatttattttttattttttttgtgctccgttccgtttgttccgtcgtcaccctttcccctcccctccctctcctctccgtcccctcttcccgtgtcgatcatttttgataattattcgcctctcctccgctgacggttagcaaaatgattgaggaagtacactaccgccacgccgacgactccccaaacagtggcggcgcatcggaggcggccaaagtgccgaaccatccgccgccggtgccgtcctcaaatgactcgccgtccgcctcctcaacggcgtccttcactttcgtggcggacccttttttggtgttggacaacgatttggacgacgtgagcggtaagcacaaacaaaattggatgaagccaagcaaattgtttgttagaagtgatcaagcacaacataatgaccgatcagtcgagcggagcatcaacgccgtcgaacagtcggtcaatcaaaagcggcggcggcgacaaagcggcggcagaaaaacggtggacgataaatcaaacag

SEQ ID NO: 25443 - DNA, 1551 bp, Heterodera glycines
cttgatgccgtttttgttgtcgccgttggctctgccgattgtttttccattacaaagtgtcgctgctgtgccgttgttgtcgtggtcgtgtacagctgcagctccatgtgcagtgccttcatctccctgcccacaatgtgttggccgtcctcgcacgggtcgtagtccgggtccatccgtctgtacaagtcgtaccgctcctcctcgtcgatggcgccgttgttcaacaaacacgtcaaatggagcagaaaatgggtgcgcaaatggcggctgtcaatgtcatgccaatggtatttgacgaagacgcgctgaacaaagagggaaatttatatggactgctttgtgctttgtatgtcctaccaaagttctgtaaagcatccgacgcccgaacagagtgattcgaatgcgaagaaggaaagtgttccacatttgcatcattgcgcattcggccgggtgaaggtcgctgatgtcattgagcttcttgaaaatgaatttttcttcatttcccagtattttttgtgagtctaataaaattaaaaatacacatcatattttttaattgactaattgtaaggtaaactattgaattaaattgtcaaaaggttccgaaatgcaccggcggagaaaatttttgcaattttaagtagagaccgttaaaaaaacttgggagtgggactcccgccagtctctctctaaatgtaacgaaatatgttaatttttaatttcccataggttaagggcctatcgggggagggtaaaaaataacgtttcccaaaaattcaaaaggttctccatgcccgcctcttcccctccctcactctgatgctcatctgtcgcatccacagtttgtcaatgcgtgtcggcgtctcaaaattgaagcgccccttcagccgaatgtattcctccgccgtgctctgtttggtggccaacgccgtgtaccgttcaatgggaaaattgtccactcggcgcatttctctggccaacgccctgagacgaaaagtgttttatttgttagtgccgtggccattgtttcctcacttagtgaccagccaagtcggacgcacggcagtccgaacggacggaagctcattggacgcgtcgtatttggtgttttgagagatggaaaagccgggcaaacactgagtgggcgacacggggacggatggctaggacgagaaattggaaaagttcagaatatggaacaaaaaaaggacctcatagcaaaactcaaagcgcgggtggcagaacgtgagatgtttgtgcagggcccacaaactgcgcactttcagcgatgccaaacagaagaaacaacgcgaggagggaaaacgacgacaaacgaacggaggagagacgacggaggaggagggagaggaagcgaagggggaagagagaggagaaaaagcggacagaggggagaggacggagtcggaggacgaccgtttggaggaggagcacgaagctgacaaaagggagaagcgaggagtacaccagcagcagtcagtcataatttaaagaaacatcgagaaatggactccctccccttttggcaca

SEQ ID NO: 25444 - DNA, 1611 bp, Heterodera glycines
gcctttcgctgttttttccttagcagaaagagaatacacaaagagagacgggggcaaagaagacatacaaaaagagaaatagaacgaaaattttctcggtgtcccacctctattgtgactcagcataaaattgttttactctttttccaaatattctcccatttccattggttcttatccctggtccctttgtattcggacgatgaaatctttcgccttttactaaaggtttccgtgcagggggacgcttatgggttaaacccaatttttggacagcgccttctccagggagggtgcgaaaaatttctaatatattttaaaatgtctctccaaaaattggtctaatgaaacagcgaaaacgccttacgcaattgaaaaagtcaattaaaactttttgaataaatttggcaatgtaagggggaagctggctgggcggttaaaactcggaaattgtgggttgataagacgcataaaaaagaaagggcaaatgtgcctcggtagctcaatgcgtactcgtggttttatcaccctttgaataatttttcaatagttttttctaacctctggtcacgaatctgactttatttttagttatcatgtgttttattcggtgcctgacttttgacagctgtatgtatttaacatttaatgctgataaattcgatggaatttggaaaatatatcagattatattttaaaatttggaatttcattaaaaatcttagattcatggtctgcgtcaaaattaggctaaaaattagttccaaacccggaagtcccgcacaatggtagagctgccattttctcctcgatgagggtgttgcctcggacatttttttcaaatttctccagccatcccttgacaaattttgttggggaatttcttccccgatttttctctccccgagggtcgggggaaaaccccaaattttaatgcattcatattttatttaaacattttttatgagtaatgcttatgttataattaaaaatcaatttatttttgctgtaaaactgcttatcaatcgtttgtctgatcattcttttgttttctccactttctgatcaccagtaacctccaataaaaaatgatgtaaaattttaattcgaaaggtcaaaattaacctcctacatactgtgaccagcagaacccgcaaaattgtctaacaaattcaaagtttcaattgagggatcgattccctaaataaaatttaaaatacatttttgttttgttttttccatttattattttaccacattctgttgctgattttgatcactttgattaccaacaaaatttgccaataaatcctttgttgttttcacctcatctaaatggtcccgttttgcacttgtttctgcttcatttgaatcaatactaatttcgctttcttaataattaaaataaataaatttattcaaaggtgattagaaatttatcactttttggctttaagtctccttttttaagacaatgacattttaaatttgttgggccattgttgataattaacaaatcataatttatttcattttgcccattcgcttttggtttaggacattttctataggtataaatttcagcctaaaataattaatattcaattaaaa

SEQ ID NO: 25445 - DNA, 1810 bp, Heterodera glycines
atccgcaattattataattttaaaatgggttaataaatttttattcgaattctcattttagtggctccatggcaaagttaatttgagggcttgtactttaccaaatgaaattgaaaataaggcttgtttaaaagccttatcttccaaacgaaattaaaaataaggtttatataaaagcgttggcactccttgaaaaaatggacgatcgtttggtggaagaaacaaacaacgaatttcccaaaactgaatacaacgagtggaaatcaagtggagttttaatttgatcatttgtcaaaaaagatttattcaaaatttagattttctttaccagctgaccgaattaccttacttgtatgcaattcaacacatggtcaaaattgaaaagggttagaaaattaaaaaaaagcaaaaatgtttatttttaataaaatttttttttgtttaaatgaaaacgaaaggttttataacattcatttaggcctatcagattcgggtaccctaaacttctcattggtgtacactgttgccgatttgtcgcagcaattggtccaagcaattgggtccattgtgcataaaggattgtatttgacgcattctcggaaaaaaagggaaaagcctttcaagtaagaaaaaaaatggaccccttgaagagtcgtggctagagacaggcatggttaattattcggtctctaatttaggttgttttaccgaaaaacagaccaaaaatttggaataatttaatgttaaattctgaaaatttgtaaatttggcgattttactgcaataaatcttgcagagataaataacattgaataatatttaatattttaattaattctttcggcaaaaaatatcataaaatttcattttttatagtgttttgatttaatcaggtgaaaaaactaaaaattggattaaaagaaaaatgagtttatttttgggggggtggttcatattttttaccgaaacatttgaaaatagctgtaatttagatgcattctgaagagcataacaatggcatatgcgagattgcgaacaccgcttctcgaaataagcaacatgatcatcgctgatgtcaccaaacttgtaggttctaaatgaaataatcagcccctaataataatctgaaaattaatttgttttattaaataataatttttttaaaattaaggatttcattggaacaatttgctcaggaatcctttcaaaagggaacactcttgctttggaatctgacatggtaaaatatgatcaattgtcgaagggcatcaccgaatccacgcatttgtggtggaagaccgaatcttgtcagtgtgttatggtatgctttgtggcatttatctagggatgggtacggtgttaggatgttagtcaagatccatcacacccatttgtcaaaaaaaacattgtatgttatagatttactcaagaaagccgaattttaaatcttgatatcattagacagccctaattgttttatattatcctgcaaaatttcaaaaagttcgtcaagtttcaagaaagttaagacgacaattaaaaaaaaatcttccttttttgagtttctcagatcataatttttttgaatatttggataatttttttaaaattttgcaggatagcagaaaacacttaggactagtgaatgataatgatatattaaaatagtttaagcgaagttctgatattctagtgtcaaaatttttcatttgatgttttttggtgaacgcccactctgatggatttgtctatctccccagcatcaatgggtctctgacaatagagaaggatggtattttcaggattcagc

SEQ ID NO: 25446 - DNA, 831 bp, Heterodera glycines
tttttgggaaattttctcagccattcttaggggtatatttttcttacatttttgttaagaattttttttgaaaatcctgaaaataggcgccaaaaaccacgaaatagacaaaattaggcattataagtcatcgtagacaccccaaccaagctgaaaaagcgtttttcgtgctgataagccatttgcctaaaattgcattccctaggtttgggtaagacaggtgttttttgcaaaattgttcattcaattttaatggaatttatttatgtcattgtattttatgtttttttttgaatatcgattttccaaaatattagtatatttaataagtgatttatagggattgtttttttatgtaagaaaatcgcaaaatatgtaaataaaatatatatataaaatgctaaaatatgtaagaaatatgtacaaaaaacccaaaatatgtaccaaatatgtaaataaaatgttttttaatggttattttttttgcaaaaaattcctagtaaagggtgaagaaggcacaaaatgtcttaaaaattacctaaattggcttaaaatcaattcttattatttaaaaattatttttgatatctcattttttgaaaaaaaaagttttttaggaatacattttcaaaattttttttttatttttcacaaaaaattttcaattaattctcaaaaatcctcataatatgcaaaaaatgaaaatatgtacgaaaaaatgaaaatatgtacgaaaaagtccaaaatatgtataaaaatatgtacatatgtaatatgtagaaaaatccgaaaatatgcaaaaatatgtaaataaaagtcccaacttttgtt

SEQ ID NO: 25447 - DNA, 1158 bp, Heterodera glycines
  misc_feature (63)..(63): n is a, c, g, or t
  misc_feature (116)..(116): n is a, c, g, or t
  misc_feature (144)..(144): n is a, c, g, or t
aatggatcaaatggcaattcatacacacaggcaaaagtcaaacattttaaaaaaattatcttntaatttcaaaaacgaatttttttaaaagtaaaattgggcaaattcaaacagtntaaaaactgaaaaaaaaatttttttttntaattttgatggtaattttctcttaaaaaataatttagaagatttttattaacaaaaaaaattgtacgagttgcctttgtatggaaatgtcatgacatcaaggaaattggaaatactagcatgactataatctcaaaaaccggtcgtcctcctaatttatgctcaggggatctctttggattcatttttgtcctcattcggcagttcgtcctccgccttcaattcttcgctatcaatttcattaccaccttcgaacattgtaaaatatttacgatgcccgccaatattgccaccattcttggtacggcatttaacatcattcattttttgaaggtggtcaactgcagacgattggtgcagcagcagctcattggattcgcgaaaaagcggatgggctggcgaattggtgttgctcaaagtacgcgctcgaattgcgtccaacgcattgctaaatgacatacgtctctgaagtattattattatttttttaatttttccttaaaaattaaatttttaatccttttaaatgctcatcacggtgtccttgaaaatatgtcttactttttcaagctacatgggcccttgaaatctcatacaattgttttcgttgttagcataaattgtacaaagtgatgcattttgttccagttcagggaacaccagtgctttttgggtccagaaatctaggttccgtattctgtgaatttttaagaaactgaaatccaagcagaaatttttttgggggcatccaattaccccctcatgttatacgcttctaaagtaagggaaaaagtttcggggaatccggcatggcattgttcggagaatgcttctaaattacttgctgagttagtgggtcatgttgttgttgtaaattttccgcctttgtctggttcttgaaactgtcttttttctccaacttgtgtaacttttttgcagctgctttacctcttccaacatatttgcgcagataaattggtttagttagcactaaaaaatgcttctcaaaaaaca

SEQ ID NO: 25448 - DNA, 2681 bp, Heterodera glycines
ttttgctcatcttaaagatctcttgtcccaaactctctataaaccaataaattgcgcctaacaattctttatttcaactttggaaaatatttattaaataatataacttcaaccattatgatttttacataatttgttgaatatttgtataatttttaatatttcaatctcgaaaccaatgatttataatattataatattaattacattatattccattaaatatttctcttacaaaaagttttactcttatataatttttcttttcaaagttttttcttggcactgcatccaatcatatatatatatatccatgctttgtaatgaaataaaattattataatatttaaaagttttttgttgggtcaaatttaactcctcgccaaaaactgagaatgtcgaaaatctccatccgccttgtgatttaatttggacccaaacaaaataaaatactgaatcatgtattatacgtccttttatattgtatattattaatttggtttttttttcttttcaaaaggtctaaaatgcatgatagtattttaattttttttataattatcttggtttttcttatttttaaataatattatttgaagccaaaaatgcatgcacacaaatatttttttgacaagcttttgggtgcatatgcaaaaccattttttacaatttttaaatcattgacaagaaatatcagccttttgtgcgtataattaattaatatttaaagcgttttcacacagcaaaaattacattaaatgacagttttaaaaagtaaacatttagtttggctcaatacgattatattattttatttcgctttatttataaaacaattacaatattaagttggtaataatattttcatttgataaaactaaagtaatttgaaatctgaaatttttacattgtccttttgttcgatattgtttttaagtgttcataattacttataattgcgttatttgtaaagaaattgtaaataataatttttattaatattatttttcgatattcctattttaagaataattgcttatattaggattatttagcaattttataaacatttatttaaatattattacatacatcttatgttatgaattaaaataaaattttaaaaatattttaaataaatttatgatatatttttctttttaaaaccttcatttaatattttttgtaatttgtgctgtgtaaaaacgcttacaattcttgttttcctgccgtttctctggcacattgtcaactagcattttcgacgcttttttggtttaccggccgattcaccgcgttcacattcctccaatttttaggtgcttcgatttctttcgcctccacaattgttgcctgaaatttatcaggtcttccacgaccccatcgtaagtaatattcgttccgtctgctgaaagcttcgccaaaatactttgacgaaatgccgaatcgctgtacgacttcaatgccgttaacagcatcaaacagttgaattgttctttattcaattccctgaatttaaaatcggcgagcaattttcggtgcctgttgatgaaactcctaaagaattttatacagaaataactaaattattgtcaattggtttaatctaatattaattattttattagtacaaataattaattaattagttaaaattattacaatttttttttcatttgcaaatgtaaatattattttagctttttcatttgctggaacgaaaaatttaaattttagactttttcactaggtcatggataaatcgcataagcaggtcgtgtaaatacaaaagtagttctttgcaaatgaaaagatttatttgatttttcaattatgtaattttggacataatctgtttaatatttatcaaaccaattaaacattttatttcttatctcatgagtatatttttattttctttccgattcattaattttttattgtacattaaatgtaagtaattctttatattctgttctatctttttgaaataaattaaaagttttaaaatttcctttctaaaattaaattttatttaacttattaattttaataatttttttaagttgtaggtgcgattagttttagaaaaatttacgtccaaacatttgtataacagattgatacagaaaagtttagtttttttgtcagcttcatttaatattttaaaagtactaatattaattattttattagtaaaataattcatctatttattaaaaattactaaaaaatattctttttttgattttgcaaaatataaatatattttggtttttttttgttgctattttaatagtttcaaaagtgcaaggaccaggatttcaaggaacaataatagaaaaattttctaatttcaatatttttgtctgaaaattagtaaaattttgctattcttcagggtctaattatgcatttagatttcttaaatttaatatcaatattcaattttttatttatttaagttttaaaattctcttgcctggaattcaaaagattgttcttttaatactagttgttgtcggtaatctagcacatattctttatgatctctagaaaattacaattatttaaatgtttattataaatttatatgaattaataaaaaccggattgttgaaactttttagaaaattttgatgattctttttttaatcatttcatttattttatttagatat

SEQ ID NO: 25449 - DNA, 1111 bp, Heterodera glycines
tttttcaattttttttaccaccctccaaaaaatccaattcgcaatataaagtgcatattcgtgttcagcacctcaaattaccctagaaaagtattttttggcaattttaagagcaaaaaaatttctcatgaaatgcaaatccatggggtcccccctttggttttgcatttaaaaattcatttttgttttataactttttttatattaaagataaaaagaccaaataaagcacataagacagagcttaaaattctctacaaaaatggtctgagaagattttttgctaagatcaacgcctgacgagttataagcctcaaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcgcgaaattcgaaaaatgccaaaaatggttttcaaattttgccaaagtgtacaggctaggcttttgcagctaggcatgccaaataagcgccaaattatcaattaatgatgaatgaatgaaagaggaagggaggggaagagaggaggggaaaagagtggtgagaaagtgaagagaagagaagggaatgagaagaaagcaaattaatgatgaatgaatgaaagaggaggagaagggaggaggggaaaagagtggagagaaagggaagagaggaagggaatgagaagaaagcaaaaactgtgatggctgaaacgataattgaatcgccataggtgtttgataattgttacaattagggtagcacgagaccgagaccggtaccaaaaaaaccggtaattaccgattagtaccggttaccggtatcggttgaaaacctaagtaccggtaccggtctcgggttttccagtaccggctagtatcggtaccggttttcgtcaa

SEQ ID NO: 25450 - DNA, 1583 bp, Heterodera glycines
  misc_feature (23)..(23): n is a, c, g, or t
  misc_feature (77)..(77): n is a, c, g, or t
  misc_feature (89)..(89): n is a, c, g, or t
attataaggcaatttccatgtgngcatattgctctcgaccaaatcatttgaaatgtgatttttcaagttaaaagacntaaataatgatntaaaaatttatggtaataaaaaaacacccccgccccctcgccctgccgggggtgcaattccaacgccttaattttcgaaattgtattccgatttaaagttattttttaaaattaaattattgaaacgcaattcaaatgttgaatttataaaacagaaatttctagaattcaaaataatatttgtaaaaagataagtgaaattggtaagattaatttaaactttattaaaatagctatagctaaaataaacaatttgatgctataagcaagattagtcaaatgcaattttgaatgttcaaatttaatatactatcaaagggaatttctgatcctaccgtatcatttttattgttatatttttacctatggatttcaaaaccatttctgtaagcaaatataaatgccttcaaataattgccaataatttgctcattttgttcaatttgtacacacacaaacggattgccaatgagaaaagcaattccaaaaaactgaattttttcttgcaaaattgaattttggtgttgctcaaactcatggagcttcaatctatggtcaacagacacaatgttttgtagtgttttcacaaaacacagttcttcaccaaggagaaaaggcaagtttttttgcttcactaaaatttaaaatttaacaaaactcgcttaattttttgaaattcaatttgttcatttattcttttttgatactgaatatattgcagttgaattatgtaaaaattatccttatcttttttattttatttggattttcattcattaaatcttaagtaaaattatttaaaacttttgttggcgaaactccatgagtaaaaccttatttaaattaacaaattgggctttcaatttacaaaattttattgtatttggctttttaagaataatagtaggacacttcatttattaattaattaattagttttaattcttgtcatcgtatttagccgagtcggtgttttggtcgagagtctcgaacaatatttgtccaaaagtttcaatgggccaatcattgtaaagttccgaattgctttttccatgagtcattgtggtgataatccataatcagttgccgtaaaatggctataagctcatttaaagaagccattttctcctccgatggcatttcttttgcaaattatacaaaagcaattctaatcgttcataattttcagtgtcaccaattttttaatgatttttttcaaaattttatactcattcagttgtgtaatgtttgtgattaaatttttctaatcatttttgaccatatcaacttttgtacataatgaatgcatcagcaaatcctaacacgcctaaaaaggaaaaaagttatgatttaattaataaacattaattaggcaatcaattaattttacttttgcatttgttttcatcaattttaattgctctagcataattccacaacggttcattgaataagtgcaactctaattgtttgcatctgaaaatagttaagtat

SEQ ID NO: 25451 - DNA, 1612 bp, Heterodera glycines
gcattaaaaacggttcaacatttaaccagttaggcatcatataatacaaacaataacaaaaaatcacacaatggctttatgccttcaaattcacaattcatttttggcactaagcccttggcacatagtcattttaagcacacagcgttacctgccattttcgcttgacactagaagcacacagcttcgactagtccatggcttacgctcatttcacccattaattatctcttttctgggagcacacagcttcgaccagtctcgtggcacacagccacaacggcactcagcccagctaggagcacacagctgcgactagcttttatcttttcatgctcaaaaccgttgcacttatcctttcgaaaacagccaaaatcacgaaaattaacatattatcacattaaaacacaccgcattgatcaatcaatgaccacaaaatatgccataaggtttttgtattaccgtactcagccatattagccacagaaaatttgccaaatttcttttgcaagacaatgcatttttgttggctcatttacgttttactgaaaaatagcaatttcccattgctttagtcctttttttttgttgccaaaacgtactttaatttactcttcctatctccaacaaggaattaaaatttaaccagattaaaactgcttttgggtctgcgtccctttttaagtctgcattgttcaaattagcctttaatggcctcagacactttttgtctggaatgctctggaattttaattctctctctctctgtttaacaaaaaaattttacacaacgggtcgtggcaccaaaaaggtgttgtgtccccgggtttaaggcttcaagccatttcaaattactacttttaggagagaggaatttattataaggaaaagcattgacaaataattatgaattgaaaaccgggaatatgtttgggtcaacaacaacctcagagcattttgggtgggtcagtgcaattggttatttgggaaaggattgccaaaggcaaggaacggcacagactgacccaccgcagacatctcgcagcccccaagggggaaattgggaggacttatatactgacacaatggggatggactttggataggatgaggggtatgacggcaaaacacaaaagggaataagagaaatggatggcatatgcaacagaggtgaataggaagaaatggcaagataacattggaaatgagagggataggattggcttgggataggatgaacagatggataagtttacgacgggattggtcgggagaaagtagggcaatgtacattatgcacaaaatatgaaattttgaatgctgcggatacagcatttctctcctcctcgaaaaaaagcctcctggcttttgcctcatcacttctgatcacgtccatcgttctgatcagccttcgggcgcccattgatggtcaaacattgatgaacatgatcattcgctgtcgatcagttgaacatctgacaacgctcccatttgcttcattcaatcatgtcattttctcttgacacccatatctcgggttatttcactttaatggcaaatttcgcttttcctttctttataacagtctccggttttaatttcatattcattt

SEQ ID NO: 25452 - DNA, 1918 bp, Heterodera glycines
tttttacaaggcgaatcgtgaccatttttcagcattggctgcttacccgaattccgggaaattgttcttagaatacatcaatcgactttgtgcatagtagtgatacagacattttataagaaagaaaatattttaaaagtatatttttcaatttatttaggataattgctcgcataaattattgattttcatatttataagggaaaattcgttctttcctatagtatgcaattaaatgataaaagcctaacacaggcttgagtgtagcgatacaaaactgcgtgcaatggcttaggctaggcctaaactttaggcttgcatgggcctagatcttggcttattttattttgtaaaatttttattgtgtaacttagtgtccatctgccgaactgtcccatcagctaagtgtctggcagctaaatggtcctcagctgactagtcccgaagccgttggatcaaattcttagtactttattcaacaatttagcatcatcggcgcctctaaaaaaccacagaatgaagcgaaaacttcacatattctggcagccattgcttattagcacaaaaatccaccaaatcgatggcataagaattgagacaaaaattgttgctacaagaataaatattattgaaaattgttttcttcatgaataaaaattgctttatttataacacttgttaattctaataaagagatttttgttagagaaaataaatttttattggttgcgcaaaaatcgtaaattaataaataaaaattttcttcctgtagctttgttgcgctgagaaaagtaaaaataaccccttaggactgagcattattgaaatatttacaaatttgaaaattttctaaaaattgatccactaaacgttatattcttgtccaaaatttgtaattattaatttaattacagcaaataccagttccttataatttctcgaatagtgatcagaagcgcatcaaatacagggacagggtatcagctgagaacaatacttatttcaatgagtcacagagttttcttaaaaaatttttgagttttcctatgtttttataccacttttaattatgcctatttttaggcttttaaatttatattttatgcgctaaaacaaaattacattttatataaataatttttttccacaatttcttacaaaaagttaaaaaattttcgtttttaagggtgtattttttaaaaattaccaaaaaagtcgatccttaagggtgtatttttcgctttttttttgcatttttcttgtgaaatttgtcaaaaatggcaaaatatgcatttattctcgaaaccccaaaatatgcttttatatgcactaaaaaccttcactaaatcaaaaattttaacgtagaattgctatttttgagcgcctttcttcatagcatatgcgcagaaaaatatgcaaaatcatacacaacttcgaaccctaattattataaatccaacaaagaaatattttttttttgcaaaaaattaagatgccaacaaaacatttattacggataccaattgattattcacattcaaatatttgctatccttttttacgtcagtcaatgttatgacggaaaattgggaagctatgtgatgtcactaaacgattattataaagcttttttgtggcaaaaaatgattctagccatccattatcaatggaaatcaattaaataataaattaattcattttaaagaaaattatctttttattactaatgttttttttaatttttaaatattcatccaattataaaattgcaagaattttgagaaaatgattttaattatcttaatttttaaaatatttgcttttgccaatggccaaccatcaccagcagagcaacacataagttaataaaaaaatttaaattttaatacctaactaataaaataggaatatgattttt

SEQ ID NO: 25453 - DNA, 1321 bp, Heterodera glycines
tcttggacaaaaagggttatctcttttttctcatttttttaccgcaaaattgataccaacagttgccttctcttgtctggccctatcaaacaatcttacgatatttgaaacgcaaacaaaaaaaattcttgaccaaaaaatggttatctctttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggttatctcttttttctcatttttttaccgcaaaattggtaccaacagttgccttctcttgtctggccctatcaaacaatcttacgatatttgaaacgcaaacaaaaaaaattcttgaccaaaaatggttatctcttttttctcatttttttaccgcaaaattggtaccaacatttgccttctcttgtctggccctatcaaacaatcttacgatatttgaaacgcaacaaaaaaaattcttgaccaaaaatggttatctcttttttctcatttttttaccgcaaacttggtaccaacagttgccttctcttgtctggccctatcaaacaatcttacgatatttgaaacgcaaacaaaaaaaattcttgaccaaaaatggctatctcttttttatcatttttttaccgcaaacttggtaccaacagttgccttcttttgtctggccctatcaatcaatcttacgatatttgaaacgcaaacaaaaaaaattgcttgaccaaaaaatgtctatctcttttttgtcatttttttaccgcaaaattggtatcaacacttacaaaataagggcacacaaattgtttcgatatttaatagttattgacacgaacacttataaataataaacaatggaaatcgtctgaaataaatttgtttaacggtaaataaaataaatgtaatgttttaaagaatcattacgtttatgctttgcataattttcgaatgcttgaaataaatcgaaagcgacagagagagagagagaaagggggcaaaatagagaggggatgggtgagggaaagaaaa

SEQ ID NO: 25454 - DNA, 1061 bp, Heterodera glycines
gtcagaggcatcattccacaacaacgccaagggttcgcccttcggtatccgaattcgtcaataataaagccgtgccatctccatccgcacgagttaaagcgcaggccaaaagaaaaagagccaatcgaaacatccgccatagcacttcgaagaaacggagagaaaacgacggctcgacagcttttcgccgacgaacggagagaaaacgacagctcggcagcttttcgccgacgaacggagagaaaacgacggctcggcagctttttcgccggcaaacggagagaaaaacgacggctcggcagcttttttcgccggcaaacggagagataaatgacggcttttttgactcacgaaaagagagaaaaaatcaaagctcaactttcgcccgtttttcgaacggagaaaaaatgggttttcttcgagctggtagttggattttagtgcaattaaatgtttaaaggtttttaaagaaaaatcgattgggacgcatcaaaaatttttattgggacgcataaaagtcgaataggacgcataaaaatttgattggacgcataaaagtcgattggacgcataaaagtcgattggacgcataaaaatttgattggacgcataaaagtcgattggacgcataaaagtcgattggacattggacgcataaaaatttgattggacgcataaaagtcgattggacgcataaaagtcgattggacgcataaaaatttgattggacgcataaaagtcgattggacgcataaaagtcgattggacgcataaaagtcgattggacgcataaaaatttgattggacgcataaaagtcgattggacgcataaaaatttgattggacgcataaaagtcgattggacgcataaaagtcgattggacgcataaaaatttgattggacgcataaaagtcgattggacgcataaaagtcgattggacgcataaaaatttgattggacgcataaaagtcgattggacgcataaaagtcgattggacgcataaaaagctattggacgcataaaagtctattggacacataaaagtcgattggacgcat

SEQ ID NO: 25455 - DNA, 1057 bp, Heterodera glycines
aaaaaaaaggtcatcaaaaaaaatcggcggccgacccccttcacaaaaattttggccgacccacccccctttttaatgtatgatcttgttctaacctgctttggaaacaagacgcgcaccgatcaattctccaagcaaaactgtgagatttggcgcaagtgcattcattcggttcttcaaataatcgtgtaattgtgcgcgatattgtgccaattctacgatctggtcacacagctcgacaatgtgtatcaaatccagctcggaaatgtccgttcccatgctgatttcggcctcctgtcgcactttttcggccaattcttcgggcaaaatggcgcttaaatcggcgttttgcgcattcgctttcattccaattgctttcacgcactgaagaaacaatgtttaatgaacttaattttaaacaatgtattaattccccattaccttcgcatacgcttgagcatccgcaattagctttcccagctccggaaaatgccacccataccattcacgacaacgcatcacataattgttcaattctttgtccaaatcatccaaaagagaaacagccttaaaaaagaaattataaaaccacaaagtgcgccgcctctcttcacctggacgatcatcgtgtcaattttctcggggttaaatttcactttgtaacggccgatggaatgggcgacacccaatcgcatcgcattcatttcatgtgctgtttcttcgcccaagaaactgctgacatttgcacggattgagcgcatcaattcggaaactgcgctattgtgtaagcatttgatatccaacgaattctaaagggaaagcacattttaatgaccacgggtttgtgtcatttaaatgttaaaaacattgccataccttaatgattttgccaatttgtgtgtcgtccaccgccaatttctcagtttgatcgatgatgctttttttcaggaagcgtttcaatgttttgtccaactttccttcatttaaggccgttgcatttgacacagcttcagcgacaggtttgtactttttgaaggaaaccaattgaagcctttaa

SEQ ID NO: 25456 - DNA, 1632 bp, Heterodera glycines
tcatagcttaattctgataaattaaattttttttcaaaattggggtggatgcttaactactccaaaacagtcctcaaaacgcaaaatttggtcattttttgaaaaatctgttaagcgattaaagtttttctcacccccacccattcctcaaaagttttttttttttttgaaaaaatgcggcgcaaaaagtgtcgtgaaaagaataaaaaaatttcataatggtcgacatgctaattacttcaccaataatgttaatgaattggccgatgaattgggacgggccaatgatcagaaaattcagcagaaggcacaggatgaaaggatttgagaagagcattttgccagtgtgcagcaacagttgctgttaatgaccgttaattaattaattaattatcaaccgggcacagcgcctaatctgtttggcgtgtcacagctatagccctaggaattggacggaaaacaattgccgtgagttatatttggttcctcaccatgccataaacgcaaaaatttaatcattaaggataagaggaaaattaattttaaaaaagtttggcaaaaaataaattaatttaaattgactggaaaactatatggttataaaaagtggtttcgatcacttattactcaaactcatagctaaattttggtacattaaaaagaaaataaaaatattttttaaatcattaaaaaatgaatgagtcaagcatattgtatttataatttataatttatttattttaacttaaaattttaatatgaatattaagtattttgaccaattttaagtaatcaattttttaaagaatttgttttttaatctttaacaatattccatactgtactttagctggctggccattttcctgtgacttgtcgctaattaattaattaattaaaggtaaacatatccaagggatctgcccttcacttttctctaacattttcagaacaaatttgtaatctttttttttctccggaggtcatttggtctttatatcccactcattaatgagtcattcattaatggtcgaccgttgtacaaattcgacatggccactttcaatgtggcccatctcatcactttaattggcgttggggtacaaaaatttaaattaaattttattcctattttttataatatttgattttgttttagtcaattgctcataggttgttgctgatgagcaacaaaatcaaaacaaaactcaaattggaaaagcaaaatgaaaatggtaagaatttttatttaaaatataatttatttttaattaaaaataattttattgtatatttaaattaatattttattttgggaatgcgagagattcaaaatgcgatggccgagaaaatatcgggaactgaggccaaattgtaaaaacaaattgaaaaaggtaaaaaatagctagctacccaatttaaattttatttttgattatttgttttttttaaatattttaaaaaattgttttagtattcactgaattgcacgacaaccaaaatggactgtcaaccaaattggaaaatggtggaaaatgaatatttttttaaaatttaatatttttatttttaatcatctgcaggaattcaaaacaaccaaaaggcattgtctctgatgaagaatatggcaac

SEQ ID NO: 25457 - DNA, 960 bp, Heterodera glycines
ggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttcgtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtccccttaatcttcactctga

SEQ ID NO: 25458 - DNA, 938 bp, Heterodera glycines
tttttaattgatagaatttaatgtatttttttaattaaatttgttaaaaaatattttcgttttaatttaatgaatttactaatcactgttgtacctcttctaatcactgttgtaccaatttacatttaaagatttgttgtaaattaataataaaagaatttatgtaaaaaataataattatcttttaataaagaatttcatattttttttaattgaatttataaaaattaatttcatattaatttaaatattcaattcttgtacatttcaaaattatctttttaattaataaaaggaataattaatttattttttaaaatttataataaattgcattcaatttttgtacctcttctaatcatttttgtaccacattcaatcacttttataccccttctaatcactgtttcacctcttctaatcactgttgcacctcttctaatcactgttgcacctcttctaatcactgttgcacctcttctaatcactgttgcacctcttctaatcactgttgcacctcttctaatcactgttgcacctcttctaatcactgttgcacctcttcgcatcacttttgtacctcaaaatttaaataacgggcgctaagcgcccgtccaaggccgcgaagcggcctaacaagctaaaaaacgggcgcgaagcgcccgtatgagttcaacgaatttaaaaaatgggcgcgaagcgcccgttcaaggtcaacaaaaattgaagaacgggcgcgaagcgcccgtccaaggccaacaaaaattgaaaaaccggcgaagcgcccgactgaggctacaaagcggcctaacaagctaaaaaacaggcgcgaagcgcccgtatgagttcaacggatttaaaaaatgggcgcgtagcgcccgttcaaggtcaacaaaaattgaagaacgggcgcgaagcgcccgtctgaggccgcgaag

SEQ ID NO: 25459 - DNA, 1352 bp, Heterodera glycines
  misc_feature (1316)..(1316): n is a, c, g, or t
aacaagtagagctcgacctggacctggatccaggcctggatttttcctggatccaggtccaggccatttttcggcaacctggatttttcctggacctggatttttgtccaggaaatccaggtccaggtcaaatgtgaaaaaaaaatccaggtccaggtccaggcaaaacaggaaaaaccctggattttcctggacaaaattttaaaatttattatttcaagtgaccgatgttttttcaagttttcaaaaacagattaaatacattttaaaacacattattatcattaattagatatttttagatgtttctaagcaaataattaaatttttcaaacatttttttgatttttaaaatgactttcaaaaaatcgagctctaaaaacagtattacccaaaatgacttaatacaatttgccaatttctgctcactttaaaaacatcaaggtccgtgaaccgcgtgtacacttcgtcctggtgtttgttcaacttgcaatgaataaatagggataggaaaacgctaatttttaaagaaaaccatacgtaaaattaaacatttgcacttaatttaaaccgttaatttatcgtcattatttgaatttgtcactatcaatgagttatttgatccttaacccaaaatggttcacacaccatctcaaaaaatgataatgaactaacaattcgctgcgttttgttttttgtgtttaaataataataataataaacaggaagtaattcgaaaggtttttcaataaaccaactcatatttaaattttattttttgatagaaattcatttttgggatggtgcgccgaagtaccaaaaacaggcactaaaggaagaaatgaaaaaggcaaagccatatgcacaaagataatagtatcgcctgagtcgaatgagcctttttcttttctcagcacattctcttttgaccctttcatgttcctcaaccagttttttaagttgttctttgttagcttcgcgtgagcgctgcaaaaatgccttagaataagaaaataaggcattttatcttatacattcattcaatttggcctccaaattaaaaaagctgtgctcacaaaggaaggtccccaggtgtccgtgggatttccgaatgaaatttggtgggtggatagagcacccacaggttcttaagaaaagtgattttattttttgcggaatgaactcgagtgccgagttatgacgtgccaaagtttttggttttttctaattaaagaaaagaaataattacttcactacgcaacgagcatctattggtgtagcggtagtgcgttagtcaaatttattttgtgtctcanggttcgacgtctctttgctatgctaataccatttta

SEQ ID NO: 25460 - DNA, 1279 bp, Heterodera glycines
  misc_feature (80)..(80): n is a, c, g, or t
atcaatagaaagcgttctgagaatgaatttccacacaattggccaaatggacgccgcaacgctccttcagccaatcaatntggaagtaatcagcaattaaaaggaaagtgagcacattttgagctagaaaataaaatcacacaaaattgtttaaatttttctttaattttaaaataacaaacaagtatagaattattaattttaatagcccaatggctcataaatactcaattttaaaatggtaaaattttatgtttgtatataggtattttgctgattttagatgaataatattagagtccggaattttaaagtacccgacccggaaccgcgcttagacaattgaccgggccgggcggcccgcccgtttaaacaagcgtccagggctcggttccaaattttgtccgggcgctgactttttcaaaatttgtggaagttgattaataaaataataataataaaaaaaattttaccttgaggattggttaagtcatccaacgactttatttttgcttttcaaagccaattttttaagagaataagtatttttaggaaccggtaggaaaatttttttagtttttagcttttaatccattggcgccgacgggaaaaattgaaaaaatctaaacgtgaaagggtacaatttccaaaaattccttaagttcggtcttcaaactttgaactaaagacgtttcgcaaaagaattattaaagtattcaaatttggggcagtttcactggtggaaattaagcccgttttaagccgttcaaaatgaccaggccctggcttagccaattgaccgggtcgccccgccaaaaaaagcccattttagcgggcggcccggttgtttgtcgaagacgggaccgggcagcccggtaaaacgggcttgaataattattatataaaacaatttgtttacgatttggaaaaaacggttgacccaaggacgaaattgagatggcatcagcaaattcgctgaactgctccatcgtgatacccaatccgtccagcttgatcgcccgctcatgcttctccttcatctctacgctgagcattcgtttgatcattggcgaaattgacataaaccaatgagcagaaatgttcatctgacgttcgccaatgtgcacagtcaaatcgtcgtccggcgaacaaattggcgggcatggactgataaatgggggaggcgatgacaacagaaatcaaggacgtacccagcccccttctgccccaccaagcaagaaacgaaattttttgggcgctggttttaaagcaagcaaaa

SEQ ID NO: 25461 - DNA, 1228 bp, Heterodera glycines
  misc_feature (1220)..(1220): n is a, c, g, or t
ttctggccttttcagtctcgagtttaggtttcggacctgaaatttaaacagctttgtttaaaatctcggccttttttcctctctacatagaataactcttgacttttcccaatttccatttcaatcattgctttatttaaagcatgtctttttcccaaagtgcaattaactaatgaagcaattaattaattaattaattgtccgtccccacccagtggtgtttgttgttgttgctacatgttgttattgtggttgtggttgtgctgttgttgctcaccaattcgttgccattgttctgttcgcttttgctgtgcctttgttttctggcggccattgacgacggacttttggcattggcactttgtgcgcagtcgcgaaaagtcattttgcagctcaaattcatctgcaatttttgcaaatcaatttttaattttattaactttttactgctttttaatattaaatttttattaagattaaaaatcgttttataatccataagataaatgatcattagttaatttgctcgtttaaatgcttaattggcggattgtttgccttggccagcagtgggaagcatgccgtgtgtgccacaatgtgacagccgctgcagcggcgcttctcccccatcttctggcagtccttctcgcccaaataacattcggtgtccacggcggacgaagaagcggatgaagcggaggagggcagccaaatgtgctcagagggactcaactaaactgggccgaaatggcagggcgctaattggccaattagggaaagggccaaaacaattaattattgtgtaaacaattaacaaaaaatatatttgttaattaatgtagaataaaagcgaaggagcataataattcccaattgttaatgattaaggaataattaacaaaattggcgaaaaactttgcttatttaattgattataagtgtatttttgatttaaaaaaagttgttatatttatttttaatcaaattgcattatttaaattaaacatccaaaatccgtcccacctgttcatccagccaatatctgctcgtcctgtgcttgctgacccgcttctgctcctgctcctgaatggcggcggctcgcttcaccacgggcgatttggctaatgctcttctgaacacaaaaaaagaaaaatcatttttttatttgattttaataaaattaaatttgttcgatgagaattgagaaacaaaatgggatnaaagaagt

SEQ ID NO: 25462 - DNA, 1498 bp, Heterodera glycines
  misc_feature (1479)..(1479): n is a, c, g, or t
ccactgttttttgttgttatgtgttgtttttgaactccccctggaattgtttttgctttttgacatttcaacatttacttatataggtagaagcaatatttccctgggctatcaaatttagcttatcttttgaataaaaaaaagttggatgatgattgttaaaggagaagacaagcattatcactaaaataaccccatgaatatgaacctaaaattgtcataacagcgtctcacactttatttgcatattgaaaatgatcaataataaaagcgcaaaaaacataatttggggatttaataacattcgatgttaatttgagaaaatacacttttactcagccatcagcaattggagtgttgttcatcgaccggatcgcactatgaatcctaaaaaataatgtttgaacaactaaattagtgacccattcgctgttattttcaattaaattgtcggcgctagtgaaaaagtcaacacttttgaattccatcaaaatgtaaaaacaaaaggggggacccttttggtttgcaaaatttttgaatattcaattgggtttttgggtccatgacctcgaattagatgtcagattcgtgatcactgatcagcaacctctaaaaccccggataatacaattttcatgggttttattacaaaaaaaatttcctaaacaaaagggtcccccccccctttattttttgataaaattcaaatgtggtgactttttcactagcgccaaattgtctattttttaaccaaccactaaaagttatatttgacgttatacagcgtccaattcgcgtattgcaccttggatacaatttcataaagtaaaggttataaatttctgattacgtagaacataataatcccatgggttgcgttgcgtgttttgcctctcagttgccacaccaaatcctccatccttttcataaatcggtcaattaaagacacaaaaaatgcttacaaaacatgcccctggccactaaaacgatccccatttggatcatttggattagggagttcgacaggcattagcagatagccacggtgttttccagcatacagctgaaatacgattttacaaaggtaagaattacacaaaatgactgaaataacaaaccttacgaacactctgtttatactccttctccattgtttggacgaactgagaaagactcatcggcccgttgaccaaaaatggttcaagcggcgtatcatacagcgaatttccagcagacgaagcaacgctattatccattaaaatcgtttttggagtttgctcgaaaatttaaaaaaaatgtttcgaagaaaagagccccaaaaaacggttgaaaattttcatttgagatgtccagggaacggatttatatgttttttttgcgcatatgctatcgtatgaaaagctcaaaaattttggagtgttggtcgtttttggcacatatttggcgattttttgagaaagtttgtaaattttttcaaanagttcctttttggcaatca

SEQ ID NO: 25463 - DNA, 1078 bp, Heterodera glycines
cagggtttaatccaaaattcatgccaaggaatcgaataataaaacttgggcccaggtttttttttcaaaattgcgagacctcctcctaaattcacccaaattttggatgcattttcgagtttgtgccaacaaatctcagagcacagtttctggcaacaaattcaaaatgtttgtaacggtaaaaactcataattttgtgccacaattttgagtgtttaaaatgtttttgattcctttgtttttgtgcatatctctcatccaaaaacaaaccttgatcaatgccttgcagcgtttggccaatttttcgtctttgattttcttgcggaattcattcaaaacagcgccaatgcgagttttctgaaaagcgcaaaaattggaaatgagattttgtggaaaattgctagagtaaatgtgaaaaggaggtatttttccattttgatgacataccccaatttaaaaaagcacaacaaacccattcaatatgtgtaagtaaatcaaaatagcagaaggatgagaaaactttatctcatttgaacccaacccaatttttttatgcgtacaaaataagtctatgcatactgaacggtttctgtgctctttttaaatggggtgtgtcatcaaaacggaaaagtacctgaaaaggttggaatatatatgtctagtttttacgagcatcaaaccctggggcattgaatcgaaacaaaaccagcaaaggttttaaaccatttttgcattggcaagatttctcagaaatatgtccggaataaaatatttgtcggtttttacactgagcaggtcgatgttcacccgcatgttctccaaggcagtgaccaattcaacggcgtcgtccatctgaaaacaaaggcccgaaaaatgtaattgccaaaagtcaaaggaaaacactgaccgatttcgatccatcggtcattttggtcaatttgcgtgagatttccacgatgtcttcctcatgcacattcattgtggacaaatggaaggcacaaaaatgtaggaaaatttgattaatagggatgaacttttaaaaggtagattataacatgtattttacgagtcagctttt

SEQ ID NO: 25464 - DNA, 1465 bp, Heterodera glycines
taaaatttgatccattttatgcgaaattatgaatacttttctgtcaaaaattttccatttgatggttttgactaacgtcccagcacctttatgagtccaatggaccttaataactggattcaaacccaggtttttaaaaaaaaattgattttttttataaataaaaaaaataaatttttaaacaaaatataaaaaaacctataataaattttaaaaaaaatctaaagttaaaaattagaaaacgtatagccgattcttctggaacgttttaaagaccattaataaggaactaattaattaattaagaaaataatttaaacttaaataaaaatttttttattaaccaacgaactaaaacaaaaaataaaaagattccgaaccacgggtccgaacttgaacaaaaattcgaaagtcaaaattttagaatttaacattttttgttcaaaagaggcggaactgatcgcttattaaaggattgatggctttcagcttgtttcagtgtatttaaaccgattttgaaccaaaaagtttaatcgaaaatttggattttcgaattgttattccaattcaggagatgcacaaccaaaagttagccccgactgcaaactttcagcgctctagctattcccgttctaaattttttgaatcattgggaaattgggattttttgtaatttaaatagaaatcgatttgtacctaatgaataatttccttagaattgtcgaaacaataaaaggggtcgcaataatcttgcttatattgtatttttttttatgttttttttaaaaatttatttccataaatttataactgtatcattaaacttcgaagacaaccttttttttacatattttggagtttttatacatattaaaatataaccctttaaaataaaggagcgcgtccgtgcgcggtggtgcgtgctggcattgggacactggggtttccaaattggggagggatagaacggtgccatgtaatcccgacacttggtaatttcgacactgagtattttcgacactgagtaatttcgacactacaatttcgacactgagtaatttcgacactaaagagttttttgaaaaaaattcatgccaaaatttgaagattggtcaaaaacgaaatataaataaactgcagatatttgtacatataattttctcattatataactggggacaagaattcacaacagtttttaaagtttgatatactttcgttaagcagtttgagcggaaagtccaatcatttccttaacaaaaaattgatgatggaataggaaaaagtgcaatgcgatttcctaaatgagagcacacaccattatttaccaattctatactacccttattcaatgaaatttacaattaaatcacctatattcaatgcctcgatacgaccccggatccaggcatctgcgcgtcctcccatgttttatccattttgatcaaagatcgggtcgtcttct

SEQ ID NO: 25465 - DNA, 1723 bp, Heterodera glycines
atttcacgaattacaaacacctgctgctgtttgtttcaatttaaaccaattctttccccaaaagtacaaaagactgtcattaattagattatcaattttgaatgaaatgatttagaattttggaaaacaaaaaaattggattttgacctaaaattatattttagacctaaaaatgtgcgtcgatgatcttttttatatccaggccaagttggtcagatcactcactccttaatttatcattgtaatagacaccgacaaaacattctgaaattgggggaatatttaaactaaggcgcaaaaataaaaagtgaaattgaagttgcaaaagtttgaaatgcgaaagtttataaaaagacaaagtgaagcatgcattaataaaaaatttttaatattttaaatttttgatttactttttcatgcagattcatgttttgtgattttagagagactaatttggctgaatttaagtagggatgggattcttaggtttttaattattttttctgcggctttaactcgacgagaaatgcacgaaaacacaatttttgttcgaaaaactttcgttttaacgccccaggaatccctattttgagtgttcgcccctaaaataagttttatcccttttttggcgtttcgcccctatttcgcgatttttgggaaaattattaacaagaatgcaaaaaaatgaaaaatacacccttaaaaatcggcctaaaaattttcaaaaaaatacacccctaagaatcggcccaaaaaaattcggaaaaatacaccccctatgaatcgacctaaaaattttcaaaaaaatacacccctaagaatcggcccaaaaaaattcggaaaaatacaccccctatgaatcgacctaaaaattttcaaaaaaatacacccctaagaatcggcccaaaaaaattcggaaaaaaatgcaccccacccttaaatcccgaaaatttcgaaatgtacttcatttctaactacaatccgtgaataaaattatttgccttaattttaactaatttacatagagaaaatgtcaattttaataaatttcacccgtacatttgaaactttttcatcactatttttgcccctattttgcgaattttttgcccttatttaggccctaaattagaatttcccccccccccctaaaaatcccatccctaattataaggtttttaattgtttttagaaaaaccttaaaaataagatttttgatagtgtgataaagtgataggattaagtgaaagatgtgagtttaattacttaaattcatttaatttgtatttgatgaataaatatttttcgcagataatttacgtcgggtgctttttcttattttgaatttttaggggtttttctttcttttttttgccccaatttggaaaaattttcgagattttgttaagaaatatgcaaaaaaaaaaagaagaaaaaataataccatcttatccgatcagcaaactttgtgaagaaacggcacagaaaaagccaagaaatgaatgaatcatccattcacgtacacaaatgtgtaaattcattcataaaacaaacaaaaaatggagttgaaatgggaaagaatgaagaaagaaagcatttgtctccataaaagtgtttagccatgagatttaggcacacatttggcgaaaagtctttcactattaaatgccaaaatcagtcgaaaaaatgcaacaattattttattatttaaataatttttatt

SEQ ID NO: 25466 - DNA, 1704 bp, Heterodera glycines
  misc_feature (82)..(82): n is a, c, g, or t
caggcaaaaatgcaatggcaaattcagcatcatcatcatcatcggcacatttttgtgcttctcaagcaaacattgaggaganaatttgttgtcaatttgtacaacttgtcaatttgcctgaaaagtaaaaaataaaaaataattaacggttgctaattaatctctgattgactctaattgctttcttttttatgctcccattttgcgatggcttggcaaattttactacacaaaatgaatttcttgaaaatttgcagcaaattaatttctcaggtctgctgaaaaaatgcccccatttaaaatggaaaaaattgaaaaattggaaatttttaggcctcccaagccgaggttcagcaaatgcaaagccagcagtttctcaattttttcagcagcgatcgtacccaaaatttgggccccctcaaccgacaaatttaaaggcaataaaattgtctccgttttaataaattaaatttttattgttcagcattaaattaaattttaaaaacgaattttttataaattaattttttgaaattatttttagcttatttgatatttaaattgttttaaattttattaaattctcctgttaatttgaataaaatggttaattcattttttgtttagcattaaatgttgaaaaaataaataatttttaatttattttctaattgcaaataaaattttaaaaaaaatgtttttcgcaatttttaaggtttcctttgaggaggcccccgcggagcatatggtgtttctgtttggcatttttatgctcatttccatggtcatcatttgtacaatgtttttgatgaaaatgaccagggccagcggcggcgggtaattttcaacaaaaaaatttcgaaaattcttaaaaaattgaaattcttaccccctcccacccttcaaacttagtggcgccattgcgtcgacgagggcagctcttggcgcaattttgccatcaaattattccatggttctttggatgccaaaaacgggtcaaaactattttttgaatgttttgtccattaactttggcacaatgccaaattcagcggatgtcaaacggcactaccgtaccccaacaaatcaccacagacgtcattcacgcccttcactgatgctgctgttacgctcctccttctcatgcgcgaacaatgaaagtgcgttttgagaaattccaacatttgacagtatgccttaaaaattacagtacacggaaaagtaaaaaattaaattttttaaaattgtaacagcaaaatactgtacaggttaagaaatgcattaaccatttgttaaataaatcaaaaaaaatgcattaataatttgctaattaaatcaaattacagtactcggatggttactgtaacaatttattgaaatccccaaaatttagctgcacgacatcagcgagctcgttatgctgctcgagggcgaagtttcgtttctgtggtgtcatcgagcaggcaaatgaagaaacagaaacaatatttattaatatttttaattgcaaaaataaaatttgtttaattactaatccaaatttttgaacaaaaatttttttgaattaacaaaaaaatatagcatttgcatattaatttatataataattaatttcaaaattgtaaatattaattttttttttctgtcctcttttgtcagtatgcatccgttgctgccccattctttgaccattacgccgtccct

SEQ ID NO: 25467 - DNA, 1542 bp, Heterodera glycines
ttttgtctgtccataaataggcaccgaaaagccacccaaatcacacattttccattcaaatcacagctaatccttcctttcattcagtcatcaatcagttgaaccttccttgcacccttcatccatcccatcactctgctcttcatccaatcaaaaacggtaaattaaagaattagtataaaatgtaattttttaaaaattaatttaaaaaaagctagggttcgagccccgtgggcgggggtggcttttcgcgggggcgggggttggcgggggtcagagtcgcgggggcggtggcgggggcgggggtttgctttgaattagttccaaaaatctcacaaaaaaatattttttatgaataatttctttggctccacattcttttattcgttgatcgccttgataatatttattttgacataaattgcacagattttgactaaaaataatcaaatttagcgatttttgggtaattttttaagaaaaaaaggtttttttgggggggggggcggcgtgccgataggagcgaattttaaatttatttctaacagatattcaaatttgcaaaatatctactaaaatatgtaaataaaagtccaaacttttgtttgcaaacacaaaaaagaaagtgtttttcctactgattaggctatggagaagccaggaaaaatatgtatttacataaaattagcagccctaatcatgatttactcaaggaaaattggaactcagattttttaaaattttcttgcggtacatttttccaaaaaatttgctgaatgtgcgaggggagaggtccggcggtgccgacaggcgccgccggggaaattttttgaaaatttgaatgcaatttgttaacaaattttgtacaaaaaataagcaaatttttcgatctttggctaatttttaagaaaaaaagataggaattttgggggacggcggtgcctatagacagcaactattcaaataatctagatttatgttttatgattattatcccacatattaaatatcataaatttcttaaaaatttcagggtattaaaggttgaaacttcattttcaataacctaaataacattttcatggaatttacacaattttttaaatttttactttattcttcgtgtttcaaatatttgcctaaaatcccaaaagtgtatcaattaatgtcatttcattttcatggagagaatctcattaaagcacaaataaattaagatttttttcggaaaaataaatataggggacacgtttttaggaaatcagtaatatctgagcatttaatttgagcgaaaaaagaatttctcatcagagaatatgaataatacaaatggcatttcctgtgccaactaaaataaaaaatagtgcgtaatttaaaggttatgaaattggacataaatacataaaggcgtgggattttgtttaaaaattgtgaataaaatctgagttgaatggtcagaagataagaatgaatacaaaatggactacaaatatgccacaacagagacaaaaaagtgccaattgcttacgtaaatccccaaat

SEQ ID NO: 25468 - DNA, 1342 bp, Heterodera glycines
actttcgctcttatttcacgattttaaaattttcatgtaaaattcacaaattctttagcaaaaacggttggggtcgttttcgtacggcagggggtctttttcgtacgagatgttgtacaagcgacagatcgaattgaagaagcttcaaaattatacagacaaaatatttcattttaatttcatttataaaatttatatcgaaaattcattaacatatacgaaaacaaaacaacaaaattccatagcaaactaattgcatatcataaaatttgataaacattgacatgattatgatcatttggtgggacgaggttgttattgagagatcgttataactgtttacgagaagaatttgagcatcgccatcatgatacttccttttcttttggggttcgaattctcccaccacacaaactgccatgtcggcatcaatcgtcttctgctcacatctgatcgtgtcaatgaagcaccaaattgttggatgactgcaactaaatttccgccaaactttgtgacggaatgcaatgcctcagcgaagttgctggtccgatcaacatcatccaagtgagttgatgaacactccattcgttcgggtcaaaataaggcaccgtcaatgcaccatcatgctccaactccgcattgtttcgttttgttttaattacttgatgttggttcctttgtagttattaaaaacctaattttgtcaaaacattaaaaagcatatttaaagattagtaatatgtagggccgcgatttctagtgaaaaaatttttttttttgctcaattgttttgaagaaaggagctcaaaaaaattttttttttcatttggatgtcatttttcgtcactagaaatcagtattttgctgttttgtcacttaaaatagtgaaaattcacttttttggcgttttgtcactattttttcactatttcaacatttttggaaaattccttaacaaaaatgcaataaaatcaaaaaatacacccctaagaatccatttaaaaaaatttcaaaaaaatacacccctaagaatcgaccaaaattttttttaaaaatacaccactaagaattggaaaattttttcaaaaattcttcccccaaattttttttcttgacaaaatttttgatttaaaaaatgtcaatatttgttaagagaattttataaagaaaatgtagctcatttgcaactgcaatcagtgaataattattttttgctcaatttttggctaaaaattatgtcactattcgtcactatttcggacttttttcactattttgtcacttttttggcactttttcgacactattttagttaactatttcgggatttttagtcactaaa

SEQ ID NO: 25469 - DNA, 1323 bp, Heterodera glycines
ccccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaaccgcggtgaaaattttttgcagacaccaccacttttgcacttaaaaaaatttcaaaaaactttaaaaattcataggaaaattttaatttcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccatttggggtactcgaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgcccagaaaacaaaaaaaatcgattttttcaagtgtccgtttggggtactcaaacatttatggggagcaaaaatccaaggcagaattaaagtacaggctatagggaagctattcctaaaggattcggtctcccccataaatctgggcgcatcggttcg

SEQ ID NO: 25470 - DNA, 1208 bp, Heterodera glycines
tttaacggcgcgcgaaaaaaaaatttcaaaaattttcgcataattttttttttttttttgcagaaaatcatctcgcgcagtgccagggctggcctccaattcccggtgggacgcatccatcgcttcttgaagaagcgcacaacaagcaccggacgagtcggtatgttttggcgaattttcggggataaaatttgaaaaaaaaaattttttcaaaatttcccaggcgccaccgccgccgtgtacagcgcagcaattctggagtatctgacggccgaggtgttggagctggccggcaacgcgtccaaggacctcaaagtgaagcgggtgacaccgcgtcacttgcacttggcaattcgtggagatgaggaggtgagggggcggtgaaacaacaaaactttgctaactttaggattcccttgaatcctttttttggtctttcgaatttaaataattttgataatttccctgtgtcttctgaaggcatcatccgttatccgtcttaattttgctttttccgttcagttggattcgttggtcagtgcgacaattgcgggcggcggagtcattccgcacattcaccgttcgttgatgggaaaggtcggcgcaatgggcaaatagaacaattccacccccgtacggttgttttccttcagcctccgagtcaactcaatcacagtcagcagcagaatcattcgcagcagcagatgaccaacgttggcaatggcgacaactgattttggccaaatgaatatcgttctttcaataaaaaaaatattttgacgatttgtgcacttttaccaaaaccgataaatcttttgctcttcaattggcttttaccttttaggtactctttcggtttgtatccccctttggggtgatatttacgaggagtgttaggcagacagagggatattaccttctttattttataataggcttattcttttgagactattttttcgtcttttcacaagagaatttattaaaagaggaaagtttcgccttacgttaataaggtgaaagttagagaatgtttattaaaaaatttttggatgaaatattattataataaatcaaaaagaaagaagatatgatttatttttctagataaataaaaaacattgtcagaggcagtgcctgcctaaaaatagacaaaattttttcaaaaaagccaaataaattgaaaatttaaataaatttaaaagtgt

SEQ ID NO: 25471 - DNA, 995 bp, Heterodera glycines
  misc_feature (7)..(7): n is a, c, g, or t
  misc_feature (10)..(10): n is a, c, g, or t
actttcnaanggtgttatcaattcggtgagagaatgccgcgaattgctgttcagacgagcttgccgaagtgttcgccaagtcgtcgtcgtgtcgtcttttagatttgggcatttttgggattttttggaggagagaaaagggtttatcgattggtcaatttggtgaaaaagataaggggtgaaaatcggttccgctcgaattaaaattacactcttaaaatttcacatccgaatttcctttccaagatgttccaacaaaaaatcatttgaaacttcattaaattaatctattctctttctatcaacttttcttctcttaaccaaacaatcatatatttccaattcatctttattctattcaattgagccacacgtttggtcaaactgctttttcagggagcatttaacccttttattcaattttccgtctttttcgggagctttgaacccgtcatttctttgtgtatttgttgaagtggaaaattttgtttttgtcgcatcattatctaaaagggacaaataaggtaaatattcatcataggtcccagactcaaaattgcataaaattagagctgatttttatgttagttatggcgagagaagcccaaaaatagcattttctccgaacaattttttgatttagagcgacttataaaaacatattttggggttttggcacataaaaacatgtgcatatttcggggtttggcacatatttttcacatattttggcacttttgagaaaaatctgaaagaaaaatacaaaaaaaaaaatgaaaaatgcacccctaaaaatcaacttttttgtcattttttaaatattttcaaaaaaattttttttgtttgccgaaagtaaccaaatcgatttcttaattcctcattggatttcgatgttccctgatggaactttcaatttaaaaataatttacagaaaaagaccaattttagcttcgaacaccttgaaaggtattagatttgcgattgtgcgggcgaaa

SEQ ID NO: 25472 - DNA, 1025 bp, Heterodera glycines
tttttaaatttatactctatccagaaaaaatgctattctttttttttgagaaaattttatacctcacaaaagcgcttgcgtatgagacggagggctgtgcacattcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatgtctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctggtgcgatcgccattttatttcacagaggatttttatatttag

SEQ ID NO: 25473 - DNA, 1183 bp, Heterodera glycines
cgtgcgattgcatctttcggcgtccctcccggtacattttgatgattttctgccggtcgcacaacagcagcggccgtcccgaaatgtaagggcggccaaaacggttgcgggccgactcgccgacttaaattttaattaatttggaaatttaaaagataaaatgagccgaatgatgagaaacaaacataagcttattctttacttcggtccacaaattcattatttgaagccgaaagagtcgccgaagaaagcgaaggcgacgcaaaagcggaagaagaagaagacggaggagggaaaggcgagacggacgcattggcacctttgaaaacgaaaaaggcacttcaaaaaatgaatttaaaatttcaaactgcgcaaaaaagggacaatttgaagacaaaaagcaaaaacggaggggggggggggacactgaaaagaaaacttagtccaaccaacactaaggaatacggtataatgaattaggaaaaaatatgggatgacaaacagtagacatccttgttacggtacagtaccattggcacaaggaaatgttccgtggcagccggtcagcggtgggggtacggtaggtgttgtggactgaaaaagccactgactgttgccgaccagagggtactgtagcagatgagagtggaaagcagaagtggcaacaacggaagacgcagcggaagaggacagactagcagcagcggccgcgagagattgagaaaaagacggtaacagccaaaatggcaacggagggggcgcaaaagcggaagaaacggaagcggacgaagcggaagcggaataagctgaggaggacgaagcgggcggtggaactaagccaatcgaattggtagtggcgtttttcggcggctgttgctacaaaatgaggaaaagctgcttataattttgaaaatttaaataattcaaaagagataattcgttcattctttcctcactttttcctgttccgattgcttttgcttctgatccgtccccaatttcccctcattttccactgaccattcttcgctttgcctcttcgacccgtccagtgaatgctgatcaaaaatcgcaacaaattgcgcagttactgtcagccagcagagtttgtttggctaaaacgagcgatctgtttgcgctgtgtgcgtgacgctctttctcgtctcgcccgttttattgcctc

SEQ ID NO: 25474 - DNA, 1336 bp, Heterodera glycines
  misc_feature (1312)..(1312): n is a, c, g, or t
taatgatgcagaacacatacagaattgcccatattcgcactctatgacttaatgtgtgtctttgaaattttttattacaaaaatgtatacatattaatagtgtatttcataaaatttaggtccaaaacttttagaattttttgcgaattaaaaaaagaattggtaattacttattagataccttaaaaaaagttgagattacttgaaggttaattaaattaaagaacctaaattcaaagaaaaacattaggcacaaaaatgtggaaaataatgttgattccaatagttaaaacaaagatattttattcactattttgattttaatgattttttaaattgatatttaacaaatttaaagagcttgatgaagtatgttatcaactgaatcaatataatatttggaaatatgttgcttcaattatttgcaacattggtagcccattttgcttggtcttctttgtgcgcagtttcattcaaattttgaggatgaatattttggcgaaagaaaagctttacgaatttttctataattaaaaaacaaaattttaatgtagattaaaaaatgaaaattagaatggtaaaaaataaagtttatttattaaaaattatatttttaaatccaaaaaatttaattttcattgcttttaaactaattgtacacttaccagaagaacgttttaatcccgaaacaagttcgtaacggtaatatttgatggtgcaaattgaaacaattggatttatggcagagggtaaaaacattggaattgatgacaataaaatgtaatactgtaagaatttccattcctttatatcaatattgcaaattggaattaaaagcaaaaaaagaacggaaaaataaatgatgaggggcattgacgcctaaaaataaaaaatgaattaattaatattttaaaattaatttatttagctgtaaccaacctgaattataagatttagagaaacttgtttgttcatttcaatcatccttttggctatttcagaaaaagaaacgcttcaaaaaatataaaaataaaaataccctcaatttttaataaaaaaaaataattaccttttcgatttcatgactaaatggctattgatacgaaaagctaaaccaaaaattatgaggtatgcaaaagtggatattatcatcaagtagaagaatccaataaccgaacggatatcctaatttagaaaaaatattattaatggaaatttaattttaatacatttacattaaaagaatatccggccaaaacaattcgatcgtcgagattaattccgagaaattccgcaatatatttttcttccnatattgagtgttcaacgggcggaa

SEQ ID NO: 25475 - DNA, 1700 bp, Heterodera glycines
ttgccgtttgagccctggtgtagacattccaaaacgagatcgggaaacgtggaggacagacgatgtcttgttcccagcgtctaataagctgcaagctgctttcttcggacaatgggattgtcggagttgatggttgtggcgaatgcagtccgaattgtattggtccactgcctgctattgtggacgtctgtgatacactgaacgctaaatcatttaaaattatgttaattatcatgaaacagtacatatatgcgcttacgagttgtgctttgagtgcgacgtagaaagaagcgtccgacatcagcattgggttcaaatgcctccgctccatggtcaatctcaaattgagtggtgccaatgtaggttttgccaaaatacgccagccatccttgaactctaggcggtgccgcgctgacaatagttgaaaaagctcgccgaacgtaaagtggcggaatgagtgccaaagagagaactgatcttatttggaaaaacaaataaatacacatgagctaatgaaagacacctgaatgttttgtgaacagccttcctttgaaccggtgcttcgtcgtcatctccgtccaataaattaaaaatgcccatgcttctggcttttcggaacaccgcttgcgctgtaatgtgaactttaaaatatttaaaaaatttcaaaagttgcgcattttttgtgaattggccaaccacacatttttctacctaattgtcgtccattatgagtgaaaatgatccgtcgagaggccaaattaaccccacatccaatggtatcaccacgagaaaattcataacgttcttcgtttagccagacagacccactggtctcaaaagtgccattgcttttgtatccatagttgtcccaatgacatccgacacattcgtccaatggcatcgctttggaggcgattccaatggaaaaatggtatttctaataatggcacacaaattaaataatttaattgcaaaatgtaatttcctttttaagaaacattataccctaacatccttaagattttggtttcataataaaaaatgccggaagaacaggtcgggaatgggtgttttgcgaagacagatgagcatcctttttgacaaaataattaattaattaataaaaaattttgtacaaatttaaatatatatatatatatatattatacatatttagagaatttataaaaaaaattcttgtgaaaaataaaataaattactttggaaaatatatttctaaaaaataggtgaaaattttattcgcatattttatttacatattttgggtttttctaaatattacttacatatttctctctgttttaatatatatatttttactattttgcaaattttcttacataaaattcacatccctaattataaaagataattcaccttcttcctctgaccaccaactgacagtcaaacatttgtcatcaatgattctgagctgattgtcacaagcgttggcatcccaacaattttttggcggcgaatttgaaaaattcagtgaatttagaattttgtataaattccataattaaatattattttttacctcaacgaaattctgacgaaaattcggatgaacggctttcaatagatcttaattaacaattaatttggatgcttttattaatctcgtcttaaatattgcataaaaatacccaatttaggacattcctaaagaatggggg

SEQ ID NO: 25476 - DNA, 1128 bp, Heterodera glycines
cagaataattacgccgattctaattgttctgggattttgtttctcgggcgcgtttgttgggaaaaaatttggataattggctatctctttttctgctcaacagtaataggaatttcaaccgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgcttctcggcgcgtttgtttgggaaaaattggaaaattggctatctctttttctgctcaacagtaataggaattctaaccgcattctcaaaataattacgccgatactaattgttctggaatttgtttctcggcgcgtttgtttgggaaaaatttggaaaattggctatctccttttctgctcaacagtaaataagaattccaactgcattctc

SEQ ID NO: 25477 - DNA, 1712 bp, Heterodera glycines
ttaggacacttcctcaggccagaggccttcgggcgctctatgtctcgtgttttttcgaatgcaagcacactggtccccaggcaaggagttccgatccacgaactcatagggcttgtcaaccatggcaatacgccactcactcgtataccaacaccaccaccaactttaggttcagcatccccagtgctgagttccccacagcatttgtgccttaggccacatttacacaagtcaattaactcgccaaatttctttaacacacagacgagctgcatgttttattcatttcgacagctgccaatcgctggagaaactgaggccacggcaaaggtggcaccccagcagcagccatcaccgttcaaagccgagcacaagcgcaagcaagcacttgaacccagacggccgcgctccccacagcgaaatcgcatcttttttccagccacaatatcgcaaaaacggcccaaccaccacactcacccacgccaaccaaccaacgcaaagcacatacgactaggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtgggcgattggaataaatggacaaaaaagcaaagtcaaagacaaaaccttaaagcactagccgattgaaataaatggacaaaaaagcaaagtcaaagacaaaaccttaaagcactagccgattgaaataaatggacaaaaaagcaaagtcaaagacaaaactttaaagcactagccgattgaaataaatggaaaaaaagcaaagtcaaagacaaaactttaaagcactagccgattggaataaatggaaaaaaagcagtcaaagacaaaactttaaagcactagccgattgaaataaatggacaaaaaagcaaattcaaagacaaaactttaaagcactagccgattgaaataaatggacaaaaaagcaaattcaaagacaaaaccttaaagcactagtcgattggaataaatggaaaaaaagcaaagtcaaagacaaaaccttaaagcactagtcgattggaataaatggaaaaaaagcaaagtcaagaacttatcctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtacctcccgacaccggggagcaagaatattgctatcttgcctaggcgggattctgacttagaggcgttcagtcataatccctcagatggtagcttcgcaccattggtctaaagaacaagcacatgaaccaaactgtctgaacctgcggtcgaccgcaggcagcaagct

SEQ ID NO: 25478 - DNA, 423 bp, Heterodera glycines
aaaattaaagaatatgtgtacttcaccgaattcgacggataatatatcattcgacgccttccagtctgtaatgaacgaatccacaagaattttttggaacggaaaccattttgggccgagttatgggcccgggactgaagtggccaaatggctgtgggactgaaccgtacaaagccttaaaacgcaaaatgcaaaacaatattggtcagtcgattcctcttggtttataattgccaggaatccatttttgagggcgcacagcgcccgccttagcgagcatgcgaagacggagcaagtagtggggcgagacggagggcggatgaagcagtctgacgaacgacacaggcggttgactgctggggcccgaagggcccccgacaatcagataaccgcctgcggatcacgcgcggacttcttccgtag

SEQ ID NO: 25479 - DNA, 2953 bp, Heterodera glycines
tttcctcatttctacggatcgaaatataatttctcgagaccttgccagaattgaaatgattattatttatattatgtcataaagtttaaaagatggtatacgcgagtgctttacaacaatcatataaaaatagagtaaatcataaagcaatatattacgtttttataattttaaaattttttgagtgtctaatagttttttttcattttatttcaagtaatttgtctcattttttctttattaaattaataaataatatatatttaaatcggttaattaacgacttatgaattttattttttgggtttttattcatttattaactcattaaacattaaattaattatttttttgttagttgttttctcatattttgtattaattttaatcgggtttaaaattttattgtgataatttatagtgaaatatttttgaaataagtatttttacaaaaatatacttccgttcgtaaattttgaataaaattagaagcgacgctcaatttatatttattcaaatctattttatttttctgatcgataatacttatcaattgtacaattaaataatttgtttatctcggttatgatcaattcatgttaatatttttttcaattgtataattttggctaaataaatattcgaaaaatcattatatttagattttatcataaaataaatttttgtttattctcgttttaaatgtccatgtttgctagcaaagcgtgatgatttttgccggaatcaataaataaattaaaaaattgttatgtgaaaatttaatctatttttggtgttctggttttacctcaccagagagcacaaaagatttttcaattaaattccacattattcttccattaacccaaaaatatttttctgtttaacttaaataattaaattttttcattatttttttaaaatttatttatcattttattttagaacaggatttttgcttcttttataactgaatacataatactcgcacatttgaaattagagtaaaacgttctagaaatttgaatgtaaaatattaaaaaaataattgaaaattttcataattaatttttctttctcaaagaaaatttatgtttatttaatttttatatttttaatttctataatactatttattctactattattcttttttaaattaatttagttcattcttagtaccaactttcaattttatttataaaatgtaagtatcttcataatacatctttattgttaacattgctgtatattcaatatgattaactgtaattagtataaaataattttgataattttaattgttcttttctaaataaatcaattattttatttgtttcggttaaaagcctaggttcaattctctcgctcgggatatcataattttttctattttgatgagcagcatttttaaatttatttaattcgttatgttattttctattatttgttgccaaaaatatgaaaaattaatttcttttcaaattattcttcatcttcattttaagcattttttatttttattttgtaaattattcattgtttcgtttgtgaagctgtcttattttttaaaaacattttcttaattaatattctcaatttggtgggccattcaatctttttttacaattattatttattttttatattgtttatgttaaaattttaaaatatattcaattataaaatgtacccatctctcattattattaaaaattgctgtaaacataatttgtttaactgtaaatttcttataaatcaaaattttaaaaattatgtttttttgtcacatttatttttggttttttacttaatgattcattaagaaattattattatttttagaatttgttaattaaaaataattaaatttatagaaacattaaaataatatattaaaatcagttaaatttccaatctttttatttttattgatttatctgcaatataagcatttatgattataattttttaaaattttgctaattttgaataaaaatttaattattccattctataaccggaaaaatttaaaaaattatttgataatctgtagtttaagtcatatattttaattttatcatttttgtatttttttttggtttttcggttttatttattttataattgcattgaaatatgcttaaagttgatatatgttgtattcttttttttccactaacgacggctttcattgtcaatatttagttcataatgataattaatttatttaattaattgttttttattcacgtgttatctaattgcttccttttattattgaattcacacgttacatatatttttttcttaagctgtttacgcatttgggcaatttatagttaaattgttaatatttctatttatcatctttgagtttttttcaataaataaatttttctattcattcgattacaaatttttcttttatacatttgaattttcattttttgaaagtaattatttctttagttgagctatgactgaaagagacaaatctcatataaattttatgactttaataattcggtgtaaaaattataaaatgaaaaagcaaaacaaaataatagttaacaattttggtttttctatgttaactttcagttggaaagttttatttattgttattacaaatggtgtaattttaaaatatagaaaaatctttaaaaagtcataaactggcctgatctatatcataataattcccttttttcagaataatgagcaaatatttaaaattgataaatataaatcgaatttataaacataattttcattttaatgtataatttaatataaaaattacatatttattcatttattcaattatctgagtgagcggatttatccatttgctatgcgcacaaatcagatttaagttatttattctcgaaagtaaaataaattaatagatatatttaaaaaattaaaatttaacattaaaatttagaaa

SEQ ID NO: 25480 - DNA, 1134 bp, Heterodera glycines
aaaacggaaaatgccgaaaatggggtgccaatttttgcctttttttgaaccatggctttttaatgatgggcccgccaaataagcgccaagttttgcaaaccagtccaacttaaaaatcttccctccaaccattttccgctcccggcttctttccggcaaagttacagggcaccaaaagacgggcaaaaaaaatttcacgccgtttcagcgccgcgggcgctgaaccgtccaccggagcggaaaacccatatttttcccagatgcgcctcaaaaagttgtaagacccttccaccactttcagacccctcccgacagccgttcgactcaaattagtttttaagccgagtccccctttttctctatggtaatataaactagcgtgtggcgcagtaattgctcggtgtagacagtatgctttgcacagtatttgctcggtgtagacagtatacttttggtatatatgggcgggcgctgatatgagcgcttcgcgcaaaggacttcgttgctagtgcatgcgcgtttgataagtgatgagcaagtgcattcggccgctttgcggcctcagacgggccttgcgcccgttttttaattttgcgggggacattcggccgcttcgcggcctcaggacgggcgctttgcgcacgttgtttaattttgtggggaacatttggccgcttcgcggcctccggacgggcgcttcgcggcctcaggacgggcgcgtcgcgcccgttttttaattttgttgagaacattcggccgcttcgcggcctcaggacgggcgcttcgcgccaatgattaaaagaggtacaacagtgattacaagaggtacaacggtgattagaagaggtacaactgtgattagaagaggtacaacaggaaatagaagaggtacaacagtgattacaagaggtacaacggtgattagaagaggtacaactgtgattagaagaggtacaacaggaaatagaagaggtacaacagtgatcagaagaggttcgtttttcaaattttgttgggcttgggcgggcgcttcgcgaccgttttttaaatttgtttgggccagacgggcgcttcgcgcccgttttttaaatttagttggggccagacgggtgcttcacgcccgtttttcagatt

SEQ ID NO: 25481 - DNA, 1573 bp, Heterodera glycines
cagggatgggccgaggtttcgcttttcgcatttcgcctttcgcattattggcattttttggcgtttcgcatttcgcttttcgcatttcgctttttggcgcgaaatgcgacttttacacccctaagaattggattaaattcccataaaatttttcaaaattttacctataaattggctaattttcagtgaaaactgtttataaatgatcaaaatttccaatttttttccccggcggcgcctatcggcaccgccgcgcccccaaaactcctatttttctctgaaaatggcccaaaatcgcaaaatttggtaatttgatgaaaaactgttctcagcggcgcgccaaaactcttatttctcattagaaaaatgataaaaatcacaaaatttgatgattttttggtgaaaatctgtcaacaaattttaatcaaattttctaaaattttcccggcggcacctgccggtgccgcctgccccctccctcttcccaaaaagtttttttggaaaaagcgcgcctcaaaaaagcgttttattgatttttaaatttggaataaaattttaaaaaatgatttttgctttatgattttaactattaaaaatttgtagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctgattcaaacagtgtcagtctgtttagttgttattcttcttcatttttcatatctttgataaacctaataaatgttaagatttttaatgattaaaaataaaaaaattaatgtttatctttaagtagtgattttttgaaatttttcacttcgttattttcgtcgttggtttttagtaatcttattgatattagtgaaattgaaatgaaaaatattatttttgactgcgcggcgcaaatgtccatttttactaggcggcgcaaatgtcgcggcgcaaatggagcggcgcaaatatccgcggcgcaactgtctgcggcgcaaatggcgcggcgcaagtgtcgactttgctgagcggcgcaaatgtccatttttgctgtgcggcgcaaatggcgcggcgcaaatgtcgcatcaccgcagaaattacggagttatgaatttttgaatttggcagaaaaaatttgtgcgaaacttggaacagaaagtttctaaaatttagaaaaaacaaaaatatatgggatttgattttaaaacttacaacaaatataatgagaatattctacaaagtgcggaagacattgtcttgaaatctgatgagaagacttgactttgattaaacaaatgaatcggtgcaaggaaaaagaagagtcaaaaaaatcccaaaatatatacgaaatatggacaaataatataaagtcctaaaggagtatgctacttatgatgttatataaaatcttagaatcttatttgtccacttaaatgaatagcaatttaaataataaatttactaacaaaagaaaataaataaataaatttcaattgaaaaaa

SEQ ID NO: 25482 - DNA, 1499 bp, Heterodera glycines
cggggggccctatttcgtctcttctctctcctccctcagggtagtttcgttttctccctagtcccaggggtgattttcgtcttctcctcatcttaggggtattttccagggttgttccgggttacccgaaacccgatacccaaaacccggcctttttctcgacccgacccgaaacccgacccgatgattttgggtcgggtttcgggtcgaaataagcactggtaagaaaggggtctgggtgaaaattagataaggaaattgagaattttttttgaaacgattgtgttcaatggaatcgaaaattttgtatttgtttttgttcattattatcctttttctaaagatattttgtatgaatttcttgaatttaagcaaagcaaatggctgaaaaacctgattccatttggttttatttccatcgtcctataaatggcgcaattcgctgcaaatattgcagtgccatccgcacccatgcaccagggttgttccgggttacccgatacccgaaacccggcctttttctcgacccgaaacccgaaacccgacccgatgatttttcggccgacccgacccgaaacccgacccgatatttttctcgacccggaacaaccctgcaataaatataataatttttttttcttattattacttaaattaattaagcgaagccatgaaatttaaaatattctctcctttttatcttctaataaatattattgtataatgcaatgttaaaagtaaaaacttattcatttatttatattcttataccttatcttaaattttaaattttcgaaattataaaaattttattttttacaatttttctttttacgtctgctgctgatcatttcgttgtttcagagctttgccaatgagtctaattcatttcataactttatctatcattataataataatttaaatttacagtatatgttgaatacatttttgtaaatgtttttttaataactattcaccagcatttgaattaaatttatgaaaaaaactgtattttttcttatttgctttacttttatttgaccattaaataatcatataactgacttaattgtataattgtttgattttttcgttttatggtttatattatttgtgtttttttaaataaatttatttggcttttaaaaaggaattcaattaaaatcaaaattctataattaattttcagttaattagaaaaatcaaaaaacattataatatatttaaactgtttattcaaattgtaatgtaataattgatgttaatgtgttcatcgcttgtctgttgcatttgcaattgacgaatttattttgtaaaataataatatatttatttgtttcaattaataaattatcaatataattgtctatgaaaattttttaaaaataaaataatttttctcatggaataaaatttgctttatttatcttattttatttagttgtaaattaattaaatatcatttttacacttctgtttaataatttttaggttta

SEQ ID NO: 25483 - DNA, 1144 bp, Heterodera glycines
aaaagcgcgccgaaaaaaaattatgtgaaacgtaaatctgaatttctataatattcgttcatttagtccaaaaatgattaattgtttgaaacgactgaagaaaatttgatttgaaaatttttattaatttaatttagctttaacttttggagtttattcaataaaaaacaaagtaaaaatttaattttgttttattttcaattgaaataaattaaaataaatttttttgaatttttaaaatttcccggttggtcccggttcccggtcccgaaaaaaaatcgaggtcccggtcccggcttctcaggtcccggcaagtcccggtcccagttttgcccaaaattcccggtcccgctgcactactttaaatcgcctgtggcggcacggccattttaatgttcttttttaaattaatatttataaattctgaaatataattttttgggtctttggcagatcgttaataaatttacttttacacacaataattgcataaataaacactcaattacattgctttgcataaatgtacaaaaaatagactgttcaaaattgttcaataatctcgaatggtcaaatgctcataagagtcccgactgtttcagtccatccattaaagctctgcttttgtacttttcgtccatcaatttttgaatttgttttgcctccgtttctttttggccttggcattttgttgtttttgctgttgttctgctgaccagttcgggctccacctccgttgtgctgatctcttcttcgttgctccactcaatcagcggcttccgttcgctgtcgcatccgctgatcgaattggaccttttgaatttctgtgaaaaaataacatattttagtttttggtttattttgtcatttgaagcaatttaaattattgaaatattcattttttaattttattgaagcaattattttttgaattttggttttcctttttgttcgtttgccaataatttccgcttaatatatgaaaatcgttatggcaacaagcaaaaatgtgaatttaaaaaaagcgaaatgttgaattttctcaaaaaatcaaaatttgattttctaaaattttatttctttctgtaaatgtcggtaactcttgggttttgaccccccctgaaattttttttaaagttttcct

SEQ ID NO: 25484 - DNA, 1026 bp, Heterodera glycines
  misc_feature (27)..(27): n is a, c, g, or t
atctgttcatattatgtccagcacttntgatcaccaatctgtggtttgttcaagctccccggttacaactacatgttggtcttctgttctatgcttagctcattttgcagtttaatgatcgaaatcagcattatcatgtaaaaattagtatttaaagggctttaagaattagaatagactcggacagggatttatgagctgaaacactcgggattgggaaacaaattcgctgctcattgttcacaatttagtgacaattatctataaaaatgcatttaattccgtgcaggtgccatcccttcctgaagagagagttcacgcacatcatgaacagattcggcatcggttcgaggtagagaaaggcaaatcaacatttttctcttagcgcacattgttttaataaataccaacattgacgttgatatttattttgttcaacatacattatgccaccaacgctaatagcaacgctaattttaaaattggaataattttttaaaatttaaaaaacaatttttttaaaatgacttggcggaaaataaaatggggagaaagataacgcaaaaatgagagggtgttaaattcagccccagtcatacataagtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaacacacccctaaagatcaactttttggaaatttttaaaaattacaccccacaaaacacgaaaaatttgagttttcgtcgtcattttggcattttcaataaatattttcgtcatttttttgcgaacatttatttttttaatgagaattttttcgaaatttggcaaacttggaggtgtttttgat

SEQ ID NO: 25485 - DNA, 1260 bp, Heterodera glycines
  misc_feature (1170)..(1170): n is a, c, g, or t
  misc_feature (1183)..(1183): n is a, c, g, or t
  misc_feature (1195)..(1195): n is a, c, g, or t
  misc_feature (1216)..(1216): n is a, c, g, or t
aattcagcagtgttctggtataacgactttcggttcgttccaccccttgtgcaattgccccaaagagaatgctagtagttcttaattattgatgattcaaaaataaattgagcaattcaactcacagcgaccatcctcagaccgggattatttcctatcttttcacgcgcaagccgaaaaccttcgacacgttcgaaatcaacaatgtactcagcccgttgttgctcattttcacagcccgcaggccacccactcgcttgaactttcataccgacaaatgtgttcatgtatccacgaaacatttcaccatcccaagcatcataatgccaaacctatttttttttgatgaaatatatcttcatttgattagattacttcaaatagatccgtgactgtgtatccaagttcgagtgctttgttcaattcgacatgagtatacctgaattttttgacatagactttaaagaaaaaaacagcatacgctgagttccatgagcgtaaacggtccgtgtgtgtgcatgggcgctgttggcgaaaatcagcgcatcgtgcacagagaggaaaagtcagtcgtccatcattggtccggtacggaagcagaggaattcgtagagggcgaacatccggatttggtggtaaaacacaaacaaacaaaagtccgcgaaaagtgttgcaatttgaattttgccagggtaacggggccgttggaggacataagagaacctctcgcgttattacatgtggatttccaaccggaaactcaaatgctttcatcacataggggtaaaggctcacctcaaaacgtaatacatcttaaaaagcataatgtaccatccacttacaatgtcgatgagaatgatttcctcgttttgggtgcaaacgtgctgcagtgtaaatggctctgtgcgacctccacgtagggcatcttcacgtggatccagcgggcgagggacaaacgcatcattgtatagttgccgaagcatcggatttgtgcgcaaatttttcttcaactcacaaccccatataacatggagttcaagcccatgcgtgtgctccaactcccataaacgccgctgtgtctgctcatacagctcttcagcagtccttccaccagccaaatggcgctgacgttcgtttggatagcatttggggcaacctgagaaattttanagcttaactcggnccctcactacgncattaccatggtaataacaanccatgtactctatcgccacatttcgctgtggaggcgaacgaaca

SEQ ID NO: 25486 - DNA, 1771 bp, Heterodera glycines
agcgcatttctgtggaccgtcgctgccaccatttcatcacacggccaggggaactgatcaaacagccgtacattgaacttgtcgaggtgagttgccatgaaaaaggaggggttgcgattttcagctaattttttaagaaaaattgcgggagttttagggtccggcggtacaaatagacgccactagggaaatttgggttttccatttttagtgaaagttggtaataacattcaaaaaaactataatactttatatgtcagtgaattaaggctggttcggctttggactccaaagaggaaaagtcgtcggacattttgtggaaaatggaagaaaagttgcgcattaaagcggacgatgaggactcgcgtttgccgaccagcacaaaatgggacaaatacttcacgaaaacgttccaatttcagcgctgccaaataaggtgacccaaggaaaaatgaactggatgtgccaaagtttcccttctgtttcccagcaagtccaccttcaatttggttgtcgttctgcacgatgtgttgcgcgcggctgcggagacggactcggagatggaggcgagtcggctggtcaccacagcgcggaacattgtcgaaatgtttgccaccactgcgcccgaataccaccgactcactctttcgtccgtcccgcacatggccggtgggtgtttcagctgttttccatgggaatgtcctttttctttcattaatttgtgcctttaatttcagctgttttcttcaacaattgtcatttcattgtgcaccgattgagcacactttccgccgacattttgcagaacattttgacagtttcgaaggtttttttcaccgttaattttgtaaaatttgacagaaatgactcattcattgctgcctatcaattatttttcgtaaatttatcattcagatcactgggcaggactgcgcgttcaccgatttgttcaccgaactgcgaattttggctgccacgactttggagcagcacattacgcaagcgcgacgccaactttcagccacaattggcgaacacgacagtgagtgggaggagggaggggaaggaagaggcacttcattcctaaaaaagccaagataagccagaccaaatgcttcccagatgtggcacccaaagccctgacaaaatgattgcaactttggaaacccgaatgaaacagaaaatacttttcaaatgtcatggtcggaattttagtttttgtcggtttgcgtgacgacagaacgaacaaacactgtgtaaagctgctcaatggctgtgtgatgcaactcgagcagactgcttcagtttggcgagaggtgtgggaaaagagtgaatttcttaataaaatgccaataaacgcatcaattttgccgcattttcccaggtgctgtccgatttcgtgctgacgcattgtgtcggcgagttggtttcgtatttgttgtccgcaatggcgaacataatcctggccaaggaggacatcgcctccagcgacgcggagatttcggccaatctgctgaccacgactgtcgaccgctgcaagaaattgatggaggtcggcatgcttttgcggcgcttttcgatttacaccgaaaattttacgcaattgcttctgacccccgtacgatttacgaatttttagattgactgtcagccgacaattcaacgcgcgtgcgaagaaccctaccacaaattgcaggaaatcatcttttgtttgaatggcaatttggctgtgagtactaatgtcatcccaacattttccaacttttgccct

SEQ ID NO: 25487 - DNA, 1835 bp, Heterodera glycines
cggttttgtggcctgatttttaaaaagtttggagtttggctaagatttttgcatccaaaaaaatttatgaacatttttcttttcgtgcccttttaggcccttcaactttcgtgtttcaccctttttacgaattacttctcccccaccattttccgacagattgccactccgttgcgttatgcctgcactttggtcggcattcgtatcgctttcaacactttgcgtcgtctgggcaaattgcgcaccacgcgcgagattgacctgacggtgcgccaacggctcgacctgctcattgagcaccgggatcagaaacggagtgccaaaagggcggtacggcatcagaacagttgagttttgccatcattcgcaggagcagatcgaaatatctgtccagattcaacaaatctctaaaaattcaaaaaaaaatatatatttttttcgactacggatgggccacttttgggacttgtgattttcccccaaaaatcactttagatagcatgaagaggcattcactgtgttcctcgcggacgaggacaaagttggactaattagtgcctttgaacttattgttgtagcatagagaactgctgaccgacaatgagtttatttagtctgtccgttttgtttggttttgttttgtttattgtcattgctcaaatgatgcgccattgtttttctttcattaaataaatttaaataaaaattgttttgcttttttcctatttcaatgtgatttgctttcgctgtaagttcgcgattcaatttgcctttttttacattattttccactaatgtttctttgctttttctgtttgtttcttcctccacaacggccgacggtgagcagcgaaatttattgcctccttttcccattattttaatgcgttttcctatcaatttaaacaatttgttgtgtatttatcatttccatttaattgattttccgtcccttttcagaaatttgtcccccacccattgcgatgagcgctcggcgtgtgctggtcgctgttggtcagctgaatgtgcagcacgacttgcagcagaatttcgagcgatgtgcgcggatggtccgacgggcgggcgaacggaacggctgtaaggtgggaggactgaagaggaaatggtgaaaataaatggacaggaaggaaacaagcgatcccacagcattcaaaaattaaacattttcttcatgaaaaaaaactttgtaagccggggaataaattgaaatttctttgagttagctataaaagaaaatgtattcagatggttttcctgcccgaatgcttcgattacattggccgtactgttgccgaacagattgaccaagcgctggatacccgtggcccatacattggtaaattccgcgagttagccaagcagcatggcctttggctgtctttgggtggcttccatcacaaggtgaatttgttggattttcatgggtttcatttccgggaattgaatttttcagcgtcccgaacttcggtccgaccatttgccccgaaatacgcatttgctgattgactcggatgggcaaacgcgcgccgaatatgacaaactgcacctgttcgacttggacttgccgggcaaagtgcgactgatggaaagcgaattttcttcccacgggcacaaagtgagaggcgtcccacttttttatatactttggcattttgtgacattattcattttaaatgtgtttaccctctccccttttttgagttggtgtcccaccgttgctgaaacgccggtcggtcgccttggcctgtcaatttgttacgatttgcgctttcccgaactgtcgttgtaccagcggaacagaggggcccaggtgc

SEQ ID NO: 25488 - DNA, 1003 bp, Heterodera glycines
caaaaaatgtacatcgatttaagcctcggacttgatccatgtcaatcagccgcgacattcggtggaagttgatcggagaatagcctgaatttggcattttggcataaattgtgccaaaaatccggcatttaaaaaataattaaaaatatttgcatttttaaatcaaaattccatttttccaagttttccgaccctcaacatccaaaaggccttcgttggccccgctgtccaacaaaatgtcgaagcattccaactccgcagcatcgcgcgacttctctttgtcgtcgccgccgcttccgtccgcgtcatcctcgcgcaatgttcctgcaagtgccgcggcataatgcaacgctgtacggccctcctaagaaaatttttgaaaaatttaattgaccctcacgaaaaaaagggaaatttttaaatttttaattgacgaacggaaaaaaatgaaatttttaaagtttacgctatcccgcgcgtcaatgtgactcccgtcctggtccagcaaagctcgcaaaatggccggatgctcataaattgcggccaaatgtatgatggtggccattgtgcgcgggtgacgagctgaaaattaaaatttgaaggccaatggccttgcgcaatttttggaaaattttaatttccaaaattcaaaaggatggaaaaatattagaaatttggaagttgtaggcattttttgtgaaagattttcgaacttgaaacagagcatttgataaatagttgaaatttggaaattgttagctaaaattttaaatttttgaaaatttaatgaacgaagtgtcaatttagattttgaaaatctcaaaaataaatgaataaaattaaaataaacttatttaaagtaaataattatgaaaaattgaaaatttgcgcgaaaaactgcaatttaattgcataaaaataataatcaccgcgcataaggtgccgaaaatccatcaatttgtgtacggttggctcgtccccttcaacaattgctggagaaaaa

SEQ ID NO: 25489 - DNA, 1629 bp, Heterodera glycines
agttgccaaacgatggcatgacccagggggaatcggtcgttttggcgccgccgtttggtgccagtcaagtgaaaaaccaatttgtttaaacgcgttgtgcatacctttttttaaaatttttctcgatttcagcacataaaaaaacctataaaagtggttttgtgagtttctggctccggtctgtcaagtacatatttacacatatattagtacataatatacagacaattccgggctaatatacaatatacagacaatttcgggctaatatacaatatacagacaatttcgggttcgctatcacggtgcatcgcggtatttccacgcatctgtcggcgccccggatccctctctgacaaagtggcgcgcgctccatggacgtccctgtcgtttgcgctctgcagaagccgcacgctcgcgttgttcaattgcttgcttgactgtaggaagggaaagcattaattactccctccatgcaatttgaaccctttcaaaactcactctgtctcgaaaggggcaatttcttcttgtacaatgctgcagtgagatgacgccaaagctttcggctctcattcctcctcttgctccatcacccgaacgcactcctgacaaaaataaaaagattaaattcagcttaagtgaaaaatcgaaaaaatccctaccttcttgcacaaaggaaacaccttttctcaggtgtggtttcgtaagccgcttaccaattcgtctggatgggctgaaaaatgagacggagccggtcaattcagtgccgacgattcagtgccgacgattcagtgacgacgattcagtgacgacgattcagtgtgaagacgattcagtgccgacgattcagtgccgacgattcagtgtacgttgaaaagccgacaattcagtgccagaaaattggcaaaaaattttcaaaaaaaacccctaaaaatacaatataaattgaagtggttagaaattctgtctgatgttattgttatactcttatgctaaatcaatccaaaattaaaataatgacctaaatatgtttagaatcaccggtgctactgtaaaggaagaccttttggaaggttctgcggaacggattaccctttgggttacgagatataaaattgtgctaaaaagagatagccatttttctgagaattaattcacaatttccgcaaatcttgcggaaaagtaaaaaattttgaagaggctctgcgtaacggattagcatcggtgttacgagatagaaaattgtcctaaaaagagatagccatttttctgagaattaattcacaatttccgcagctcttgcggtaatggaaaaattttgaagagtctctgcggaacggattagcatcggggttacgagatagaaaattgtcctaaaaagagatagccatttttctgagaattaattcacaatttccgcaactcttgcggtaatggaagaaattttgaagaggctctgcggaacggattagcatcggggttacgagatagaaaattgtcctataaagagatagccatttttctgagattaattcacaatttccgcagctcttgcggtaattgaaaattttgaagagtctctgtggaacggattagcatcggggttacgagatagaaaattgtcctaaa

SEQ ID NO: 25490 - DNA, 1135 bp, Heterodera glycines
aaaaatggcctatctcttttttaggacaatttttctatctcgtaaccccgatgctaatccgttccggagagcctcttcaaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctaagaaaaatggctatctctttttaggacaattctctatctcgtaaccccgatgctaatccgttccagagagcctcttcaaaatttttttccattaccctaagagctgcggaaattgtga

SEQ ID NO: 25491 - DNA, 644 bp, Heterodera glycines
caataatcgcaaattgccgtcacttttgggcagatgtgctcttcgttgggctatcccccccccctcccccctttaattcggcccatttccctttgtaaatgccgctctttcccatcgcttccggcttttatagccggaaggcataaatttgcgccactgatcatttcattaattgccctcgggattttctttcttttttacccttaaacctttctcattcattctccaaaagcccttgacatttttgcttcagctgcaaaaagagacaattctcagctaattaactgccactcattggccgcagggaatgcaaaatgaggcgggagaccaaagagaaaaggtcaaagaatggaccacattgctttagcattgcttccaattaaggtgttacattaggcaaatttgggtggctaattacccataattaattaatgccaaattaatctcagccctatcgatcgattggtcgtgcttttctctctcctccattatttatttgcttttcgtccttttccaacttcgttttgcgtttgttctgtcgcgtgtctctctctcttctctttgccttatcactttcttctgtccctttggctgtctcttatcgtccaaatgcaaataaataaactcaatttgccagatttagc

SEQ ID NO: 25492 - DNA, 464 bp, Heterodera glycines
aagagtggtggaagggggggggggagggactagggatgggggagggggaggggtcattgaaattagacttggaatggaaggtgatacgggggagagggggagagaggaggggatgaagcgggagaggggggggggagatggggacgagtgttttgaaccttccgggccattgaaatttaacctttgataaaaggaacggaacataaagcgaagagacttatagcacaaagtcaaaagaggagggtgggggataatagctagcaaaagaaaaagaagcgcagaaatggaatttaaaatgaataatgaatatcatcagtccttaaatgttcaatttatgactaatcaaaaatttgcaatttttcccccccccccctctcttttctctctctcctctttctctctcttgccaacctctctcttttctttctatctctctctttctctctctgactctagaggtcccc

SEQ ID NO: 25493 - DNA, 1133 bp, Heterodera glycines
ctaaattgtattaaaaattaccgtatcattttcaaatattttcaaataagacactcataggaaatgccaaaattggaattactttttttgtgaatgattttggcgttccaataagaaaatgttttatctgcagcaacaaaaaataaaaaaaaacatttctgacgtggaggccaaaaaataatctatctttttttttatttgtttaatttgtgtgctctttttgttcgggttttaatcatttatgtaaaagcaaccttctcaagttccaatttgataattttgaagttcatttccatcttggcacacttttcacgaaattccttttaatttttttaaattaatatattaatattaattttaattgctcacttttggctgctgctgaacagtgacttttccatcagattgtccatcgttgtccaaactaattgattcacaattaacttctgaaaatcatacaaaatttaattcgtaaacttaaattaatatttattttcacacctaccaaaactcaatttactttctacggtttctttctctttttctcattacctccatctgttggtatgaaatcgccatttgttgaattggtcgaaattgacatttttaaaggtattgaaaattcaaattccttaaatcattttcagatgtttttttaatatataattattatttcgataaaatttcaaagaataaagaaatgagcatttatttttctgctgattttttaaatattttttagggtcaattaagaataaattgaggcaaaatgatgacccataggaattattcatatttaaatttgccattaaaaactgtgacctaataattgaatggatgaatgaaagaataaataaaataaaaaataataatctcctctgattgtttttgatgacttggttccttttttgccttcgactcgttttctttgcgaattaaaagtgattaattttgcgaaaatgtgtctataaaaaaattactgaactcaccccttgagtcgagtttggcaaaagttatacattccgaaaaattgtatttttataagggaaaaaattaattttccaattttggaatttttttttttttattaatttttggccacaaattttttggaaaaaattaatttttttttt

SEQ ID NO: 25494 - DNA, 2032 bp, Heterodera glycines
atttcccgagactcgagaccgagacttgaccccgagactcgagaccgattccgagacttgaccccgagactcgataccgagaccaaaaaaacccgagacttttctcgagtcgagaccgagagtctcgaacatcactagtaaacaccatcatttttatgctcacaaattgaaagataaattttatttttcataaactacataatataaaattatgcataatttacagcttcctaataaaaatatttaatgtgatcgatctattgactgctcgattaaaaacaaaattgatgatcaatttaaattaatacaaaaaaataatggacaatatcatttaaaaatattttcatattttatttttaaaaaatgaaaacattcttcgtattaatattatacgttttattattaaaaaatgcaaatgaacaaactgaagcaggcaaaataaacaaagaaaaaagttttgatcaaatatttggccaaggatgggacgacggagaagaagaaaacatttgtcgaattgatcaaatatttaatggacagacagctgatcaggataaccaatttgatcagatttttggtgaaagtttggaagtgaaagaaggggagagtgaagaaatgtccacaaacagtgatcaattggaacaattgcaagaaaatgttggacaaatttctgatcatttttcaaatgctattggtaaaaagaaaagagaaattgtggaaaaatttgataaaattaaagaaaaagttaagcaaatgggaaagaaattcacaagaaaagaatggcataaaattgaaagaaaaattgccaaaaaattgggagtaaatcaaaggaaaatttacaaatggaaaagagaatttggaatgatgataaataaatattctattgatgaaaagcgtgaaacagtaaagcgatttgatcaaatatatggcaaatttaaaatgaaatttaatgaaaatttggagggaaaaagagaaaaatgcaaaaaaataatagcaaaacatttgggcataagtttaaaaagcatttataaatggaagaaacaattaaaaaatggaaaacctttgaaaaatcaacaaattgatgatgaaaaaagagaaattattgaaaaatattttaaattaaaaaatgaatttatgcaaaatgagaaacattcacgaaaagaatggaaagaatttagtgcaaacattaagcaaatatttggaatttattatagaacaattgaaaaatgggacaagaaattcggcattaaacaaaatatttcaaaaggtgaaattttttaaaagaatttttaatttaattatttaaatattaaagggcggaagcattatacaattgtcgaaaaaatggaaataatgaaacaatattttgaattgaaaaatcaaaatccaaagctcaccaatggagaaattggcgaaattttgaatattccaaaaggatcattagaaagatataaagcggaattcaagagaaaaagtgaaggcgttccgaatacggaatgattgagaatttatttcaattttcaggttttagtcaatgtgttgttatgtttggtaaatttttgtaatttgaaagaagaatcaaaaaaaggctggaaaaatattttaataaaatattaccaggaactcattaaatttataaaattgtaaatttgtgatttttgaaaaaaattcggttgaaagtcattcaaaatgccttcattttttaaaatttgtcatgaaaaaagttgttagtaataaaagttttcataaaatttatatagttaaaaattaaaaaaaaattaaatattccgatgtaaattttattgtaggcaattgtttttcaattattttaaaatgtttttttcttactaaaattttactatttaaatttctttttacgcataagcaccatttatcaaattatagttcgttgaacttttgtgaatgtctcgacctcggtctcgagttaggaaaatcgagaccgagaccaaaaaaacccgagacttttctcgagtcgagtcgtgaaaccgagactcttgaacatcactggttgtaa

SEQ ID NO: 25495 - DNA, 1887 bp, Heterodera glycines
  misc_feature (1650)..(1650): n is a, c, g, or t
  misc_feature (1783)..(1783): n is a, c, g, or t
  misc_feature (1818)..(1818): n is a, c, g, or t
aacattgccatccgaccataaatgccaataccttcgtctgttggcaaatccatcgcactttttggcgcctttttcgcttttccactcgcaataaatggccattcattcatttcgccgagcagattttgttcgcttcgggccgagctccgcttccgtccaaccaattgccattctccaattattaatttattaattagttgttaattaaggtttcccaatttcaattctttgccttaaccaaccgttttcttccttttcctttttttcatttattcgccgattgtccccgacattctcttcaactttggttgtttgacttaagcaattaaactgatttattctctcctcttttgcttccccttctcctaccattccgcttcctttacattttttgccgggggtgccaaattattttttgcgtttgttccgcggatttcccatgcgattggtaccgtcggtcttctgcataaattaatgtctgacaagtttaataacaaaaaaaaacagcacttttctagtttactcacaaaaatccaaaaaagaaaaagaaaaaattatttttagagcaaattagggactataatcaaaaaattttgtacaacctgaatctgaacccgatactcgaatataaaaccgaagaatttttattttatattagagcggctcaaaaatgcaaactaaattaatgatttctttttgattttaagcaaaaaataattaaaatattgtaataatgatttaaaaacgtggtacttttccgtttggaaccgcacattcaattttttttttgtccaaattgctgctttcctctcaaaaagtgaagcgctgttctttaatattcagtgcgcaattgaatttatttaattcagttagaagttaggaattacatttttactctaaaaatatttttttttaattttagcaattattttgtgatataaagcagaaaagtaccaaagaagcgaacttctcagaattctcccaattctgctcaattttaattgtatcgatcagactgagaaagtcgcgaatgccattttttaaaaacataatcgcttccttaacaaatttaaagggattaattaatattggtcggttggtcccatcggttacctcacagcccaaaatattttgctgaattcggcagatttcgtacattgaatcgactgatgcttttagagtgtcgatgcagtagctccattctcgggcttctcgaattttgtcagatatggacatttgaaattgaagtaatatttgtatttttcgttatttttttatttcttaaatgctttaagcaattccatatttttaattaaatttggcattatggcattctgaatctttttaaaaaaaagtcagccaagtgattgaagattttatgctctcatgtgatttgtaagcaaatttttgtcaaaatgagtcatgacaatggtaacaacgcttttcccgccgcctcgtccatttacccctcccttccgtcggccctttgcgatgaaaagccttcccccgccgccgttttgtcccattgcgatgatatggaaggcatcagtctcttggtaaaagctgcggattttgcagctcgtagacaccgtttccaaaagagaaaggacgagcggacgccttacataaatcacccaatcggagtcgccnctctgctgataaggtaaaacttttgccaggctaattcgaacaaagcgaagtctgccgcttttgcagcgttgccaaagtgtacgaccccgccacattggctgctgcttatctgcacgatttggtggaagacacncaaacgacgtttgaggagttggaacacttttcggnagagagtggcggaaattgtcagagaatgcaccgacgacaaaaacttaccgaaagatgtgcagaggaaaa

SEQ ID NO: 25496 - DNA, 1167 bp, Heterodera glycines
tgctgctttttgtctcctcacattgtcctgaaaaaacaaatggattttgtagtgttcgttatattataccgaaggttggagaagagtttggcgctctctgagaatttcgacctgaaatgctttcaaaaaaagtccaaatgttttcattttgagaccggctgcgccttggaagcgacggttgtgttcccaccagcgaccgttattcggcttggcacaaacatttcgggtttcgtctcggacttcgcgcgatgtctcggcatcccagccacataaatgtggtcgggcacttccattggacgatgaaactcatctgagggcgaatttgaccggcgacatttcctaaacgctaaatttaataagaaatgaacgaatgaaacgactttcgcttgctttgttgttccccggttttgttttcttttgccatttagtggattttacaatcacaatgactgttattatttcttaataaatcaaattatggagaaacatttgtgtaaagttgtgaaaacatgtttccgtgggttttcggggcccattgatcacgaactgcattcattcgactaattccgaaccccgtactcgaattcgaataaaaaaacgaaaaatttataggtatttctcaaattagaaattgtttaaatacttttttggcgttctgtaaacttaggtttcaaaaagttaaagaaattctcgtattaattctttttctggatccaggtccgggatatttttcgtagcctgtgtttttcccaagacttgaatttttgaccatttagaagaatctgaaaacctatgaatagatccacatatcacttttaattgtatctaaatgttagcctacacttgcgtcacggcagtttgaagctcagtgacagtagctattttataaacaacgcatacaaaaatcaaatttactgaattcaataaaatttattcgaataacaaatctttaaaagagcagcaaaatcggtgttaaaagggaagggacagctggtctgacagccgaaacgtatcgggggaagtaaaactggtaaacaacaattaataagagaggaagtccacccaatcaagaaagcaaatctgatcgatggtctacaattatggcagctaataaatgtacaaaaatctgaaaaaacaactaatttttggtaattttcttttattcat

SEQ ID NO: 25497 - DNA, 1765 bp, Heterodera glycines
tgccaaaactcaacgtaaatttttcaaaaatctgctgtctgttcaggtacagctattcgggcattgcctactcattggccaaaggaatgtccatggaatgggcgtgccattctgaggtcggactgatccggcccgacttggtgctattctttgacgtggtctgtctcccgccccctttcagacccgtaaccttcgggggaggggcacccaatggatttgttgggaaaaatgcaagaaaatggacgggaaatggcacttgtgaagttcacgaaggacgactttggcatttaattactttgataagctcctccgaaactatagtaggtaatagccggttcattcttttgctgtatgtattacataatttatgctattttatttatacaatttttgtacattttcaatatttattaatttattcattcggtctttgtaaaaaaatgaacaatgaatcatttgttgggatgtgctctattcagtgatgtggtgaaattacacaataaaacattgtcattagagctttaaattgctttgctgggaatggaatgcgttttaagagggacggcaattataatgaaattgaattaattacaaatgatggaaattaaatgaattaattacatacaaatgattaaaatagatcgatggactcatccccgaacctctcctcacgaccccctttaaatgaatccccactttcgatgcttcttcgtccgctgagactgctttcctttccttttcttccatcagagtcggtcctttgtctgtctgtcgtccctttgtccgcttttcatttgtcctcctcttccgttgtgtctccgccgccgcgtctcttttccgtttcgtccgtttttcgctgtgcgctgatgaagttgcgtatgctgctgaatgcgcttccgccgcccatctctccgtccgcctgcgtttggtggtggcgtcgttttccctccgtcggcggtggcgcggcgttcgcttccgccgctttcatttcgctttcccttccgccgccggcggcgttcatttcattctcgtgcttcttcaaatgtcggtccaaatttgtttgttgcccgaagcatcggtcgcaatagtgacagctgaagcaaatgaattgatcaatcaatcaataaaccaatcaatcggttgatcgatttattaattgcagaatggagcaatttgaccgactgaattaaacaatctaatcacagttatttaactggtctgccaaaaaacataccgaaatggcttttccttgttgtgaatgttgcgcacatgccgctgcaaattcgagctgatggagaaggaccgttcgcagtattggcactgcaaatatgggaaattagtccaaaatgtaaaccttttccctctctctccccctcgctcctctctctctatttctctccccttctctctccctccctccctattctctctctcctctccccccctccccctccgctcatttctcattttgctcactttgtacggctgttcgcccgtgtgggtgcgcaaatgccgcgtcaaattggccgaacgcgggaacactttttgacagtatcggcactgatagcgctctttgccaccaccgctttccttcactccgtccgccgatcgattcgaagcgccgttcgaacgccgcaagtgcgtcacggagtcggaggcccttttctccgcctgttgcgttgagctgccagccgtttggtttttgcgcttcttctgctcgctcggccgataatgggttgggggagcggcgctcagttgggcggtt

SEQ ID NO: 25498 - DNA, 1080 bp, Heterodera glycines
gcaagaatttttttcgttagcatttcaaatatcgtgtgagtgtttcttgaggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaggagaaaaaagagatagccattttttgggcaagaatttttttcgttagcatttcaaatatcgtgtgagtgtttggtagagccagactagagaaggcaaatgttggtaccaagtttgcggtcaaatccccaagagaaaaaagagatagccattttttcggcaaagaatttttttcgttagcatttcaaatatcgtgtgagtgtttggtagagccagactagagaaggaaaatgttggtaccaagtttgcggtcaaatccccaggagaaaaaagagatagccattttttcggccaagaatttttttcgttagcatttcaaatatc

SEQ ID NO: 25499 - DNA, 1044 bp, Heterodera glycines
gcactctgataattttagcgttcataatggggatgtataaaggcgattgtagaaggaattggatgcgctaaaattgtttgagaagctttttgagcgtaattacgatttttacttagaccatttttttaaggcttagatcacatgcgattttcggcactctgataattttagcgctcataatgggatgtataaaggcgattgtagaaggaattggatgcgctaaaattggttgagaagctttttgagcgtagttacgatttttacttacaccatttttttctaggcgtagatcacatgcgattttcggcactctgataattttagcgttcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgttaaaattgtttgagaagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgaggagctttttgagcgtaattacgatttttacttagatcatttttttaaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtattaaaggcgattgtagaaggaattggaagcgctaaaatttgtttgagaagcttttttgagcgtaattacgatttttactaagaccattttt

SEQ ID NO: 25500 - DNA, 1615 bp, Heterodera glycines
tcaggaaacctccagggtgaaattccaaatattcgcgttacatcgtacacctaaaatggcaaagaacctttttaaacggaaataataaatgcaaggatggacctttaagtaccatgtcaaacaacaaaatccaacaatcgtcttcagagttatgctttgaaagttcgtcttggtcaaccgaacaacgcacattgtgagtggtcaaacgaccagcatttgacaatctaaaagaatttagggaacatgccttagggcctctcgtaagtacctaatccagtcgaggagtccttttccgggttttaactccactttctgtcttttcatcttaatgtctctgtctacgcaggcagcggcgggtggtaggggcagacaaaggaaaagtaaaagaaatacgataaaagaaatgaaaaggagagacaataaaatttgtctcgcattccttccttatttatatcccatcttttattatttaaaatatttaataaaagaaagaggaaaggaatgcccattgaatccgctttggccataacaaaagagaaatctctaaattttaaatttaatatatggatgagttgggtgtatagatgagttgggtatggatgagttgggtgtatggatcagttgggtttggatgagttgggtgtatggatgagttgggtatggatgagttgggtttgactcccgagcggttcccgtgcgggggatcgattaagcgggtggtgcaaatatacccaaaaagaccagggaaatatccagaaaagcccataaattataacacgattgtctccattgagaaaaagagtactttaactagctaataaatgaaacactttagggtaagggatgtcttcggctcgacttccgaaggggtcgaacgaaggaacgccaagcagtgacgaaggggagttcaaaaaggtgggtttggaacgaaatcgatcgaaagctgcattgggttatcgtaacttttcgcttttcagattgtgatcggaatatgcgcaatgcaacggaaggccaacagcaagccgatgcgttcgatcatgcttaaaatgaacgagttctacaaggtatttaccggcttacaatgaatgcccttcatctctatttaaatattttccaatattttataaaatgttttacccttttaggactttctcgattttgtaatttttcccgaggaaaccattctcaatgaatcggtggagaattggcccctctgcgactgtctcatctcttttcattccaccgatttccctctcaaaaaggcaattgaatatgaaaaagcgagaagaccttacgtgttgaatgacttacaccgccaatttgatttggtaagttattattttaatttagtaaaagtgaaaaatactgacgggattgaaaatgtatatctctaatgaaagaatctgaaagaattttttggcggcaggaactccctgaagagttacagacccgggactgaagtggcaaaatggcttttgggactgaaccgtccaatgtctaaaaacatgaatctccaacataacatacagaaatagattatttttgtctctaatgtagaatatgtgacaattttgaacaaaggtaaaccaggaattcccctttttggggaatcttt

SEQ ID NO: 25501 - DNA, 1701 bp, Heterodera glycines
ggagtagaaacaaagagaattgacaggcaatgaatgagggagggaaatgccacttcagcagatgcctttttcattgggacttccgttgaattttgctcaaaatgccaataaatgccaaaaccaattaaggcgtgtaattcccccaatccgggcgatttcgtgacaatggcaaaatgatagggacccaattaattttgcggcacactcaaagaggcgatgaaatgctgccattcgccagcagacaaagaacggcacaatagccattccccccacccccgcaatttcctgtccctaatgagctcctctctcaattcgctcattttgggagaaatcatcgatttattgttattgttgtggtcaatgaatgcttgttcttttccccattgaattcattatgcttcttccccgggttgccctgggacatgccaaaatttagccctaatttgaacccccgagggcacatcaatccaattagtcacgggaagagaaagaaaactgtcctcaaggccaaagttaagtggattaaaagtgaatgaaatgaaagtggatgggatgaacacagcaaagcagcagcagaggtggaagagaaagagaggggaggggaaatgaacggggaaacgtaagggggaggtaagggaaaaaggggagacggaggggggtaagaaaaaaaaacgtgttaaggaaaacaagtgagggggggggggggggggggtaaaaaaacttgggaaggtttgggggaaaacggaaaaacggataaaaatggaaatgcctaattttctcatttgcctattagccgttccttttaaagttccttgccatttttgtcggctctctttaattttccgttgacttcgaaagggtgccaatgattcgttccaatttaacttcggttgtccatttaaacccccagcagcaattccattatgtttttacaaaactgctcaattcgattcggccgtccacttgaacaattagggacagaaggaaagttggcagaggaaaagcacttgagaaggcaaatttggacaaatgttgttgccgggggaaggaaaagaaaggaagggaaggcattgattgtgccgtgccgaagaaggatgttgccttttggacgaactaatgaggcgaacagagcgcggatttgaatatgggctgaaggaatgaatggcaatttggggtgggggttaatggggggacgatggaggacgacgatgttgtttgtttgtttgttttgttgtctggattaaccaaaatttgcgcggataatccctccccatttttgggaccgaaaagcattcggaaatgactaatgaaaatgcgaaatgattggttgacttgttctgcttggggttatgccagaaaatttttaaattttcctttacagatttgcggaagcatttcccccaggggccaatcgctcggcgggtcgaagagggaaaaacggtgcaattgcactgtcagccgccagagggcgacccacggcccgaggtgggccaaaatggtatttaaagacgaaactgagccatttgcgcaggtccattggaacaaagacggccaagcggtaaacttcgcccctggcggcccgctgattcaggcggccgacggaagtctgatcattagtgcggcacggttggcggactcgggcaattactcttgtgaggcgcgtaacccagcaaacagacgcatcagtgaagcagcacaact

SEQ ID NO: 25502 - DNA, 1228 bp, Heterodera glycines
ccccgacccgagacattttttggaccttttccccgacccgacccccgacatgtcgcccccgacttccccggccctcgactttttgccccccgaccccccgacactaattcgggggattggggactcttgaaaatttttgaaattttgaacaattttcttaataaaattaattaaaaatttcgaaaaacttttcggcggcgcctatcggcaccgccggcctcccaaaactccaaatttttcctaaaaattgcctcgaaaatcacaaaatttgacaatttttggacaaaattctcaacaaattatattcattttcaaaaaatttcccggcgtcgtctatcggcaccgccggacaccccccccaagttttcaaaaagtttgaaaaatgcaccactaaagttgtcaaatttttgagattaaatttttgagcctcggaattgatttctgaaaatttttggagcctgagatgccgggaaagggtcgtttcggcggcgcccacgtttcggcgctttaatttatttcaggtgaaaataatacaaaattaaatttttatcttgttttttattttataaaatccaaaaattaaagctcacatcacttttttcggcacgctttttccaaaaaactttgggcagataaaagtggtccggcggtgactgataggcgccgccggggaaaattttggaaatttgagtatggtttgttaacagattttcaacaaagaaggctggtttttgggattactattctcaatttgtacggattttctttaaaaaatgataaaatatttgtcaattaaaaaaaatatgagggaaaaattgaaattaaaatcaaacttttgctgcgccattgatgaaagtgaaaatttttctaattagagaaacagtattaatcggaattgtaaaatagttacctcaagaattttcaaaattagggaaaataaatgaccgggctaaaacttatgttttttgtctaaacctaaatcaaccgcgctttgtatgaaaaaaaattaaaaattgtaaattataattgttttcataaaagaaaaaaataaatattaaataagcgtttccttttcttcccaattttaatttcatttgaaaattcaatattttgttaaaagttaactgcaaaatttcaaaaaaatatataaatataaccgtcgatttttgttttattcaaattaggcccgtaatccaaatatcgaccgatactcaaattagccagaaaa

SEQ ID NO: 25503 - DNA, 2206 bp, Heterodera glycines
ccccccccccccccggggggataaatcgccttaatccccgctttgtttcaaaattttccttcctttttcatcccgtgtgcccttccgccgacggcaagcacatggagatgtatgttgtgtgccatgccacatttgtcaatcagtgtaaattatgtggtgcatgggttatactttggttcattggcacggcacattttggtgccatcccatcccttactgatgaaatcacttctgctgacgaaatcctgttccgtgcgcacgttttcgtgccaggaaggtttttaagaagccataactgttttcacagttgatcaaattctgtaaatctggtgttattcaaaagccctttataagctctattagtcctacaaaactcataatgattttccaacttgtaaaaaagatttaatcaactgataaaaaagctacggcttcctaaatcttcctggccggaaaattcctatttttgggtatttcttggccataacttttttgttttgtggtccaaccaatttgttttgaaatttgcatgccaatttagactcttaataattcatactctaactttattaaacttggttgacaaataaaaaatttacaacgtttggcgtccaatttgggcttaacctttaaattgggtccccctctttacttttggcatttgtttcttaaattgggtgccattttggcactttggcacgggacatttttggcgccgtcaaatttagattttcatatctttgttcttttcatatctttgttcttagtatcatacgataggcaattgttctcaattaacttgcaaaatttcaataaattttttgagatttcttggccataactttgtttttgtggcccaatcaatttgttttcaaattgcaggctaaattagattctcaagagctttataattcatactaagttaattaaatatggtcgaaaaatagcgtttggtgcccaattcccaattaggcttaacttttaaattgggtgccggcaatttgcgcccgcccctaattactttatgcaattgttttggcattttttttgccatgcgattagtgccagattttcaatggtcggagtgccaactaaaccagcagcccctccctcattcattcatttattcattcatcttttaatgggccaatcccgttgattggtggcacactctcaaaagcacttcccccatctccccacccccgctttactttccaatttagaaatgccattgctttttggccggcatttcgaaaaaatttttctattaaaaacaattttaataatcacttttcaataattttcgaatgacattaatctattttgatcagtttcatgtgatcaaaatgccattggcataatttatttacttcaaagctcactgacaaaaattttcagtggtacaaatcaattttgatcactttcgtacaaacgaatttttgatcattttcaagtgatacttttcattatatattttttatttaaaaatcacattcactgatcacttttcaacaatttgctaatgacatcatccaaatgatcaatttcatatggtcaaatgccattaatataatttcggtgaattttgattaaaacgcactggcaaacgttttcaatggcacaaccatttttgatcacttcaagtggccagttttcattatttttgctaattgatgagacaaattcggattaaatgctttattaacagtatcaaaaattgctaatttttttaatgattctatcttcatcgttaccacttttttaaatcgatcagaagatatatatagcaccagaaaattaatttttcttttttttgatcattttaaatattttcctggccattttatctgccaaattaaaatactccaccgatcacgttaaattaattagatttagaaatattttcataatcggacattaaaacaaaaattgcttaaaccgtccgtcataataatttcattttttgattctaaaatttattaccaatcccggatgtccgattttttcagggcaaaattcaaaaaacaaaaaacctttctcagtgtttgtcattgttaatttgtcaaccaccaaactataattaaattaattacgttttttgtgtcaaaataattagagacggctggccttgatcaccacgcttgatcacttcctttcattaatttctcattaaccacacactcttttcattccactctctttctct

SEQ ID NO: 25504 - DNA, 1375 bp, Heterodera glycines
tgatcagtagggctgtgaattttagtgacgaaaaatcccaaaatagttaactaaaatagtgagtaaaaatgccaaaatagtgaagaaatagtggcaaaaagtccgaaatagtgacgaatagtgacataattttcagacaaaaattaagcaaaaataatttttattcactgattgcagttacaaatgagttggactgggatttttaagaccaaaaaacccaaaatagttacctaaaaaaattttttaaattaaaaatttttgccaagaaagtaaatttttgagaaatttttttttgatttcataggagtatattttgaaaaattttagctcgattcttaggggtgtattttttggttttattgcatttttgttaaggaattttgcccaaaaatgtcaaaatagtgacaaaacgccaaaatagtgatttttaactattttagtgacgaagtcgccaaaatagtgatttttaactattttagtgacgaagtcgccaaaatagtgatttctagtgaccgataatgacatcagaatcgaaaatttttaatgcagaaatgcgttttttgagctcctttcttcaaatcaatcgagcaaaaaatttagttaaaacctaaaattcacagccctagtgatcagcgaccccgaaaacctcataaaaaattttttttaatggtctgtaaagtacatagtaaatacccacaaaaatctaatccctaaatattattctgaagtgtttgccgattattttcgtaatctttacattttcacttcactaaacacagatcattctgcacacatcgcatcattcatttattgttttcttatgacaacggaaccaaatggtgccgttgaccagcagcagcagcagttgctgtttgcctcaactgcttgcgcatgtcgtccgaacaccatggaatggtgcaaaacaacttcatttattgtgtttgcttctcagaggaccatctgcattgtctctgatcaggtttgtttttccttttttcttttcgtcttcgtcgttttcccgaatccttcggaattggacggaaaattaaaaatttttttttttcgttttataggtaaaaaaaaattgatgacactcggattttgcaaaatcatttagtttttttctgatttttcatcaagttgttgatctttttgcaatttaatcattggtctcttaagggtccctttgcggcgggggtctggggttcaaacccgcttggctgcggatgtttattgtaatttttacacaaaaaaatcatcaaaaattaaaatttttacttttctatctcagaacattgattttgccaccaacaaaatttgccaaaaaaccaagtaggtgtatttggtgaaaaatcgtggacaaactcaatgattt

SEQ ID NO: 25505 - DNA, 1657 bp, Heterodera glycines
  misc_feature (1593)..(1593): n is a, c, g, or t
  misc_feature (1641)..(1641): n is a, c, g, or t
ccataacttttttcttatttggtctatactacattcgttggtatcaaatgaaagcttgaagtcccagtaattcataaatacaagaaaaagcaaatattgacacaagaaaaaaattacaaccaaaaaacaggaaatgcagatttttgtgagtatattcttgaatatttttttgtttatctgttggttttagcacagattttagttctttaaatctatagactttaagttttcgtttgatgccaaaaatgtggatattgaccaagcaagaaaaaagttatggcaaaagaaactgatgattggacaataaaagccgattggactcataaagtgcattagagccgcaaaattttaaatttaatctgcttacaaagaatttatttgaaaaaacaaattaataataaataattatttttaagttcgaagatgacttggcagtcaatgataaatgggcaatgagcaatttattgggcatggcatctcaactaaattttacattccaattgggaccacctggtggaaaacgtggctacatggtgcaaatctttgtatttaaaagatcaatttaaatcatatttatttaataataaaaagaaaatgcgtaataagttatttgcttgggaggcaatgaatgtatttaattgaaaaaagctttccaataaataaaataaaaagagtttgtacagcggagcctgtatggcctagtggataaggcgtcggcctccggagccggcgactcgggttcgaatcccgatacaggctagaagatttttgtaatttattttattttttagatttttgtaatttggttttattttttctagtcaatgttgaatgtagctcgaccgccaaaatatgtgtggtatgtgaatggatacattgccgatttgtacctgaagcgtggaatcacatacacatttatgtacagttttaaataaattaattttaaaatatttaatttttatttttactattcgattaaaaaagttcgtttaatgtaaatttaaaataatttttttaaataatataaattttaacatttaattaacagtttaaaaagttaattaaataaaaataattttttgttatatttaattttatttttaatattagattaaaaagttcgttattgtaatttgaaattatcatttaaaattagaattatttttttaaataaatttaattaaataaaattaattttaataatatttaatttttatttttaaaaaagtttgtttcaaatatatgaaaattattaaaattacaattaataaacgaatataaattttaacaattttagcattgaaggcggccataacgaaacagttccagagctgtataacccgttctacctatccgatagtccatacggtgcttattccaaattaaacaatgacgagaaattggtaaaaaagaaaaaaaaagttttttttaaaattttttttcggtcttagaaagtaagaaaggtaacccaagaggagactggacgactttgcagatggactgaaacaaaattggatgccaacccggacgaattcgctactttttctgacttcagagacactcttttgtgcgatttgaaatttaaatttgtanaaataattttgcaaatttacaggcttgattgcgatgaatctgatcggncgtcagtgatcacctt

SEQ ID NO: 25506 - DNA, 776 bp, Heterodera glycines
aaaataaacgcgggaaaatgccaaggaaaataaaggggcaataaaaaaggaaaataaacgggaaaaactccaaggaaaatccctggggaaaatgccaaggaaaataaaccgcggaaaatgccaaggaaaataaagggggaaaatgccaaggaaaataaacggggaaaatgccaaggaaaataaacggggaaaatgccaaggaaaataaagggggaaaatgccaaggaaaataaaccgggaaaatgccaaggaaaataaacggggaaaatgccaaggaaaataaagggggaaaatgccaaggaaaataaacggggaaaatgccaaggaaaataaacggggaaaatgccaaggaaaataaagggggaaaatgccaaggaaaataaagggggaaaatgccaaggaaaataaagggggaaaagccaaggaaaataaacggggaaaactccaaggaaaataaagggggaaaatgccaaggaaaataaaccgggaaaatgccaaggaaaataaacggggaaaatgccaaggaaaataaacggggaaaatgccaaggaaaataaagggggaaaaaccaaggaaaataaacggggaaaaatccaggaaaataaagggggaaaatggcaaggaaaataaacggggaaaatgccaaggaaaataaacggggaaaatgcccaagaaaataaactggcgaaaatgccaacgaaaataaaccgggaaaatgccacggaaaataaacgggtgaaaatgccaaggaaaataaacgggggaaaatgccaagg

SEQ ID NO: 25507 - DNA, 2417 bp, Heterodera glycines
ctatttaaggaataccgtaatgccaatttgctactcttttcattttccctcccgttttattcctcaccataaaagtcgtatgttcaggtaggcaatgtcttcattgtcgtcctcctcaaaattggccgcttctttgatggcacgatgctcctccctggtgattggcacctttttgagaattccaaaatattaaataagtaattatttaattttaaaattctatttttaattttgactcattttgtcaccttttctctggtcattaaattctctcattttttaaatttcagaatccataaaatattaggcatcgaaagagtgtatggttgtgagcgtattttcatggattacccagaaatttctcttgcgaaaataaacatgtgcctagaaaaaaaataaacacttcctaggcaacaaatgttctctaccttcaatcaaattctccttagttattttaatttttgaatttggcgccaacatatcaccatggcattctgtttctaacaaataaaaaaattcactttaattttgctccttcttttttcgtctttttcacttccgtcacttgtggacgagctggagaagtgttgtttttgctgttgttcttggtggtgctggtgatggtcatggttatggttgttgtgtctgttacggtggtgatactgtcgttggccatggcaattgcaattgtcatggactgtcgacatccaaaaatgctgatcaaattttcgtgtcatattacgaattcaaattcggagacaatggcggaaggcatagtgtagcagagtaggtgaaataaagataaaaattggcatacggtagtggtatgtatttataaattaaaaagaattaaattttaattttgtacatgaaaaatttgatgcttatactttttattggataaagtaaaatttaatctacaatattttaagaaatttaaaaattaagcccaaaatactatgtagtaaattgaggatttttatttattctttaatctttttaatgcaaaaaactttgtgaaatttttctgccgaatggagaacactaaataatagaaatatttcttttaagaaatttatttactagtgaaaattactctttcatcaataatcataaataaaaaattaaattaggcgcagtcatttgggcatattattttgcgctctagcagcacaactaccccataaataataagtctacaaagatgcttcttgatggtaaataacgacgacagagcatgataagtcagaagatgtacacaatgtgggtaaataattagtgaaaattagcaaattaactattcattgcccccggcgtctctttcgccgcccattataaaagcgccactttcgctctcagcgacgacaaacgcgcatttttgcggtggccgcggagacggcggggaatgcgcggaatgaatcaatcattggagaaagttcggatcggcagatgagccgaaggatgggaggagtggtgaagagcagccctttgctgtgttcttcgctgatcagtgggatcaaaaatttacaaagaaaggaccaaaaatgggggaagagattcttttctccgatgcttttctcctcctcccgcctaatttgaggcgcttattattaatggaaaatgagctatttgtgcacaaaagaagcacagcaaaaagtctgtctgtgctggaggttccattgatgggaaaaaataatgtcggatcagatcagaacagcagaacgatggtcgaataatttggtggggggggcggctaatctaatgggaaattgttgcttaatcaacagatcgttgctaattgtataactctgatcaatatttaaaattgatgatgccattcgataatcataaatgattatcaattagcctgaatttcaaagaaatttattaaaattcaaaaacctatgagcagaagggttttaatttttgtccaattttttgaaacctaatctttttttttttgaaattttgcagccaaataatgaacccatgtttttgctaatgctaaatctatcgaataattcaagatctaattagttattatgaaaaattttaattataatagaatttagataaccacacaccaccataagaatgatgggaattcgcgatagaaaaaactggcaaaactttgcagttttacgagaagcacttgcgttggcacaatcttatttctacatgtggcagatcggagctaagaaaagggaaatgagacaaaaactgtttgaattgtatccatcgttcaacagcggcgaattattccgcagagacatcaccaaaaagcaccctgctgatcaactccgacgaaaagccgaccaccatcagcacataaatcaaagaattgggcggggtggcggaatgggtgggaggacgcggaaaggggagggagagagagacagagaagaaaaaaagaaata

SEQ ID NO: 25508 - DNA, 1686 bp, Heterodera glycines
tggtattcataaaacacaggttccaaagtcgttttcttaagaacggacaaatatttgatttggatataattttatattattaaaaaaatgttaacctgacgtgaggctggctcagacaagtggaagatgacggcaaggaagacgaaatgggccatgcaattggcgtacattttttaaaattttattttggaattttattttatgttttccaatgaaaatctttaaaaaaaatttttattttaacagtgctttaagtcatacacccataagaattttagtttttttagagaacgatagaagaaatgagtgctggatcaatcagaaagattttcatttaattttaacaattctcacttttttggcgaagatggaagaagagtatgggagatggagttgggttcggttacggtagattgaacggcggcgtattgaaacgaagaaataagaactgctggtgaatttttttgtttttctgaaattgacaaaaattcctaaattccttgcaatacatgaacacagacagcaattttgtcagtaaatgaatgaagaatgagtgacttttgctaggctttcattgcctatttatggacagacaaaaaaggggtggaaaaagggaaaagcagcggggaaagggccaaatcatcacatttacactgccctagcacattttttgtccgatcgctgggaaaagcgttggcaaattgagcaaaagcgatgaaaaaagggaggaaaagcgaaaatgggaagccgaatcatcgccaaaacggccgatggaatgccatttccggtggatgggaatggacaaatcggacaattttgagtttttttgcccccaaccgatcacaattcgctgggaaaagtgttggcaaatgaatggacggacgattttagcattaaaaataataaaaatattattttataaaattaaaaaataaaaattgtaaaaaaaatgaacaacagatatgtagtcaatacatttccttaaaatactatcataggtactcccttatttcaacgagaattcaacaaaatttaaacaacagtttaaaaaattttgcgtacatttaaattaaatttcatgtgatttttctatgaaatttgcagaaatcagtgtcaagaataagcaaataaaatttatctcagaaaattattctaattttctctacaaaattttgcgtcaaaaatttttattacatattttaattaaaaaattgtttttacttttttgatgttttatccaaatttctttaaatatttttctatttttcaagaatttttgaagttagttttaagaagaattggtggcagtttttaagaaatgcgccagcacggtcgaaaaatatcaaaatgcttttttttaaattaggtcaatagtttatgattaattaaaacttaaattgtttaaagaacaaaattcaaagataactaaaaaacatttcgttctttattcattaaaaacaaagtcctatggagcccatggaagccagccaccttgagaaaaatttgtagtttattagattttggccaaaagaacaaattttaactagttttgctaaaatccataaaaaaattcataaatacctttctttgtacattaaatattcttaaaaaatcattagcatttcccaattttatccaaaaaccacaaaaatccacaacatttctcaaaaaatcaggaaatcggca

SEQ ID NO: 25509 - DNA, 1249 bp, Heterodera glycines
tgttttttgtaatgtttcgttttgtgttgtcaaggactgttaatgcccgaattttcttctccattgtttttgttgttgataaatcctctgaattttgcacttctctcgggcaaagtcattatcatttgtaccattataacaaacaaattgggcaaattcccaaaatttaaattttgtgagggttttccatgaaattgactgatttttctcatttgttttcttctacacatccaatattctcaaaattgccaaaactcatccacgcaaaaaacactcaccacaaatgaaaatgcttttttgtggcttcatcactctgtcattatcaccatcgttttatcgttgtatcctccaaatcccttccctccatccttacacatttccatcctccatcaactgccgttttgttaaaaacataaaaattttttgtctaccacctccgaaaacattgcacctctgatgagccttattttcgacacaatcatcaaaattctatagcttaattagaaagaggtgtacatactcatataaataccatatttaaatatttgttttatcaatcaaatgatttccctccccgacaaagacaagcatttaattaaaaaacggtaaggaatggcatcacatttaattcaaacttgtttttttaaatacatcctcaaaaatggaactttttctctgtccgatgccattgcctttctgccgataattttttccaccttttttatgatgaaaatgacctcttccaatctccaacagatttagctccccaaaatacgcacagtaatgcttcaaatataccatacagtatacaaccaacgtacgaccaataattaattatatcacattacccttaatttacccaatgtttatttcttattttcccataagaacatacataggtagtacaattttgttagaaaaacgatgaatttcgactaaaaataaatggaaaattttattttaaaaaaattgaaattcgaatccatcgcctcacattcagaaactgtcaacacaaaagcaagaaaggaatgaatcaaattaatgtgctgtaaattctgttctgttactaccgtattttccctaccgtattcgcaaatgcttttttttattaccgtttccatcttccttttttgttatcaattccaatctgttgagcaaataaattttgttatttgctaatttgtagacccacacaacacatacatatacatacattaaccaccaatcgaaaatcatatttttattgcat

SEQ ID NO: 25510 - DNA, 1675 bp, Heterodera glycines
ttccttcttttgctgtccttcccctcattctctgatgtcgatcactatcacattaagtccatctccgccactttgctccgcccattttgcccatcggttcgcttccatgtcaatcggtccccgtctgatcagccattcgtcgcaattcgtggacaaatttcgtcgactcaatgccattcgttcgcgcgtcctttcgttttccgtctcaaatggctcaatgtcagtggcatattttagcagacgaagaacgatggcataactaacgggcgaagtggcacggagaaatgcctacgaaagggcggcaataattagcattgaattgaatagggaaagcgcatgggaaaatcgaaaagagaggttggataatggcgggaatgatcagtctcaatctcggcggaagaaataatctcataatcagtcactcaccagagattagaaaatgaattatcgaaaacaaaaagctgtccttttcaaccaaaatgccctctgatcagttttgccaactctgatcaattttcttccgccgtttgctgactttgcgcttcattaattgctcatcaatcacttcaatgagttcctccacttttgtgtcaatgttcgaaatgcaacaaaagttgtgacagtgcagcaaattcggccgccgtccgtcgtcccccgggcggacggtgtgcagccatttggacagcgcttggtcagagggagtcgtgccgtcgctgtcatcggccgtccctccgggcaccaaatcgcccgaacggacagagcgaagggcagtgagttcgcgcagaacggtgggcgaactgtgccgtcgcagcagggaaaggcattcggcaccgtaacagcccaaactgacgattgacggggccaacagaggccaaagcagcgacttctccaccacaaattgccaactgcgctggtggtcgtcaagcggccccaaactgacgcaaacgcccggggagagaagagaccgaatgagacggagaaaggccatcacgtcggggtcgacgcacctttgcaaacagcacaatgaacggcatggagaaattatgccgggaatttccaaagagttcccccggtaaatggcggatttaatccgtcggccgggttacgtcccactgattcaattaatggacaactcccagtctcattgatggggactaattgtgcaaatcccgtagttttcgcctgggatcaccgaatggtgatctcccggaagccgacaatgtaacgcggcggcgggtcgatcggcaatggaaaatattccgcgactccgtcggcgtacactttgacaatttgggcacagaagcgcagcgagtacaaagtgctgcgttggatgttgaagtggccaattgtcactcttcggcccttaaaatgggtgcccaccaaagcaccgaatcggccgctgagcagcgcaattttcagccaaagttcggccggggacaaacagaggaaaatggccagccaaaggtcggcacaaatcctgcaaaagttggcacatcaatcagcgcatttgggcacaaaatgcacgatagaatttagttggactgggtcagcccaaattgctttcaaatgtttcaacatctttgaaagtacattcgatttcggaaccaaaatgagatggcaattaaaaatgcgttagcacttgtcactgtttgcccttggcaatgtccgataatga

SEQ ID NO: 25511 - DNA, 2253 bp, Heterodera glycines
  misc_feature (21)..(21): n is a, c, g, or t
  misc_feature (71)..(71): n is a, c, g, or t
ttttttcttagaaaacttaanttatatgttttattattattgaaacagagagtgtcagtctccccccgatntttttctggatcatcgtcctctccaaattttttccaagttttttttttaaaacgaattttccactttttcaggtccgattttccgctgcaagaagtccaatgcttcatcgcaccggcggaacgtgaaaaaattgatgcagtcaccgcacgatcggaccgcgacagtctgtccatgcggtcgcagcgaagcggcagcggaagcaccgtgcgttttgttggctttatgccaagaaaaaaataataatgacgccatcaccagggttgtgccgtccaaatcccaaaatccgacccctttttctcgtcccctcaagtcccggcgctggcctgaaacttttcctgtctcgaatgctaacttttctggccgcattgacctgcctgaatccctgaatcctggcccgacatttttaagacccatgacaatttctgattaccataaccacaagccctaacttttttttgaattttaaaaattttcaatttttaagcagatagggcttacataatcattaaacgctgattagttaattagtgttaataaaaatttgcaattttttcagtttgaaacaatccaagaatgtggcggctccgttggtccaaaacgggacagccggacgagcattcgtcatccatccagcaggtgtgttaacttaaaatcccaaaatcttcgggtttttcaaaatctcggctttaacggcaaccaacatttaaactgatggacagttaaaaaatgccaaattaataaaaaatttaaaaaaaaaaattaacttttccctaattttcaaggcctccctcttcaattgcttcggctgactcacagcagaaattgcaccaaattgtcaacaacaacaacaacactgaggaggacgaatacattctcagcagcaaacaatgaaaaattcaatttcaaatttcaaattttattatttatttttattttttaattccgaaaaaacacttctcatccctctttctcactctctcattttataatgttctctctctctctctctctcatctctcgccgtttttttttgtcttattgtctcaccaaatataacactatttatttttcgtatggaccaatgaaaatatttttttcaaattgaatatgcttaaaatccccaatatttttttttatatatttattaatttatttttattttgccaacaattttatatgaaaatgttttttgttccctctcatttcatttttttgttttgtcactttatttttattttgaaaataaatgtttccgtcaaattttggttttcaatttgcttcttcaatcccatccaactccattgatgccgtcattaaactgcttgaggatgaagctgaaaatggagaaaaattatttttaaacaattaattggtaatttgcgggtttttgtcgacttttacaaataaaagaaattgaaaattctttcaatgggttttcaatttttctactttcagtttttttaaaggaatgtttttttttgcccccaagatggcaaaaagttgaacctggattttttgaaaaaaaacacaatctctaccgaaaaaaaaccgacaaaataaatgttctcagaaagcatcagctgctgtcgtgtaaaaatagcgcaatggttaaagcgcgccacagaaatccatgattgcgggttcggtccagggctggacgtaattactgattacggattacgggaatttttaactattaagggttagaaatcacagtatgcccgtctgttttcagggcaaaattttcggggggagcggcggggggactggaaaacttttgcgctacaccctgaaaattttcatgaaatattttcaaaaagttttggaaaaaaagaaaaaaaatgcatcaaattacatattctgaactggcatttacattaatcaatttttccttatcagtttagggagccgaaaattgtcaatagcaaattgatcatactctaaacggtaaaatttataaagagaaaaattatgggtataaatgtgccaaaaatgcataggttgctgtcgtgtaaaatagcgcaatggttaaagcgcgccacagaaatccatgattgcgggttcagccccacgagcacgcatttatttttatttaatttgacatgtttccacacagataattcaaataattattttttggtaaaatacctaactaattaaccaaacaataataattaatta

SEQ ID NO: 25512 - DNA, 1710 bp, Heterodera glycines
  misc_feature (56)..(56): n is a, c, g, or t
aagcaaaatttaagaccatttccaaagaggaaggaacaaaaatctttgcctaaatnttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgctattcgaatgagctagacgcgctctacattttcaaatgtatcaacaaagggtctaccgccactccctggcgggttgtttcctgacaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccaggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttgcctaatatttatttacactgttgaactgttggaaatgcagctgatgccgtcggaaaagctccgattttttggggaagtttttttctttcagtttcaccactgattgttgaggcaatttttttcgcccaatttcttttgtctacaaacgttatttattgcgtttcatcctgtagtgtgtaaaaaa

SEQ ID NO: 25513 - DNA, 1571 bp, Heterodera glycines
aacatggtaagcttttgcgattgattgataccaagctctccctgattttgtccataactaaaaaaaagttatcgtcctacaaccgccggaacgtcggcgccgccaaaacacgacccacactccaatattcacgtcctttttttgtaccaaaaccctcattcaaatgtggttttcttggttccattcaaaagcttagtctcaagaattatttttaaaaaagcaacagacaataagaaaaaacacacacacagtgacaaaactacaaattcaactcttacgaatatactcaagtacgactttttgtctgttgttatgagaacccaaaataagttagacaaaaacttctaaagccaaagccttttcgattgatacccaagatttagataccaaggattaatttttctgtaaatatgtcgtctgctactgaaaaaatacttctttttctgttcgtcgttgctcaacgaatcggcgatatggtaaaaggaaggtgagggggaataaaaatgaataatttctagcccaaaaatatggacctttgcttttttagctgttcaatccctcaaattgttccattgtccgaatacatttttttttcatttacagccccccaaaatggaccgtcgcgtcagcctggagctgctcgacttgcactgcaaccggttgccggacgaactgttgcggtgccgcgtgctgcgcacgttggacatcagcgggaacaaattgacggaactgccgctgaacattggcgacctgcaaaacctggccgagctggtgctgtgcgagaaccaaatccggcatttgcccagctcagtcggtcggtgatgcctcatcaattaataatattatatttaaaaaatgtagagctgaattttgcaaaaacccggacccggatttccgttctatggggtttttaaataaaaagtgatttttgtctttctttttgggaacggtttgtttcgccccgccatttttcctcgcataaattaaaattaaaacaaaaaatagatatttttttttgatttgttttcagctaggttttttcctaataaaaatatttttttcattcttaagaagggaaaacgcattgcaccttttttaaaaattcatggcccccatttttgcaggccaattgaagcggttggaagtgctgaagtcgtccaaaaacaatttgacgctgctgcccccgtcaatttgttcacgtgcggtgctcaccgatttgattatgtgcgacaatcaactccagcagcaggttcagcaccaagggcgtagccagacccttggctttgggggggggggctgaagtcaaaaaatcgatttttaggggtgtatttttgcttttttgaaatctcgaattagggggtgtatttttcagcatttttcgccaaaaaagttgttattttttccattttggcctccatttttcaaaaatatggtaaaattggggtccggcggtgccgataggggccgccgggaaaatttttgagtattttaatgcaaatttgttcagaaaattgcttaaaatttcaaaaaatttactgaaaatttttcactttttgggtttcggggggggg

SEQ ID NO: 25514 - DNA, 1688 bp, Heterodera glycines
aattggtataaaattttcaaaatatgtaaataaagtccaacttttgttcgcaaacacaaaaagggaaagtgtttttcgtactacatattcagagcatggagaatccaggaaataaaaatgtatttacataaaattgccagccctaattgtatttttcccccattaggtagctaatgacataattttttggacaagaatcgtaaaaaaaaaattgttggagcgtagatattttgtgtaaacagaatcttcggggatgggaaatgtgaatagacatttttttttttttgtaaaaagagaatcttcggggatgggaaaataaatatgattcattaaatttcattacaaaatacatataagttaaaaccaatccattcccatcaacaaattcattgaaaaaaaaactaacgataagggtggctggcaaacagaggtcgatttttaataatgattgtgaaaaatttaaataaaataataatattaaaaaaaacatttcaaaaagaatcattcaaaattggaaaaaaaaacgttttttgagagtccgatgaggcttaatttccaaaatgaggctttttgtttttttttctttattatttaaagctttatggggttttgggaaaacctgcaaaaaaagtcattgttttgttaaaatttgttaacaaattgtattaaaaattgcaacattttccccagaggtgtcttctataggcaccgccaaaccatcaaatcatttagttttttttacaaaatatgagctaaacctcaaaaataaagtgttttttttttggtctaaatctgttgtaaaatttatcgtaattttaaaattttcccggcggcatcgataaatttttttggaaataacatgaacaaaaattgtggaaataatgaagtcgttggcccatatacctaaaagtcaaccacgttctttttttaaaaaaaacaatgaaaaaatgaaatgcttataatatttggttttttttttctgtgctctttaaataaatttcttaaaaatgaaactttttgttttttgaatttttaattggcagctaaaaacggaaaatgcttagaattaattacatatttgggtataatttttgtaaagtataattgtaattttataaaaatataaaaaatttatgcaggcaaaaatttttcaattaatttttttgcttaatttttatggtccacacaaaagtcactggcacattaaatgttgtaaccaatttattgggctttgtgtggtcatcgctcgcgcacaatagcaataacaataatggctactacataaattttcttttcgggacagcgaattctcgcgcaccaattaaaatttgggttgggttagtcataaatcaaaaaaaataaaaataaaatgaaatttacgacgacgcacataaaagcggcggccgcaccaatgaagaaacaaaacatgtccataaaatgtaaaaaaaagcaaaagatttatcgtaaatatgcacataaatagtcaacagaagggagtggggacaaaattataaaatcaaattgatgaaaacaaattatttaaaattttgattttaaattatttgaacttttgataaatggaatttaaaaaaattaggggtgctaaaaatacaaaagttcgaacgaaattttaacaaattaaaaagcaaattcaaacaaaaaaaattttttttctgattttatatata

SEQ ID NO: 25515 - DNA, 1889 bp, Heterodera glycines
aaattttatcatttttttcttttgttttttgcccttctcagagtgcgaaatccattatcgctttctttgctgttgacgaggtgattgaaacggcatgagaattttcatcctcctcacctccggcatcatttcccgaggcacttgcctctttttccttttccttgttcatccaatcccggaaacctttgccacctctgctgcgctttttcttcttcttcctcctctttttattcccgacatctgatgatgtcccaacctgttcttcttccccctcctcatcttgttcctcttccctctcctcctcttgttcctcttccctctcctcctcttgttcttcttccctctcctcctcttgttcctcttccctttcctcctcctcttctaactcgaacacaattttcttcgccattcgtcccgggtcagcagcgaaatcctcgaactcgttgatctggttgagcaggtcaatgttttcattgacccggcccaacattagtccatcatggacctccttctctctctctctcttttccgtctcaaattcacgcacatcgtttgagtcctgtttttttaacttttttcctattatttcatatttttcttacgagttgattggtgcccacaattgtaacgcctggcccaagtccatgccagtcgcgttcactcccaatccacttcacggcgtaatgactatacaccaaatcacagtccgggcaatggacatcaatagggcctaaaaaatttctcttttgaaaatccccattaaaaactaaccgtccgtgattcgctctacgacggcatccatgccatcgtatgcttcgcggtggagctctggatttgttatgcgcaaattgacaacgcaagcggggtcgtgctccccttggcatgcctttgcgcgtatgttgtctgcctctattgctttaatagcttgcttacgtcggcaatcctcgcaactctgattcaagcagcagcgtctccgttttggtggcattttttaaatcaaaaaatttttttatatttaaattaatccaacttaattaaataaagacataaaatgagctatacatttttaaaatattctacttaatttctatccaattcgtcccaccccatatttctgtttgatttgacttagtttgacctcaagcaaattctgtcacaatttctcccacacacacacatattttattaatcttttactaggggcatattacgcctccaattcccaatgtacttattcatttaaatttatttgttgaaaaatttcctcctgtcctattttacaacttttattctttgttttttttaaaattttctttttattaattcattttcaatttgtatggttttaaattttccgcttttttctccctttcataatttcctttcatacgaattttctcgacaaattttaaaatttattgcccatccactttggtgaggccggtgcttttcagcgctggctttgggcttctctctctcattctctctctgcccacccactttgatgaggccggtgcttttcagcgctggctttgggcttctctctctcattctctctctgcccacccactttgatgaggccggtgcttttcagcgctggctttgggcttctctctctcattctctctctttctctgcccatccacttgtgaggccggtgcttttcagcgctggctttgggcttctctctctctctctttctctgcccatccacttgtgaggccggtgctttttagcgctggcttttggctttctctctctctttctctgcccacccacttttgtgaggccggtgcttttcagcgctggctttgggcttctctctctcattatctctctgttcacccactttggtgaggtcggtgcttttcagaacgggctttgggctt

SEQ ID NO: 25516 - DNA, 2069 bp, Heterodera glycines
  misc_feature (38)..(38): n is a, c, g, or t
  misc_feature (48)..(48): n is a, c, g, or t
cgactagtaagctacaaaaaaacttctgcaaacatttnaccctctacncaagccataggtacatttatatgtatacttgtattttttaaatcctaaatctttttgatcaatagacatctcatggaaaaatggcttcatcaaaaggcttctttgtatgacaattgctgccggttctgtggggtttaccttcggattgtacaattatttgccaacaaattttcctctgctcaaaatatgccgcctaaaagaaaaacagtcattatcatcgaatgcgtttggaaagccgccaacacgggccgatttgcccattttcagcatggaggaagtgcgacgccatgggaaagacgctgacagaatttgggtcattttccaccaggtagaacaaatatcaattacaaaaaaagtagacacaaaaattatgtatagcaaattttttagggggtttacgatgtaacagaattcattgcaaatcatccgggtggcgacagaattctgctggcggcgggggcctcaattgtaatttccatttgcgtatttaatccggtattagcattcaggaacctttttggacagtttatcctcaacataagacggacgaagtgatggaaatattggaggaaatgcgaattggatcgttaaggcttgaagatctccaggaaattgaaacccagcaaaaagtttccgccaattcaatttcacaataaaatacattttaaggatgctccgtcgggtgatccttttgctgccgacccgcctagacatcccgcattgatcgtcaacatgcaaaagccatttaacgcggaaactcccccgtcgttgctgatcgacagttttctgacacccaaagaactgttcttcgtccgaaaccacatggctgtccctcgggtgaacattctctttgatcgatagtcttgaatttaaaattaatttagcgctttcctatcaaaaaatttccaagtttttaacactttaattttagacaaatgaagaaacgcacaaagtgcgcatcgatgggattggtgtggataagcaaattgtactttcgcttgaccaattgcgcaacaatttcgagcccgtttcaattgtttccgccattcaatggaaattttttttttgcagaacatttcacttaaaaaacgacagcacaggaaaaatgctttttgaaattttatttttttttcgtcgggaccacaattccacaccattgccaaataatgagtctaacaatcaacaaaatgttcagatttatcaatttctaatctatgaatataatgaagataaaaacattttcggtcattttgcgtgacaattccaacaattaaagcaataaaattaatttgtatctgttcgcaacggtgaaaagcgagtcgtcaaatatttcggtcgtattgtcaaatgcattcatcccttgaatcatcgttccggcaagaccaattggaattgaacacgacttaaagggaaaaatatttttaaagccgtgaaaaaattaacacgtcttttcgtgaaaatctgggttagggtcagtcggaaatccgggtggtccaaataactcttatgatagaaaatactaattatttagaattagatttttgcggctagaatgcgttttttatttcttgaaaaaagtttaattacaaatctagattaacttagtgttgtggaattactttggcaaaccacatacggttgtggataaacacaaaacttcgccaaaatgatcgaccaaataagtaatttccgaaggcaaatggctgaccaacattggatttagacaagatctgactaaggtcaccggttccaccgagagcgtacagttggtttctgcaagaaaaataatttcgaaaaattttttataaagtgaattatataaacaaaaagtggaattttttgaaggacacctgggttgctagtgaaaaaatacattgaatgcgcccacttgttttgagtgcccagtaataccaactttatcgccttttctagggcaccgcggtgctgttgaatctgtgaccgggacaaagccagacggtttcaagggtcttcttcctgttcatcaatgcgagtgattgcaa

SEQ ID NO: 25517 - DNA, 1299 bp, Heterodera glycines
tcaaccgccggtggtcgtcgctgtttttcgtcgccgtccttgtcctcatcataccacgctagggcgaactttacgacttgtaagcattttggagaattggcgtattttttggtcactattctttccttcctacccttatcgtttccaccgaaatttttcatgaaaaaatttcaaattgaaattttatagaaaacatgaaaaaaaattttttttttttttttgcgattttttggaaattttttttttttttgtaaaactaaataattttcatcacaaacactatttttttcttaaaaatttcgagtatggaggaggggctcttctgggtgggagcggtgactatgcaaaaaacaaaacaaaaaaaacggtcaaaaggaaaaaaaatttttttaaattttatttgtcccattttcagcctcaacctttgcaaatgcaccaacaaaaacaaagacagaagaaggagaagaaaaagaagcaacaacaacaaaatgtaaaaataataacaacagcagcagcgatgcatttgacgacagctcatttcactgcccgtacattttgacgatggatttcaaatcgctcggttcgtttcagaagaatgccacacaattttttttttttcaaatttgttatttgtacccttttttcttacaattatttagatccgtcgttggcacttgggtttttgacacgcgacttggcggagtacgaggacctagtgcatcggcttaaggtaatgccgccgccgtcccaattgttaagaaagagggaattggtttcgaacatacatgtgcaaggggtgtctcagcccaagggccatacgacggacgattgggacagggggggggtgtctcgggaccgatttttcatacgaaggtggtccattttttctccggcgattaccttttttcgttgcttaactactttttttttgcgacgcgttttttccaaaaaactttgaaagggggggtggggccggcggagtcgagaagtaccgccggaaaattttttgaattttgaaataaatttttctaaatttatggaataatttctcataacttcttcatacttgctagattatagtaacactttcaaacatgactaaatatgctattaaaaggcattttataagaaaaaacactgtaaagctaaaatttattcatttttagcgaaaaaccaacccgaaaacgaaattttacttttttttttgtttatttttgacctaaaatttaaaaatttttagaaaaagtaacattttattccatatttttcgggaaaaattttattaaaaaatgatttttt

SEQ ID NO: 25518 - DNA, 999 bp, Heterodera glycines
tttaattatttcacaataaaaattcaagtgaaaaagccgtttccgttgtgatatggcacactggcgaccaattgagagacttgcctcgccatcgtcgtgctgagcaggtgaaaattattattttttaaatttttcgacataaaattttataatattttgccttcatttagctgtatgttatgatgtcccatgaggtaattagtataatgataattaggttattgattattcatttttgataaacggacaaacaatgggtcaaatgcaaatacacaattttttaaaattttctaaaattgatagaaaattgttaatatttttaaaaaacataaaataaactgatgcaaacattttgaaatttttcttccaaaagataggatttttcgtgaaaaatctcgagttgaaaaatttccgggttttttggtctcggtttttgagccattttggccaaattcagcccagtggccctttcgctggctatgaacctttcacgacacattaattatttaccctaattaattaattcgtaccaaaattaattaattacatcaattattaattaattgttttcctcctcacaaaaacagagtccgctccttggcagtgcgaactttgagaaaatcccttacaatttcttcaacatttccatcacttatcgaagggacagcaccattcacatcaattttggtgtccagaaaatgcgtcattggatactgtatttgtacaaaactccctgttacagtaacttggttttttaaacacactgtggataattgacgcattttctgagagagtgctgccgccctgtggccactttaaaaccgctacttaattttatgacaccattatttttgtttttgcacaaattcatcacaaaaatagctttggcttttccgggggtttggggttttttgcgcaaaataaataatgaaaattaaattaattttaaaaattatggcaaaaaaatcatttaacaatagagcacgcagcactatcagt

SEQ ID NO: 25519 - DNA, 1683 bp, Heterodera glycines
aaaaaagttcgctaatccacgtttttatactattgacaccttcaagattcacgaaattaagatttaaatgctcaaaattacgaattctttaattcttaatttcgagattgccttcaattttttgggcggtaaaaaataattttttgaaataatcgccccaattttacgtacgttttccctgttttggggtagaaaatgttgacgcatttgtccatacagacggggtcattacgcaatggaattttgccgggcaggcacgattctgtgacatcgtctcgaccgttgaacaattgtctcgagacagccgccaacatgaagcgctaaaggcggcatgggacaaatggtcgactcaacgatattttaccaaattgggaaattcccaaaggacaatggccaaaatttgacaaatggtcaatctttgtcaaaatttgggccaaacgggacaaatgaaaaaaaatgatatgcttacggtgccctaaatgtcaaatggtaccgaatcgctttgagcattcaattgccatccgcacgtgccatttgtattcgacacaaacaccgagaaagtgccgttgctgaacggcttgttcaggttggccacaattggcccgtcaagctcggctgtcgacatgcacgtacgttcagtgccgaactggggccgtaccaccaaagtgttgttaccaccgccgccgggcgacaccgttggtgccaacggcgacactgtccgttttatgggaaattggaatatggtagcacagatactgtattagaatatgtagcttggatacagttttatctatattattccaaaaaaccgtttgaatggtccaggtttatcatttttcaagttttgcagaattcttcggtccttaaaatccaaaatttaaaatcccggacataaccaaatttaacatgtgaaacccaaggattatttttaaatttttaacagtaaatggggcgtttacccgttccgacggggaatgtaccttcacggggcgtgccggcacgagttgggctcgacagaatggcactgttatagttgttataattaattgggtagaacttttttgaaaaattggcaaaaattgaatcggataaaaatagtttcatcgaaaattcaggctatgttcaaccattctttttttaccaatccaattttaattagtttcatttgatatttggggaaaaacagcggtcggcggaagagcggaataaatggcaataggtaatttaaaacatgctttttagaggagaaatgttaaaaaatttgaactaataattcatttatgcattaaaaaatcacacaaacagcaaaaattaaaaatcataaatatttttaatttaagtttaatatatatgcgaaaatatgtgcttgggctgtgcgagactcttttcagtctcgagtctcagttagagaaaggggaagaagaaaaaactcgaatttatttttttgttctttagcatcgggaatgaattctcgtccgtggactttataactccccccccccaccgattttttgacctttttgcacttctgtcttttatatattcgctgtgaaaaaatttcaaggatagggtacggctacggccatccaataggtagaacacgggaaatttttggcattttgtataatttttaacagattttcagaaaaaattgttgggtcaaatttgaaaatttaagggaat

SEQ ID NO: 25520 - DNA, 1373 bp, Heterodera glycines
ccctccttccccactgctattttcatccttttcctcttctttctccccctccttgcttcgaatttttcctttttctctctttctcttccgtctctcctccttccccactgctattttcatccttttcctcttctttctccccctccttccgtcgaatttttccttttcctctctttctcttccgtctctcctccttccccaatgctattttcatccttttcctcttctttctccccctccttccgtcgaatttttccttttcctctctttctcttccgactctcctccttccccaatgctattttcatccttttcctcctctttctccccctccttcttccgtcgaatttttccttttcctctctttctcttccgtctctcctccttccccaatgctattttcatccttttcctctatccgtccaattgattatttgatcgattgatttgtgggtggggggataaggtaaaacgcccggcaaatggtcatcattttgcaaaatattctctttgttggtcctcctctcctcttctgttgcgttccctttttctgtgtttttcgagcttctcaaattttgttttcattgttttccgctttgttctctaattataaaaatggtactacaggagtttgtatccacatttttggtcaacattttttcaaattctttttttggtttaaaaagttcagaaaacaagtatccgccgggggtttccgaggtcgctgatcaatgatcacgaatatggaatcctcttgattttctacttctttcccttggttcaatcactctgcagaaattcaaatattttgattttctttttgttcatgggttcctacatatcgacaagctatgcttcctcatacttttttttaattgcgcatattttataatttttttaaagaaaatccatacaaattgagcccagtagtccaaaaaaccagccttttttgttgaaattcgtaaacaaatctcactcaaattttcaaaatttttccccggcggcgcctaactgcaccgccggacccctttcttcccaaaaagttttttggaaaaaacgcgccgaaaaattatgtgaaaagcaattctggatttctaagattattcgatcatttagtccaaaatgattaattgtttgaaataactgaagtaaattcgtttaaaaatttcattaatttaatttagctttaacttttagattttataaaataaatagcaaaataaaaattaattttgtgttattttcacttgaaataaattaaaatttgattttttttttgaatttaaaaattcccggaaaaccaaggtcccgtcccggcttctcaggtcccggtcccggttttgcccaacattcccggtccgctcaactctacg

SEQ ID NO: 25521 - DNA, 2068 bp, Heterodera glycines
ataagaaaatgattaaataaaaatttctcaacagaggactttacttcccattgcgctttcaagagtgataaatcaaaaaaatttatttttcattacttattatccatttaaataataaacatccaaaaagatactgtcaattatccacttcaaaaataagctacgatattttttattgaaaaagttgataaagtaaaaattaacaaataatgtaaattaattttttatcaaaaataaattctaaaaccatgaaaatgaaatcattaattaagtattaaaagtgaaggacaaagaacacaaaacaattgcctcattaaataacgctgtttttgaagagtaaataaattttttaattaaaaccaaaaatttctaataaaagctttttgaaaatttattaacagttttaaaagttcttaaatttttattcttttgatttaattaaaaattcaaaaataaataataaatagatgaaattgagctttgactaaataataattaaataataataataaatcacttttccatatttgcttttaattcacgccactttacaagagattcaaaatgatttacattatttaaatgtcaaatttttaagtttaattactctaaattaagctgtatgaacataattgtaaatttacaaataaccaatttataaattataattataaattttttttaataaaaatgtaaagaaatgaaaaattaaactatattttatgggtgctaaaaggaatgatttaatctttgttctttccaaaccaaaaaaatttaatttatttactgtaatattaaaaaatgcaattctcagttttatatttatctaaaaatattaaataacattttttatcatctgcttctttttatttagaagattgtaaaaaatcattattgatttttttctaatttattttttcattgtttatattcctgtccatttttctctttttttatgcttcaaaatgcttaaagaagcaacgtacgttaaggcactcatttttatagaatattaaaaatttatcaatagtaatcttggcataattcgattagatgaaaatttactatagaaaaaataaaataccaatataaaatgtgaaattttaaacattttaacctattaaacaaatatgtgatttggtttgataataaattaacgatacatttaaaaaacaattaaaaactcttaatcatcattggaatcacataattttacaaaaacaaaagtaaaagtggctaaaaacaataatttatataattttgaatttattcgttcaaaaaataaatataaatcaataaaatacttttttaatattttggtattacatataaacccctatacctctcctattttgggtgttcgaccttgaaaatccctattttttaattttcgtccctaaattaagtttgggccctattttgaaacaaatttattaaaaaaggtaactgaatttttaaaaaattttatataaaatatatgatacataaaaagaaataattttaaaatattttcaatcatataaattgttcaaaatttgattttttttttttctaaaatattcttcacaaaaaatatcagtgaataaaatgataaaatatacaatattagttatttttataaatggaaaaattagtttaataattcttatattatttattcatataactgtgcagaaaggcaacaagtgaattaaaataattttaagcttaaaaatattttactaatgataaaaaagaaaatataaattaatgatcagaaattattgtatactaatatgttcttggcaaagtgttttaaagggaattgttagattgatatattttaaataaatgaatatataaacgattagtcaatgcataatttgaataaattcgaatatttcatttaaatcatgacatgtcaatctttttcaccattcagcattgattcagtttatcttttttcttttcagtccaaacaatttaaagttaattttttttttattggattcagttgaaattagattcttgattataaaattttttaataatgtttttaaaaattttctaaattaatatatattaattt

SEQ ID NO: 25522 - DNA, 1133 bp, Heterodera glycines
atcagaaaagaggatagccgttttcccaaaattttcgacatcaaactcgcccagaaagaatttggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcaacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcatactgatgatcagaaaa

SEQ ID NO: 25523 - DNA, 1570 bp, Heterodera glycines
  misc_feature (1531)..(1531): n is a, c, g, or t
  misc_feature (1536)..(1536): n is a, c, g, or t
aaagggtaaccctggtgttaaagcgtgttgatggatcttctatagaaaatagtttcagatctgttcggccataaacacttttatgcgccatgaacagatcaaacagctttcgcctattctcaagtgttggcagttgcaggtattctaattgtctccgccaccgaaagaagaagaagcgggacaaagcatcacaaaagggcgaaatgagtgacggacaaaacaacaaaaaaacaatgatcagccgcagaagaagaagaaatgaattaattgagaagaatgactgactgatcataattaaatcagtgatcaaatgcaatttatgaagaaaaacctcttaattggtaaatcaatcggatgcataaaaatggcttgctatctatcgagtgtatgaatttctctctgcttgaaaattgtgacattaattttcgggattttgacgggggatttacgacgtccattagcaattagcacaggcaatattttaaaaagtgtcaatttgctgctgttcctctctcttttctgcttcattctttcctctttcttctcttccttccgccgaatttttccttttcctctctttctcttccgtctctcctccttccccaatgctatttccttccttttccacctcttcccttgtttctccatttttgctgttatccatcttcatctccattcacaccaaaatttgcttttgttgttgctgctgtactgcttgaacttcttgcttttgttgttgttgtttctgatggtgttcagctgcaattttctttttcctcttcttcagtttctgctccttttctcctctcttttccccccattttctcttccttctcctcccccttcgctgtttcctttttgctgttgttgttgatttggcgttttcttccgattgtttggcgccggcactgatagtccaccaccagcagtggagccagttgaatgttttgatttcgccttaaaatgccatttttaaatctgtatgccatggaggtgttcggcaagccataaatgccggaatgtgtaattccgtcgcaaaaactcccggaatgcggtcccaccattgacggtatccggattacggacaatccgtcagtggataatctttcggaagacaattctattagtgacggacaattcatcagtgaagaacaattcgtcagtagactgacgttccgtcaaaggacatttcgtcagagaattaaaaaaaaaatttgttgacggattgtccactgacagattgtccataaccgacggattgttttactgatggattcccactggcgcacatccagtagcaactttttccaaaaggcccaccgcttactgtatgccaactagctacagtatattattgttacaaaaacccatcccaagctacagtacccttcccctgctaccgccgccgtcctcctggtgggtgttgttgtgctgtcctttttgtgccgcatgaagtcgatcagtctgtcctgcacaatgtccggctcggaagcagcttcatcttcctcatttcgtgactctgtcgaaatgnagcgnacaccgccgcgccagcaagcgatcgaatcttttt

SEQ ID NO: 25524 - DNA, 1078 bp, Heterodera glycines
tttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaatttctcaaaaaaagagatagccatttttctggaatatctattaaatataaaaattatttgaaaaataaaatggccatggcgcaccgcacttcgtttcatgttcgagagcgtttgttgcatagaaaattctcaaaaaagagatagccatttttctggaatatctattaaatataaaaatta

SEQ ID NO: 25525 - DNA, 2321 bp, Heterodera glycines
  misc_feature (68)..(68): n is a, c, g, or t
  misc_feature (105)..(105): n is a, c, g, or t
  misc_feature (146)..(146): n is a, c, g, or t
gcccgatcatcttggtctttattatatagagtgcagcagaaaaagtcagatagtcctatacatatacnacataaaaacggattgactaaaacgattaattttagncgaaatgatgattaaaactcgcgatcaaaatggaaaacgancctccatcccatcattgagcgaccgttaaggtcatacaccgcgtcatcagcatcacgaggatcgtccaactcaacgaaagcatagccgcgctaagaacgaaaaattgaacttggagaagaatgcaattgatgcattaaaaactgtctcttcccgcccaatggatgtgctgctatcacacagaccttgatcagaatgtcgcgaatccgtccatatcctttaaagaagcgttcgacatccctttccctggcttcgtatggaatatgccccacgtaaattcggctcattgtggtgaaattggtaactcttttttaaaatgatgagtattcaaggaataacaaaaatgtctgttctataaaaaaagaaaatttgatttctatgagttagttatgtgactatgtgcctaagggactattaattggaaaagaggaaaatcaatgccagttctgtgagtttgtatggaagaatttaaatttgtcgtaatgtttttcatacggtatttctctattttaaaaatcagaccgaataactgttaataatgtagagtagaagccagtctggattcccgtggcgggaaagtggaaaccccagtaaattcccgtctttttttgccaaacgcttttatacaaaaaaattgtttcaaaaaattatttattttttctattttatgtatgcttaaatataaaatatttttatctcagctcgaatttttgtccttcctcaattgcgattctcggcattattctctcagtcttgattctcgataaagcaatttctcgcacttccctagtttcattttgcccacacaatttgcacacattggcactgccattcccttcccacgtcccatcgaatggcaccgccattccattcaatgtcccataggatttccgttaagtcattcgcaactctgtcaaattttctgccggtcaatttgcattaattggttaagtaattaccatttcttatccaaatttatccttatttgccattcataggacaaaaagggggcaattgcctggggcatttttgacgaggcgaaaaagtcagaaattccaaacttttttccctctcatttcaatcccccccccctccccctgctgattctctctctctctctctctctctctctgctcattgctcaaatcatttttttgttgtttttgatctgcagctttcggctgatcaaaatgaatgagtacttttgcacgatatttgaaaattatacaaccgaacgatgtcctccgggaggtgggaaagaaggaaactttaaaacgcatgttttacacaccaatcacattaacacttcaaatgtatggcagagaatgaactcgttatgtattttcaccgcgagaaaaatgaaaataattttatttttgtcttccaaatttggtttttacgtgataataaatttatacgaaattttttaaatttcatttttctgatcttctttgccgtttttgggcgaaattcgtttttctccaactgatgaagtgaaactgaataatttatcaaatttcgtagttttatttttttgccatcagatttatataaaattctttcgccaaaatctgcccaattttatccatgaaaaagtggtggattttcttttgttttgtgcttttttgttgcagcaaacgccacaaattttgcacaactccaaaaacatcgcttcgggcgacgacccctcgccctttcatttcatttattcatttgctgcccctttgacgagttttgggttccatccgtccgtcgatgggttgccgaaaaacaaaaatttcgtcgtcgtcttcgttttggtgtgtgtttccaaaaatagcccaccaatttgtcatagtcagccgccccctacggctgccataacgcggcactgaaaagtgtgcacagtgcacgacgacgacaacaaatataaactccaacccaaaccaaagcaccaaatcaacgccaatgcgtggacactcatttcattatcatcaattaattaactaattaattaattatcggctgtttattgtttgatcggtccgccaattggcggaagaaagccccgaggggcgccccgcggtgaattcgtcgtccatccgccggttcccccaattttcggcgtccattcgttcgtttgtccggctgttgtgttgcagcaacagtgcatttggagaaatggatgaatggaagga

SEQ ID NO: 25526 - DNA, 988 bp, Heterodera glycines
ttttcagaaaaaatgccttgtggtgaaaacaatatttcactttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaaccccattcaaaaaaggaaaaaaatttgcagtcaaaaaattattcgaatttctccaattttgttttcataattttccgaaagttattcggtatcataatgccaaaacaaaacgaaatcggtttaaaatattcctttctggacttgact

SEQ ID NO: 25527 - DNA, 1429 bp, Heterodera glycines
acgttaactattcttaagagtggggccatctggttccctcctattgtgttttcgattaaatttggtgcataaatgtatctttgccttacacctcccgtcaaatccggcatataagtcgcctcttccgcgtgaaatagccttgtattcttaaatcccagaacatatgcgaggtgttttgacaaatctatatgggtgacggcagaggaaagatagacaataaatttttgatcaatactgtcgtagttaaattgaacatcctcattggctaatctctctcgtttttgcggccctttttcagcttctgaaacttctttattttcaatttccttacgtttaaaatgctcaccgagcgcctcgttaagcctaaccaccatcccgctaaaacccttttccgatttatcattatattcctcgagagttgatgtatatttggtctttgcctgtctggcgattccctttgcgacgtcggctgatttctttgcttctttcatgtcattcttttccacatgctccaatgttatgtttttggctttatctacttcttcttgaaaagatttaagttcatttcgggatgtttgaatttctgttcccatctcaaccattttgtcaaaccaaatttttatatcaggctcttctaaaatttgaggatttgtttctcgtagtgtgtttagttgggtttggatggaattcgatatattgttgatctgattaaaatgtctttctacgtctctcccggcgcgttctgcggccctctttgcgacatcaatttttgagtctttggtatcttcagccttggcttctctccttccacgttgttttttgattttgtaatgatgtgtgaatgcctcgttaattttatttcccaggcccccggcggttttaaaattcatgtccggtaaataaacttgagtcgggacactgctgtcgttttcccatactttaataaactcttgaccgtttgtaccgagtgccccgaaagcgcacggttccgagcgggtgtttaccgcacaaacccaaacctacgggaggggtgttttcttttgaaatgtgccgcccgctcacaaacccatgcctattggactacctctgaagctgccgccaagaaccaaaccctatgggaggggcgcaaccctttgaagttgccgccccatcaaaacccaggaggggaggggtgtgtgttccaaaccaaacctaatgtactccctatgaagttgacgcccgtggacatttaccgccaagaaccaaatcctatgggaggagggttgcatcttttcggctgtacatccgttttaaattttaacgcgatgtgccttgtgcagcggtcaagtccttcactaaagacttcggcgaaactttggagcacttccgccaatttactgacgaatttggtgtccccgaatttgttgcaccattccaattcctaacgctt

SEQ ID NO: 25528 - DNA, 1434 bp, Heterodera glycines
  misc_feature (22)..(22): n is a, c, g, or t
aaaatgccataaaatgaccaanataggcttagaatcacattttagtactttattaattaatttttggtatctgttttatgaaaaaaaaattttgatttttagagatatatttttcaaaaatttttttctagatttcacaagaaatttctatatgaaaaaaaatgaaaatgcgtacgaaaaaattgcaaaattttggaggggcacctaaaaaattttcaaaaattgcaaaatatgtacaagaaacatgcgaaaaagtccaaaatatgtataaaaatatatgtacatatatgtaaatatgtagaaaaatcccaaaatatgtaaataaaagtcccgatttttgttcgcaaacacaaaaaagaaaatgtttttcctactaattaggctgtagaaaatcgaggaaaaaaacatgtatttacataaaaaaagaatccctgataataaaaggtgtccacttaaaccaacaaaaacaatgaaattatatagattcttgtagagtataataatattacagctttcgaataatatgtatatacaaaacctacgaatgttaaatttagctgacctttaagcgattttatgattttgttttatgtttttttaaatttcatttacgaattttacgaaacgagcaaaaaattttttttacttctttgtgatttattcaatattatattcatggaagaattaacgtttgaatgaaatattatttttaaactttgttttcttataaatcgaacaaaggttctgagacgatatggaacacaattttttcttaaaatttagctactttttttttttttttggaaatttgggtgaggaaggccttgaagaattgttttaagaattggcgaaatgttcgaaagaaaattaagtggcaggcagcgccgggaaaattcttttttgaaactttggccagatttgaaaagatttttatcatacataaatttaagaaattagaaaaaaaaatatgtcactaattcctaaaacagaaagctcaacagatgggacctctggattaagaatattaaaatatggaataaaaatttcaaaacatttccgtctctaccgaattctattttatttatataaaataatcgttcttttttgaaaggtttttttttcggataaatttgagtaaaaaataaaatttaggatattttgaaaaacaattattaatttttaacggctaactgaaaaaaaatttggcgattttacgctcaagccgactccaaccgaatgcaaccgctggcggggagcatggcgatcgcgttagcgattgcacatgagggcgaggccattgccaggccaatgcccatttatgggacagaccccattaagggcttttgtcccaaattgtgtccttatggccattagccacaaggacaaatatgccactagcgcttattagcgccagcgactatttcggctccacgt

SEQ ID NO: 25529 - DNA, 2169 bp, Heterodera glycines
  misc_feature (27)..(27): n is a, c, g, or t
atcagtgcttttcatcattttgcatcncgacaaaagcattggcataattagcggtcttaaaaatgtttttggtcgattagtaaagcaataaattaatttgcctacccaaactctttctccaattcagcgctgcttccattaatatctaaaaaataaaagaaaataaagtaaaactttttcaaaaattaccgattaattttatgagcatattttcgaagtccgccttataaacttcgttttcgccacagatgctatcattcccaagaacatgtttaattgctgaagcatttattaaaaataaaaataaaaaattcatttttaatttttaaaaggtaaataataatttattcaattttttacaattaatttatgcattgagaaaatgatgtggaatttcattattatacgcacatacattttggcataataaagaaaaaataataataattgcgcaaacggaaatgaatataataaacaacaaccaattttaattgaataagaaaaaatgttgacggaaataataatttttaaaaatttgttggtttggggcttcttcgacttgttgcgacttttgcgcctcgacacttacgccgtcagtcaaaaaaagatcttaaaatttgttatcaattcaacaaatttaactcagactaatgtgcaacaacaaaaaagctaattaaaaaaattagtcacaaagacagacatataattttttgtcaatacgtatatcagcagcaggaaaacaaaaatacgaagatttaataacaataataataattaaaaataataataagccacattcatacacttcagcaagtcttggcatgaaatgcttcgaagaatggtttaattctcattataaatatatgtcgattttagcttataaaagttttttgattttttaaatatcttatttgtaatgaatagggctgctaattttatgtaaataaaatatgtataaaaaatgctaaaatatgtatgaaatatgtataggaaaatatgtaaataaattttttttaatggttattttttggaaaaaaattcttcgtaaaaagtgaaataggcacaaaatgccataaaaatgaccagaataggcttagaatcacatttgaatattttacaaattaatttttgatatatcattttttgaaaaaatcgattttttagggatacattttcaaaaaaatttttttttaattttttacaaaaaatttctataaattctcaaaaatcctcaaaatatgtaaaaaaaatgaaaaatatgtacgaaaaagtccaaaatatgtataaaaatatgtacatatttaatatgtagaaaaatcccaaaatatgtaaataaaagtcccaacctttgttcgcaaacacaaaaaagaaagtgtttttcctaccaattagagcatggagaaaccaggaaaaaatatgtatttacataaaattagcagccctagtaatgaaaggggcagggcaaatgggttttatggggtggcgagtgaatcgaggcgcaagtgaagcggctcaaatgtcggtacacctttttcgagaatgaattttataacgcctatttcggcattttgtgccttgtgtacagacagtttgcacataaaatattaaaaaacaaatacggaaatatgtacaaatatctttgaaatatatcaaaatatgcaaataaaaattttgattatgattttttaggctaacatttcttagaaaagaggtggataagaacaaaaggtcaaaaatacccaatggctttttcgaaattttcatgtgcaattcctgtaattctctaacttcaaaatttgtaaaaaaaaattttggatttttcttttgggtatttaagaaaattccttaaaaaacctcaaaaattacgaaatattgatgaaaaaataaaagtcccaacttttgttcgcaaacacaagaaagtaaatgttttccataaatatgtatttatctgtgtttattcccagtgaataataacaagaaatatcaatgaaaataataccgtatttgctctttttatgtgccagtctccattaaactgccggtctccaattatgtacccctttctgaggaggttgaaaaataatctaacagtctccatttatgtgccaggggggataaatagactcaggaagtaatttatttggcacattttccaaaaaaatcaattca

SEQ ID NO: 25530 - DNA, 917 bp, Heterodera glycines
tgagaaagaaaagaaagaattaaaattattaaaaaataattaactaaataaaataattattaaattaatactttttcaaaattatttcttaaaatattaattataattattgaaaggaatatagaaagttacccaaaaattgatttaggcaacttcagccccgcattttggacgccaaaaacccatcattcagtgcgcgatgccaactcctccaacaaatgttgctggacctgggcattccctgtctgggcgacgaagttgctcatcaacatttgtttctggaccgccttgacaaggtggcggccaccgttaaggaaagtggcaccgatgggaatatggtaggcacatttacagtacgcaaatgatttggaattttcaaaattaatataaaaaattaacattactattcatgaatgaatgcatgcttttaagaacaaagtgttgcacaaagagctgtcccatttgtctgacgcgttggacatgcgcaatgttcgaattccgatcgcccccgccttccaatgccgcacaattgcggtggcggactgtgccattttcaattcattgacaaagccaataaaactgatcatcaacggcaaacggggtcaattcggcatcatttataaggcaaagatcactgactagggcatttaattgggcgataatgtcagaaaatgacatcattggaactcgttcgagattttgatgacctttttttgcagcgcgcttttcaaaaaaaaatcggggaaatttttgtaatattttaataatgcaatttgctaacagattttatccaaaaaatgacaaatttgcgattttagccagacgacgacttttttaaaaaaaaagcgtttttttgcggcgcgctttttgaaaaaaaaaactttttttgagggcaggggggttcggcggcgtttgcg

SEQ ID NO: 25531 - DNA, 1580 bp, Heterodera glycines
  misc_feature (56)..(56): n is a, c, g, or t
aattttagtgacagatttagttcaaaaaatgaaaagattttgcgaatttttattgngttaaatttatattaaatttccgtcgaaaaaagaataattttgaaaaattagaagaaaagaaagtacttggatgggaactgatccaaagaaacataatgaaaagagcaaagagcactaccactcgaccatgcgtgtgaacaaaaaaaataaaaacaaaaaattaacaaatatatattaatttaagtttatcaaaagcccattactaatggtgcattttcacattgaaaactcaatctttaggggtgtatttttcccgaaacttcgggtaaaatagccgaagcacgaagttcgaagctcaaaaaacccgaagttttcgaagccgaagtttcgcccacccctgattccgaccccaaagatgacagaaattgaaattaatcctcttccaccaaaaaaaaatgtaaggaaatcggagtcccttaaatcactggtttatataaaaaaaaattttacgaaataatccatttctcattgtgtgctgcagccaacagcgaagtgatcagcaacagaatttgccgccattctttgccgcacaattggacgaaaacaatgatcagccgaagcaaaaaagagcgaaaaagattggtgtcggaatggcaaaaagaacaaagaccggtgcaggaaacaaatggaagaggccgggaaaaggggcaacaacaaaatgatgacgaattattgctgcagttttatacaaaatcatttctctttttttgtcacaaattggaaattgttgttgattaacaaattttttgtgcgtattgaattagggagttcggaatggatttgttgcgaaaccgtagggattttgtctgcgatttctgacaaaaaaaaaaaatttgcaccccaaaaagtccatcttctctttgattttaaataaaatccaaagaaacttttttatttcattctttctattcttgtgtcttggtaaataacatagggcccaattttccatgtgattcacatttgcgccttgattgctttatcattcactgtgcatataagtgtctaaaaagtaaaactttggcaaaaagaaacaaaaaagaaaatgcttgatgatgatgatggttttgctttgctgattgtgaggagagagagggcagaggaggagggaggtgaatgaatggtgtgaaaaaagagtaggtatataataataacatttttttgatatttttacaacaaaacaaaacggattgaatgaatcatcgatgcaaattcctctcctttttcgacggcatttcatcagcaacaccacctccttcaccaccaccaccaccaccaataatgccatcattgccaccaccaccagcagcctcgagttggcggggtgggggcggcggtggcggcattttgtcaacaccaccagcgtcgccaccacttgcgccgccctcctccaactgctgttgctcctcaagctgtttgcgctcccgttcctggctttgcttcttgcgctcctcgcgcagcttgcgctccgccttcaggtccgcctcaatgctgcgcaacagttcaatttttgcctgcaaaatgga

SEQ ID NO: 25532 - DNA, 1780 bp, Heterodera glycines
attatatggaacaaattgaaaatcccaaaaactttttcctttcaaaaaattgcacaaaaaaaaagaacttattttgttataaattttgtcagtttttttaattgcattttcagcaacatttttaattggtgtttcgaaatatcttgaaatttaaattggtaaatttctaggctctttttcatatttgtgccatccgtcgccaaatatttcatcaaaatttgggcggattttgccgcattcaattttataaataaagaaatttattgaaaaaattatttgccagaaatgcatttttattattgggatataattttaaaatgaaaaatatgtttacattgataatttcttttcaataattgcacaataaaattgagttttgttatggtttaaataattaatctttttattatttatttattcataatatgtatcaaacatcgattctttagcttatttttatttgaaaggcaaataaattttggcataaatgaaatgctgattttatacattaacgccgataccgaaaataatttctttatacagacatatacgaaattttctcaaaaccccaaaattaaataattagcttaatatcagattacgatctggtccgtaatgattaatgaacttgtaaatttttgtaaaaaataacaaaaaaaaaattctaaaatctcaattcaaaaatggcggattaggaatctgtagaattggctccatttgccgaaaaataaatatgaaaaataatgatgagtcaaatatgaaaaattgggatttaaaagaatcttttttttcttcgttttttttattccaagctttacagtaagtatacatttaagcattttcaaattgaaaaaattatcggtcaaaaatagcaattacacaaatacagtacaattagatgtttttcgttgtgtgaattgattaagctaataaaatggtcacagtaatccttcagattattcagtgatactgtaggtcagcccaacggaataattgcccttctgtacagcactggcaatgatgatcacctcatggcctttcacttcggtgaacatcgactcggttggcagcccacaacaaaatcgtggccctaaacatttaaaattaaaaaaaaagaaaaggtaatttattaagaaaatgttaatcaaatagaaattttaaaaaaatttgtttttgatgttaatcaaaataattttttgattttttagtacttcttttttaaatctaacaaaattttatctaaacaaggagaaaaaaaattcagcaggctgagaatttttaatttggggtgcttacttatgaatttctgattttcaagtttattaaaaattaggatttttggtcaacgacaatttagtacagaaatcccatttgactgcgatgaaaatggttaaatttgttgggaatggatggaaatttttaacgtttaagcgttggaattttaaaaaacgcacaaaaataagcgagtttttctaacgcaacgaatttaaatttgtaaattttgttgtccaattttacccgaattggccaaattgccatgcttgatctcgacaaagttgtagcacgactgctcacatgtgaacccgtccagacggaacagtttgacctcaatgtaatgggaggccggtgcacgcaggcgccaatagcacgtgaaattggtggcattgtaccaccgaaattcagtaaatgtcggattttgtggggtcaacaaaatgttcgattcgccgggacatcttctaaaactttaatgaaatttcaatttaaataaaaacttaatgtt

SEQ ID NO: 25533 - DNA, 1075 bp, Heterodera glycines
aattttgaagggcgggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctcccccataattgtttgagta

SEQ ID NO: 25534 - DNA, 1247 bp, Heterodera glycines
  misc_feature (48)..(48): n is a, c, g, or t
  misc_feature (1232)..(1232): n is a, c, g, or t
cgaataaatttgcgccaccgaacatttcgtcaagattccttcaatgantactgaaaagataataaattgaataacaatctgcggagacactttcaaaaatcagagatttgaattccgtacctaaaggaattgggaaacagaatttcgactaatacgccacgcctctaatttttgtctacaaattgcgatctgtcgcccgaaataaggaccaatcttagaaaaaagggtattttaaccctttgagttagaacattattataaataggacagaccgaagcccttggtaatactgtcaaagaataacccaagatcaaagattttgaccacagtggtcttatccgtgttggactatttccgttattgcttcgtcagaatcggtctcacctttgtgccctgcaagcctattgtttaattaccttctcactgccaagcgacacttggctgggctggaacaaattttggcaattcgccacaaaagccgtcagcagcaaaagggtgccaatgagcaaccacagggagaggaatggtaatgagttcattttggcacacttcggcccacaaaaatagcaaattaattaatacactaatgaatgagtggttggttattacggtgtccatttcccatttttatagccaaactttccgcccaattggcgaggaaaactgtgtcagcagcggcatttgattgatgcgaaaaaagaaatgataaattaatgcgagaactgtccctttttggttttattttaagcgacgtaagcacagagcattttcagtccgagcaaatttaaacgaaattcaaatgagaaaaacagcagaaattaggtagaatattaaaattacagaagctttaagccaggctaaaaatgaactgagccccgacatttgcggcacgacttttggccccgacatttgcggcacgacttttggccccgacatttgcgcctaggtcaaatcggattcaaggtaaaaaataatgctggttaggcgatcagggattgaaaaaacaattttgaacccgatttggacaaaggcgcaaatgtcgggacacgaagtgaacgttgaattgatgcaatttgtccttccaacacaaaatttgattgccttattttgactttttgttatgtgttaaaaaataaagaaaattcattattatattcgagtaagaaatcaatataaaaaaatttagtgaaaaatataatttacctatgcggaagttttttttaaatactcanattactattttcaat

SEQ ID NO: 25535 - DNA, 1758 bp, Heterodera glycines
  misc_feature (22)..(23): n is a, c, g, or t
  misc_feature (1598)..(1598): n is a, c, g, or t
  misc_feature (1671)..(1671): n is a, c, g, or t
atccgatcattaatattaatanntttccaaacgcctctccacccccggtgacggcaccatggcgctgtgctgcgacacgacctttctcgcccggctcgtccgccagccagcagcaatgcgtcaagcgcgaggacgaaacaacggcggtggaacagcagcgacaaaacaccggcacgagcatgaaagcatcgccgtcgctgtcgctgcggcaacagcagcagcgagcaacggcggtgcccaaggcggaagtgatggcggaagacacatgcgacgaacaagcgccagaccggcatcagcaacacccgggaggcaacggcaccggtggtggcggcgagctcagccccgaagacatgctggtggcggtgcagcggcactcgctgttgctccaactgttgccatgtctgcgctggttcaacgagtccgcgctggtcgagctgttcttcaggtgggagcaaatgcatttttaatagccctaaaatttattgaaaatctaaattactaataattcaaaaaatattatatttaattataaaatttatataatttacgaataattctcgaatattttagcacattgctcggctcaatccctatcgaaacagtgatcccattcatcctgaacaccaatttgccattgaataagctgtaagacatttttgaaaaattaatttttataaaatttttgcaattttttagtgatgaacaatgtgacgggaagaacagcgccaacaccgacgcaacaacaacaaccacgaccacaacaaccgctgaagcaacaatgtctgagcagaatggtggcgcgaatggcacgcccgaaaatggagacgaacaacatggagacagggcggatgttgcggtagaacaacaccgagcagtacaacctgctggagcaggacaaggactaccttctgccgcggttgcggttgcagctgccgcagttgcggaactgttgtccttaaacagccctgctgggcaccggaaggaaaagcatgtgaaagtggagcagtcagaagcagttgattctaatgatgatgataaacgtgacggatgcgcggtggaagatgattaccagcaaagggacaagcataattatgagcatgagaaggaggagaagcaaggacagcaggagagcaagcagtaccagcaacactagcagaagttgcgcaacgatgagagtgatcaaaaacgccgatgggccgacaacacggcagcttaatcctcttatcattgatggtggatttgactggcgagcagcgaaaaaacttttggcgttgagttcgcatgaaaaaaaaaatcggcagctgctgctgaaccgcccccagttttggcattttgtttcataggcattaattaatcttcccacccgctctccactttttgtgaaattaaccttttcctacatcaaaaaacaacatttttgtaaatattgtacccattttggtgaccgactgtaccgtaccattctccttgtcttacagtatgctccactcttttccgaccgtcgagaaatgtctttcatcattttgtccccatatttccgaacaattacctaaattatattcattcatccatttttgtttgtccccccgtgagcacanattttgctgttgcccgttggctttgatttgcttagaaaaacccgttagaaatgccaaaggcatataccgtacncaccacagtaattgattaattttattattttttcactaattattgttttatccacccgctaattgctttccctttacatttaatgga

SEQ ID NO: 25536 - DNA, 1119 bp, Heterodera glycines
tccaaaaaaatggcatctctttttttgccatctggtaatagaaatctcttggaaacaatgacagtggctgtcatcagttgttatgctctaaaaatgattttcggggcgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtgcctgtcatcagttgttatgctctaaaaatgattttcgggccgtttgagtatatgtggggtatggacggtccaaaaaaatggctatctctttttt

SEQ ID NO: 25537 - DNA, 1732 bp, Heterodera glycines
  misc_feature (1700)..(1700): n is a, c, g, or t
ttttaactgctggttttgtttctccgcattggaacacccccccaggtgagaacatgaagcaggcgatgaagatattcaccctcagaattaaattagccattttacagaaaaagaaaataaacaatcgtttagaattttgtttttgaattttcgaccttttgttcaaattcttgtcggggattcgaaataggccaaaaaatggggagggggggggggcaccggaggcagtattaccgggacctttatcaacaaattaaaaaattatgggctcgaaaaattggaattttggctgaatattccgaaaagctcaaaatggcactaatctgcctcgtgcggatataatattagggctctagttatgcagatatttgattattattcatatttgctttgccttttatgctatcttatgataaaataatgacaatcaatgttcaacttcatgtcaatgttttaccatggataaagcctgatgtttattgtttaaatttataaaaatcaatgtttaactttttttaaatacttcatcgcaacctcatggcattggcatagccctgccctgtttgaacatggccccatagcatggcattggcatgtcctgccctgtttgggcctggccccgtagcattggcaattatttttttcatacattgaattgttttttaaacgaatttcaaaaaaattctacgctcaggcttggagtccagcaggcctcggcaagcctggactttttctggaatttccggaaaatttttggcacaagactcggaatttgcccggttggaatccatatggggattgaaatcccggttgaaaaaaattaaaaaactgaaagattttagtttccgaaacttcttagaatttcattctaataaaaagaccaaaaaatcttttgatttttttttgaaaacttagatttaaaaaaattttctttaaacgctataaaataaaaaatattatttaaaaatgcttttaaaattaaatatactttctggaaaacatttaaatttagaaaaaggtagagagagagaggttgagataggcagagagaaagcgagatagaaacagcaggtagagggggagagacagagagaggggtagagagagagaaagagaatggtagagataggcagagagaaagcgagatagagaggtagagagagagacagagggagaaaaaaggtaaagaaagagagaaagaggtagagagagagagagagagaaaggtagagagagagacacagggagaaaaaatataaagagagagggagaaaaaggtagagagagaggtagcgagagaacaacaggtagagggggagagaaagagagagcggcagagagagagagcggtagggagagagagagagagaggtagggagagagagaaaggttgatagagagataggagacagagggagaaaaaaggtaaagaaagagagaaaaaggtagagtgagagagagagagagaaaggtagagagagagagagagagaaaggtagagaaagagcgagaaatgattataaggaaggaagataaatgagattagcgaagaaatataaatagatggatgcgattagcgaagaagaataaatagaaaatgtttattgaaatttaaattctgaaactttaacagagcgggatgtgcgccgcgaagcggcgcccaactgctcgtttttactattttagtgacgaaacgacanaatagtgatttctagtgaccgataatgacatc

SEQ ID NO: 25538 - DNA, 1712 bp, Heterodera glycines
  misc_feature (51)..(51): n is a, c, g, or t
  misc_feature (85)..(85): n is a, c, g, or t
  misc_feature (217)..(217): n is a, c, g, or t
  misc_feature (262)..(262): n is a, c, g, or t
  misc_feature (1697)..(1697): n is a, c, g, or t
aattaatacgtaatttttgagttttacagagggaatcatttcatattaatntggtagtggttttccctttttggagaatttaatnatttagagaattatttgatttaagttttgaggaaggattaaaaaatggtggtattttatttgtatttgagttgtattttattagtggatgatgtgggagataatgaagtaaattatttgatttaaattgagnaatttaatttatgttagtatatatttgttattgtaatattttgtnataatttgtgaattggttgtttttaattagttgtttaacaacatttcttagtcttcccatgcataatccaaaatttgttggtaaattcgggttctctcttttataaggccatcgaacatggtatctgttatttttaaatgtaacatttttatcaaagtgtatcattgctgcatcttcatccgtcatatgtggtgagtcgataattccaatgttttctaattcccaaaatttctgaagtatttggttcgtttcgtctttttttcttttttcggtcactgagttacaatttgtgtcctcaatagttccttttcctgataatatttttcctaattttgtatttatcgagtaaaatcctgatggaagtaattgaatttgtgaatttggtaacatgaaatgccaataatggtcgattccaattagaatttgaggagatgcgtgactgattgggatttttactccgagtacatcaacattttctttattaaccatttttgtaacatcagtaattttttccactgtttgtagtgttatgtactccacttcaccttttaatgttttaatgccaactttgactagtctcgatttaatgatttttggcttattttgattgaaagtggaaattgctaataatttttcctcaatcgtagttaattgaagagattgggcacattcttcggttatatagctcttttgtgacccattatcaaataaaattatttccttttttactttatgtttgtcgggatttatgcagtttacttcagcagtcataagtaattcttcttcctcataattagataaatttttatcataatccattgtcatgaatgtttgtgtctcttcatgattttcgtaatttttagccatattcactctggttttttgctctttcggtttgtactgagtttgtttgcgggtacaaaggagagtattatgtttgtatttgcaattaaaacataaataggtggatttgcattcattggccatatgtcccttatttagacaatttagacaaagtttgagttcacgtacacgttcatttcgtttctcgggggttgaataaattttgcactctttacttgcatgattttctctctcgcaaaagcggcaaaatgttttattttgggttctattttgtgttggatttggcttaaactgtgcaaggcgtactggttttgatttggtcgtgaatgcggaggtgtatggaaaaggtgtggaagtctgttgattccgtgggtttggtttcatttgattgtgcgggaaatttggatagtattgtctttgtactctgttttggggtggtctattagaggggaaattccggttttggcggttcgattcttccattctttctatgtcttcacgtgcttgggtatgatcatttagaaattccattatttcttttgttgaataaattttaaatttttccctccanatttaagtctaatgt

SEQ ID NO: 25539 - DNA, 1472 bp, Heterodera glycines
tttcaggcacagttggcataaggacatcagatgtggtagctgcagagctctggtccattgacgatctctcgctcatggaatcattagcttgctcctacctaagccgcgtcttttcttgtctgatcgccctccacggcttctttctgtggaaataggcgttgaaccaattttttcaatagcagagctgggtaggtcatcatcgtcggccttccattgtttgctgcgcgtcgtttcaatattttgagtgacctatgttaattggatgtcgggagaagacacatgtattgtcggaagcgccgttgcattccgttaaggttttcaggggtaataactgtctgtcaatggcacttgaagtagagatcgcggacatcgaggtgtccaatgtgttgggcatctccgcctactgggaccagttcccgtcgctggcacggcaaatacaaatttggcatcatgtccgagtcggttatcaaaacaaaatgacacaatgacattccaaaatgtgccttcctctctctgtcaggagcgtatgattgatgcgcaaccgttgccaatcatttttggccattcaattggtggcccatcatcatccacctcgggcggcacaaattgtggctccgttggacgacgcgtgtccaatgccgggggcaaaagacggagcgccggcaccaacaacaacggcaccggcacaaatcaccaacatttacggcattcattgagcgccatgctgaacatctcgtcctcctcggtttcctccgttgattcgtcgtcgtccctgttgttgttccccccgctttccgcgtcatcacattcagtatccggttcatctccagccaaacagcaacgacggcaccaccaacaacaagcagcatcatccagcaccgcaaattgttgtgccaatgcggacgacggcatgggcgatgacaaaatggaagaccatcaaaatggcaacaaattgttggccaagatggtggtagacgggcaacagcagcaaacgaaccatgccaatggaaaagggacggccaaacgggaggcggacgagcaaatggaggaggaggaaggcagcagcaatgggggcgaaggcccacacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatcctccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgacgctttttctatcaaaaagggagatga

SEQ ID NO: 25540 - DNA, 1120 bp, Heterodera glycines
  misc_feature (59)..(59): n is a, c, g, or t
aggaaaaggcgggttggcgaccattcgtggttgctggctaccaaagggcttgaattggncgtggacggaagtaaggagccgtacgttctcgacggcacaggtcagtctgtactggccgcgcaactcgtccatcccaatttcgaattgctttcccgtatttgccacattggatcgaagaacaggaaagggcacaagaagcactgacatttggattgccaatgttgtttgccgaagtggacggtcgttgatcaagaggcacatttggggacacttgttgggccttcaacattatattagggggtggtaaaaaacgatgaatctgagcccaattcaacaaatccaaattcgtcggaattgacaattgccccgtcgtaccccttttttctacaatgaatgaaatggccgaactcaaagctattattaatcgcctatctgcaattgagaaactaatttcaacaaacaacaacaacacattggcgaccgaaatgactgcgcagttcagcgccatcgcggaccgcctcggcgaaattgagcgcaaattaaacaacaacaacaatggaattggcagtgcggaggataaggagcgaaaaaggagcctcgtgctcattggtcttccggaatcagaggaggaagtgccatcgcttcgagcgaaggatgacgcgaaaaccgtggaggaagtgttggaccgtttggacgtggaagtgtgcccgcaaatggtctacaggatgggcaggaggagtgacgaaaagaggaaggggccgcgcttggtgaaggtggtcctgccggcgtccaccttccaacgcttcgcgctgatgcagtgggggcgtcgtcggacggagctgaagaagagggctggttgggagcgtcttctggtcaggccatccctgacgaaggaggagctggaaattgaacgagaacagcgccaaaagaagtggatggaatttggacagaagaaaacggatgaaaacatcacgacgcgacgcggaggcaatgaaaaaaacttttgaggtcacctccttttttaaattgtttatattttaatgcaagaagtttggttaacaaattggacaagttaagggttttgttattagaataagtttaaaatcatagctgtatctga

SEQ ID NO: 25541 - DNA, 1956 bp, Heterodera glycines
ttcccctcaatcgtcgccagacgaagtgcaaacattctgctacacccgtcgccctcaaactccgagccgtgctccattcattcgtcagccttatccaaaatacgatcgtcagcttcgttattcgccgtttttcggtcgtcaaactccgattttcttttctcgtttcctagcgcgtatcgattttctgatttcgatcgcttaaaacatcgccaaaagcccaccgattccctcacaaaggatcgggtgtccaagcaagtgactgtgggaattccgggcaaatcttccagggtaattaggccacccattagcatttgttattacatttctgtcattttttcaaaatgaatctcctggccgagatatgaagttttcctttttagcgtaaataataaaatatgatatttattagctaattattttgtttaaaatacatttgatgagaaaaggcaaaataaaacaattttatggcagagaattgaacaagaagaaagaaaaaaagtggtgtgaggggaatttctgatcaaaattagctgaaatatctccgagatatcattttttcttccgttctagcacagaaaagatttttgaaattaatttgtgtaaaagatggcaatcatttggggtgcccagctgatcaattgatcagtccatttgcgagtaattcgcctgcgaatgtttcccttccattctgctgctgttgtccatcactaattgattgtccttcaaccgaccagtgatcacttcctcttgcgatggtccgttctttgttcgacatttgtctggcctccgtttgccagcgcagtttggtgttcgatgccgacctttctcttctcccctgcgactgtaaacaacgtttgatggagtttttcgcatcccatgaccaagtgattgtgccattttttctttgattagccaaaatccgcttcagttaaactccgaactgtgctttgggcttatgtcacggccaatgtttggtcggaatttggtaattaatattttaattgaaaaatatttatgtcaaaatgcttcagactcgcctctgcttttacctcagcgaccaattgaatgattcgattttggaagctttggccaggcatttcttaatcacgaacttttcagttaaatcgctcttttcagttttaaccaaaaccttcgcattatttcgatcgtcgaatgcccccgggtcactgatacggtaatgcatttgccaatatcatttgtaaatatagatagcatcagttttcattactctttttaaagattgtccgtcaatttaaaaattgtattaagcaaaataatgtattaatttttaatcataaattattttttaattaattcttttatgattttttcaattcattccagggaattgtcagcgtcactctccgccagaataaactcgtctgcctcgagttagtcggaattccgctgctcacttccaatgcgctcaaggctgtgaattcgaaccgtctgagaagcgtcgatttgagtggatgccgaaaggtgattaattaagcaggcaaaacccctaaaacacggacacgaacccccccccccccctccccaaaaaccaggcaaatgcccgatttctttgataaaattgaaaacatttataaaaaaattttaaaaaatgatcacattttatattccattgacttatctcagatcgcttcagaaggcattttctacttggtgtttaataatccgtcaattgttagcctttgtttgaatggctgcaggggattggacgaggtgtttcttctttgttttcagcaaccattcgttaattaggccaattattcagcaagcactttacgacatcgcgcgatgcatcggcgaaacgttgttccgtttggagttggaccaattgcacaattcgaacatggccgagcacaccgaggccatcagcagtctctcgcgccactgtcctaacatttcccgactttcactttgcca

SEQ ID NO: 25542 - DNA, 1238 bp, Heterodera glycines
  misc_feature (1078)..(1078): n is a, c, g, or t
aatgagtctgatcactgatcagtttgagtgtggcctccctgaatgggcttcccgacatattgggtggccgccattgtaatggcgccaaaagagagaagcatggcggtgtattggtagttaagtcggtcaatgatatcattggactgatagctaaacaatagcaaatgaaagaatccatcgattaaagcgaaaggacccaacactacgaatgtctttttggaggatcctaacaataagcaaaccttcgtcggattttggtcaaatatggcgctattgctccaatcatcgtcgttttttgttccgtcctcactgttttggtcggattagtgcattcactgtttttgacaaacaacacaacgcacagccagcaacagtcagtcggagcaacgcgcaacgatcgattggggaagaaaagggaggaaaaggagggaatgaaattgcagggatatttaaaaggggagaactttacgggaggagaattggagaccaaaggaggaaacggacgatgggaggcggaaaagacggacaaagggagaagggccattagagagagagagagagagagaaatggagggagagagagagagaaaagggaagcttccaatcagataaaagcgagaaaaccggataaactctggaccgaaatgaaaaatttcataaacctcatttggctcacaaaaaacctcattatgggtcaaagagcctcacttgcgcctttattttgaatacggtataagattttgaattggcaaaatgttcatgaatagtttttttgttttgtttgcgtgttttcaatcttacgcttaacaaattgtaaaagagcctcacttgcgcctttattttgaatacggtataagattttgaattggcaaaatgttcatgaatagtttttttttgtttgcgtgttttcaatctttcgcttaacaaattgtaatttgagttacagaatttttcatacttacatattattagtgataaaaataatcagttttctgtgtttctctgtgtcaggttttataattttcgaattaacaaaaatgggcgctatatggaaagtgggcctttttgaaacaaaagngggggacccttttgttttgtaaaatttttttaagataaaaaaccatgataattttttatccggggttttaaaggtcgctaataaaggatctgacatgtattttgaataatttctaaggcctgggggggctcgaataaaaatcggaatttaaattttcaaa

SEQ ID NO: 25543 - DNA, 1282 bp, Heterodera glycines
catggtatgaccacttgaattatcgattgattttctccgctgagcgcagagaggatgagcgggcgggtccgtgcctattaggtggttgtgtctacgtctctgacgggaatggggtggggggatgcgtcgggagatgtgggttcgggatggtggtaggtgcgcgggatggtgtggggtcgggatttgggggtgtgggaagggggttgcgcgagattttgggccgtgggggttaaatgcgcgggagtttcgccgcgcgggattgaacccgagatggtggttggtaggcgcgttaaccagtcggccaccgatggaatgggcggggtcgtgttattttgcgttaaaaggcgcgaccccctccccgctggtcgtcaccgccatttcgcggggcagcgcggaccccctctcgccatcgccgcggaccctccccaccattccgccgtcagtcggcgcggaccccctctcttccacggaccccctccctccactgccgcggactccttctcttccacggaccccctctctctactgccgcggaccctccccaccattccgccgtccgtcggcgcggacccctctctctactgcctcggacccctccccaccattccgtcgtcagtcggcgcggaccccctctcttccacggaccccctccctccactgccgcggacccctccccaccattcctccgtccgtcggcgcggtccccctctcaccatagccgcggaccccctctctccgacggcgcggaccccctcaccccgccgttcggcttaaggagtggtggaatgattgcctgttaaatttgaagtcaatcgtacaaggggtgagcgagttttggtgcgcgagtctcggtgtgcgcgagggggcggggcgtcgggacagtactgcttgaaatggtgcctgaggcgaaattctttcgccgttcagcttagggatgggtggattgacagactgtgaaatttgaagtcaatcggacaaggggtgagcgagttttggtgcgcgagtctcggggtgcgcgagggggcggggcgtcgggaaagtactgcttgaaatggtgccagaggcgaaattctttcgccgttcagcttagggatgggtggattgacagactgtgaaatttgaagtcaatcggacaaggggtgagcgagttttggtgcgcgagtctcggggtgcgcgagggggcggggcgtcgggaaagtactgcttgaaatggtgccagaggcgaaattctttcgccgttaggcttaaggagtggtggaatgattgcctgttaaatttgaag

SEQ ID NO: 25544 - DNA, 2157 bp, Heterodera glycines
  misc_feature (75)..(75): n is a, c, g, or t
aaataaaataaattttaaaaattaattcaattttataattaaagaaatttcaaatatgggattacaaggtgattnatttgcattatttattatggtttcgcaattattctttcggtcatttattttactgtgttaatatcttgttttatgtattaacttaagctttgatattaacttatattattggaaattttatttccgtacagtaaactttgtaaaatataagtaagtttttttaaaatttttacttaatttatttttttataagaaaatattttgtaaaagtgtcaaatgtccttgttctttaaattttaaactttattcagatataatttagtttaatatcatgtaaacagacagcaattgaatttatggcacccgctgacatcaaaagtcaaaccaacaatgagcaagaagatgatgattttggttatgccaaataataaaagaattccaattttatttatttttatatataagtcttttacatatagaattatgttataatagcataattgcttttattaatttttttaaaattaattatttattaaattagatgggatccaattaaggttggttgtgtcacgaaatttaatattatttaatgaataaatatgaataaaattattcgaaccggttgatttttatttttattttcgtctgaaatgcagaataatatatattcatttttgtaatttatagaataataatatttttatataaataaaacttaaattaaattattttttcatttaagttgagttatagctctcataattatctcatgaacatttatataactccgtagtttcgtaaatggagaaaaaattattagaataataaatgcgtatacagtatatggtcttctgatacataaataataagttcgttaattgttattctgtagcatgttcaatgcatgttgttttatttaattatacctgagtgtaagattaattacttttttaaataaggtgtagctgaaacccccccccccccccctcaaaaggagggctttattcgagaagggggctttattgttcaacctctctcagaaggggggctttattcgagaggggggttctaatcgagtaaatacggtaatttaaaaaaatcaaagttttaaagttaagatcggcgaagaattgtcagaaagtttcaaaatattttcgggagtgccccagggaagtgtcttagggccattactctttttaattatattaatgacctgccgtcctttattgcaaatgaagtggcatctgttgttataaaaatgcatgcagatgaagttaaattatattatgcccaagaatatgatgaccattcaaatcagttgattaaagcaattgaggctttagaaaaatggtcaaaaataaatgggctagaaatatcaactgaaaaaacaatgaaagtcctttaaacccataatgaagtgttgaaaatgaatgatgaaagagaaaatgaaattgcgcaacccaaaaaagcgatgttaaaaagagatgaaaaaaggcattccaaaaaaaattaaattaaaaaataatgatgcactaacttaaacataaaattctcattttccacaataatcgttcggtttgtgaatgaaatttgaattttcattttgccatttgttccacattcatcaccaccagctgtggtcgacgcattgaacattttgttgaatttgaatcttttcgacaatttccatggaaaatttttaccataaaatgcgctatagtagcacaacaaaaggcttaattagtcaattcattagcaataaataattaatgtgccttttaattaacaacaattaaagaccttgaacattctccatgaagttcaaatttcacttttaaaggaccaaattttgctaaatccaacgaaacatttcttaaaatttaagtaaattattttcttattttaatgaaaatactttgtgccatttgaaacaataaaatgatgaacaaaaatcagaaaaataaaataattgaccaagaaaatattcattagattttattaatggataaattttattgtttaatatgttaacaaaatgtgtaaagtgaaaagatttcatttttagccagtggatttttgtgataaaaaatgaatcatcgacggattgacaggaaataataattttagtttacaattgac

SEQ ID NO: 25545 - DNA, 1600 bp, Heterodera glycines
  misc_feature (30)..(30): n is a, c, g, or t
ctttcagatttgttgtagatcaaaaaattntttagtggcccaccaccgtgagtcactaatatccaatttcatttaaccttcacaattcccaactttttttttttcccaaaatccaaaaactccaaattttccgctgaagcttacccagaactgcaggagcgccaagtgataaaaacttcaattccaccgcttcacacaaattgatactcgaagaccaacgattaagcgaggccaaaacaaacaaatttataaaatcgaagcaaataataaaaagaaaagtcggaggcgatgatgagaaacaaaattatcaaaaccaaaattcacaaaaaaaacaaccagtcccacggacagacaaaatttagaaaagatcaaaaataattaaacagaacgtcaaaattataattatttaaattaataatgaggtcacttatcacaccattttaaacagattttcactgaaaattggccatttttaagtcaattttgcgctttgaaaatcatcatttcaaaaagaacaacaatcatcattgaccctgtgaaaccaccaaaatgatgataaatcattacatctggcagcactgatttaaagcctgatggataaagatttttcactataacactgccaaattaaagtgatcactctcaattgccaattcaataattaactatattcggccccataaaaggctctcttgacagtgtgaagcaataattcccgcatttattcactcttaattaccccctccaattccttcaaatttccttcaaactgttggtataattcgaaagcttaatgtgtttagaagctttttctaagctattgcttcgcgattagacaattaccaaaactgtctgcggcgcaaatgacgcggcgcaagtgtcgactttgcggatcggcgcaaatgtacgttttattcaggttcagttccttgtcatagcagtctttttagaataatttttaagatttttgttgaaaaatgccattttatcataatcaaagctcaaatttttttaaatgaaccaaatggccgccctcactttatttattttgtatgtttccctcgtctcccttattattgcattttttgttaaggaatttcagaaatcctgaacatatacgccgccataaatggcgaaatgggcaaacataggcattataaaagtcatcgtagacacctaaaaccaagctgaagtatttgtgtttgcgtaaaaataggggaaaatttatgaatattaaaaatatgataaatacaggtgatggtggtgctttgactgttcttaaggacgaaaaagcaatgacatattatggcattggagaaggcgcaaccgttttattgtttactcaatttgaaattgccgtaaaatacaaaaaagataatgcagagaaaatgtgcaccgttcgaatgaaaggcacggatcttgtggcagaattgagagacaaaattgtggaggaaatgaaaaatgtttttccactgattgtttataattctatagtaataaaggacgaccacccaagatcggattatgaccaaaatctttacggttatacaattgaattttttatttttttttgtgtttttgctagcaaaaaagcgttaat

SEQ ID NO: 25546 - DNA, 1751 bp, Heterodera glycines
atcatattttaaagctgagcaaattcttcgtttgatttgatccacccaaaaaaaaaattggtcggatgaaaaaattcttaaaaactgtacctttatcaatggtgggaaagtgtcaaagcgcctgttgatcagcctcagagtcgcctttttccgtttgtaagccatctgtgtcccaagctgggcaagcagcaggagcccatcctcagcttccatccactccttccgctcctggcccttctttggcgtgtagtgcgcgaatttgtgccggatatcccgatggatccgatccagcgatgcgcggctcgcggaaaataaattttatctagggtcgtcgtcctccaactcaaaacagtaaagcaaatgaaaatttggttaaaacgaatgctttaaagcaaaagcgagggtagaggattaaaaaacttattaaataacacttttgactgtaacataaaattttgtacgattttttgatcaatttttatcatactcttttaaacttaatcatattttttctatttaacgttttgttgttcgatacaattgtgtacacagacacctttgttcgtgattgctttagaatcgttattatttagtttatgtgtatagattttgaattattaatttataatattttggtttaaattatttatacgatattcttcagaatgcatttattcaagtgaaacaaattttattaagtggaatgtaattaatttaacaaatgactttattgggtaatttagattgactttcattttttgtataaatttaatatttgggtataaaaaagattggcttgtaccatagactaaaataattgatatatttctaatattctcttcacttttttatcatggaatactaaaatagtcttcgttatttataatgtaaatttatttaaccgctctcgcaccaaaaaagaaaaattttggcatatcatgttgacatgacttattaaattgcgttagcttcttctgaagtatggattattttatattatctatttgtaaaatttgtaattccatgcaatattttaaccccttataatcattgattttaaattcctgattgtaaaaattttaactttttatttaattcgaatattccagtaaataaaaacattaagatacgcaaattaagctttaatgggtaattacatcatttttaacttgtactatttcagtttttatatatctaatttactagtatatctattattttgatttataaagtgattaatgtaatttttttaagattgatatattctttatcatgtgttttattttttattattcaatttaatgtattcataattatgagcatggttaaatgatatgttagtaatttgttgtttcataaactttcattgatatgttattgattctaatttattatactccgattaaagattgttatcattgcttattgagttaaaaatattgcaaatgatctttttgggtgaattgttcaattatttaaataaatattttttcttttgtataaaaaatatatatttgtatcttttaactgatttgatatttgtggtttaaaccgatattgttcggtcaaacgcgataatgtattgtactatttatatttattccattttttctgaaaataaaattaaatatattttttatttactatatttactagatgtttttatcatttagctcaatattaagaataattatttcacaatgtatttttggtataatctttaaattgaaagctaagcaatcattgggttt

SEQ ID NO: 25547 - DNA, 1570 bp, Heterodera glycines
ttcgggggggaaacggcgggggggaaacggctgctttgggaaacggcaggggggaatcggcgggggggaaacggcggggggaaacgaggtgccctccaaagggagttgcttttacggatgagtttcggccagcgggcacttttcctatggcttttggttttgttttcgctggtctttttggcccttcacttggtctgttttgcgttttatttattaaattccatatgattgttattttattcaaggatttcggcattgacccattcatcggctttttgttcctttggcttacggatttatccattcttttctttgcgtcactccgttgcgcgagggtaacgagatttggagaaggcgtaaagattttccttacttctgtcggtcggttttatgcatcaagcgatttgctgttatagctagggtcaaaaaattttaggcttgcttggacctaggctttatgtttttaaatttgttgtacgagtttccattaacccagtcagactaatgggggccagtatatggatggaattactatgatacgggaaacacgcttgataatttttcaagttttcatgtatttaagtgccaattgtctcaaaattcgttttcgaagtgctcttctttgtccgtttgaagtacaacggttctcaagatcttcttctcacaatgcttccttcttggttttgtttcgcatttgtcatttttattctgtcatcgcgcatttataaaagtgtaaaaagctgttaaatggaaatcaaccccgtcaattaaaaattgtaactacctaataccccaaaaaatgttttcgttaacccacccccccccccccccccaaaatagaaaatccataatcaactgaagaaaaacaaatttttttctgttaaaaccataattagaagagcgaaaaataacaccacaaaatgttgtttttaaatcactttcgtcctcagtctctctccgcaattgccgtcagatgctcctcaatgcttttgtcgctcactttgactcctttcgggtccgtttttgtagcaacaatcacttcaacctcgtcagcctttaagtcaattcccagcccggtttgcagtgcctcaagcgccagttgaatcacttccgtgtcaccgaattttcggtcttttgatttgagttttttctccagaaaaccgttgatctgctgctgcttgactccaatgccgtaaccacgaacagaactgtattttggtagaaagctttttaaaatgaaagttatttcgaactttgatccctgggaccgttaatttttcatctattttaacagaatctattaggatgttgaaaaattatatcatagcagataaacttaatattttgagattcagtcaaaattacattacatgtaatgtcctgctggatcgatggaaaaaacagaagcgcctttttcgtcgtcgttcgagatcataagcatcactttgaaaaataagtttcatttgcgcttttttacatggaactctcgtgtgcccaatgaacgaagttcagcaccctgaaaaaaatttggtttaatgttagtaaacacctgaaatttaatttgcaatta

SEQ ID NO: 25548 - DNA, 911 bp, Heterodera glycines
  misc_feature (842)..(842): n is a, c, g, or t
ttatgaaaggacaataggcagttgtgcatttcgattattatttcggaggttattcatcagaatttgctgttgtgcaacggcattttgtcttctgcatatcgtatgccggatgaaattggccaccgcgttacggtagtcaccgacacagagaattgagaccagcggattcagtacgggcaaccaatgaaagggaagagtgatgcacatttgaataaacataaaactcggggacaattggaattcaaaaatcaccatttcaaccgaaattataaggtttattaaattcatagccaacggtataaatgcctaaatataattaaattaatctgagttataaacccgggatgagtgtttatttaaacaacaatcatcatcttttgctagcatcaatactttttttagcatgatgtattaattaagttatacataatatactaattaactaaaccgacaataatctaaaaagataaccaacttcacctcaaattattcatcaattttacctggagaatcaaattgattgtgatttgtcggttaatttgttgtcttcttgctgaacttttgtccaagtttttgtaaacaaatctggccattttatatccacaaatgacaattaccgcataacaaattatgttttcgacaaaataaagacccattgtaatttgcccgagaaaataatccttcaaaattaaaaaaaaaaacattataaaatataagaagaactcactcacattttgtccacaatataatacaaaatcgctgagatttccatccaaaaattgttgaatttgaaatatttcttcagcattaatcaaggaaagatttaaatggtcatttcccancatataatcatatgtccaagtcaaaataccgattgaaaacacaaatgaaagcattgccatatatttttg

SEQ ID NO: 25549 - DNA, 1260 bp, Heterodera glycines
  misc_feature (33)..(33): n is a, c, g, or t
  misc_feature (1237)..(1237): n is a, c, g, or t
aaatgagttttttgagttataatccatagagcncagttcgggacgggattccgtgcgggattttgcagggtcccagtccgcggtcctgcatttttggaaaaggtcggattttcaggatgagtccctgcggaatcccgtcccgcaaattctgagttccaatcccgcagcggaatccgcaaatttgaaatttccacctttaacacataatttttcatttaattatttttttgaacgttttgagtgactttacttattttaattaaacgaaagcaaaatacatttttgcgatgagaataagggcaaagcatctctgtatttaaatctgttaaattctcaattttttgcgaaattttaaattttttttcattttacaaaattttgggtcaaaatctgttaaaatttcattaaaattttcagttttcccccgacggcgccttccaggcaacgccggacttcaaaaataaattcaaaaaaaattcataaatttggagttctagaaaaaaatccaacaagtttcagcaaaaatctcgaattttccagggcggtgcctattggcaccgacgcttttcataaagttaattaaggtgaaaaaacgttcaccaaacacaagaaaaagctcgaaaaattcattaatatttgaacaaatgaatatgagactttatgaaatgttgaagtttactttgaatgcacaataattattccgcttatgtactttgaaattggcttacccatactttaacagtaagcttattttcagctgtcggcactgtttaaacgtgttaattaatgtctcgcgtatcaccttgtaaaatgtactttcattgaatatataacaaatattagggcgcctaaggcaataaaataattattgataattatttcgctccttttatttccgcttatttgctcatttgcagatttttattttattatcggatcttctcaagaatttgctttatgagaatctggagataacctaaaattctgtgtctgaccgaaacagaagaatgattttgaggaaggagccgggtgatagtcgaactcggtctcggtctttgagactttcgagactcgagaccgagacttttttatacccataatgatcggctttttgtaagttagaaataaatatacttttggtatatttttgcttcattaccttaatggtgtgcgtggctcagtgggttatgttcttggtcatgtcttcattttagcgttggatcagtacccctccaangtaattattttttcttctaattt

SEQ ID NO: 25550 - DNA, 1125 bp, Heterodera glycines
tttctttatttatttgtgaaatttgatatatcaacgcaatactaaaatatgtttgattatctcaaatgttaaaaaacatccgatctatgagataatcatcggcacagagcaacggaataatatgggaaaacaggtgctcagtagcttatcacatcttcttttgtgatctgcattgaacttccactactcgattgcgatagttattgtatgtttgaacagcggctggatccttgaaattctccgagtgaatcaatgcgtaatgtgtgtatagctcagttgacagaaaatgcggttccgaactccattagtacctcattgtatttacctattaaaagaaaagcaccaaaaaagaaagaaaattaaaagcaacaaaaataagaaaattatacaacactagttatattttggcgaaatgtttttggttcaaattttgaaatagaacttaatagatttaaagatcctattaatcaaaaataaatccaaagagaaatcgtcaattggtatttacctactttatttattaaaaatttggcaagaagggttaaaaaattcacattttgtattaattttttgccttttctcccatgaaaatgccattcttaggggtgtttatttaacccaaacccgagtcggggttaaccccggcggtaaatgtcgggggtcggggcccaaccctagactccatttttaagtcctatggcgcccaattggccgcgcgcacaagcaagaattgaatcagaaaaagtgaaaagaaggctgaggtggctggacatttcgacgggcgccggacttttcgacggtggacatttcgacagcaaaggacatttcgacagaaatattataaatttaaggaggggacttttcgacattagacatttcgacagtaaaaagtaaataaatttcaaatttgagggtgtaaaatcgtaaaattttctacaaaacaaacaaaatgaagccaaatcagtatttttttctaggtaaaaaaacgcaaaaacatatccgtagtaataatgatttagcaatacgtattagtatgttaatttaaaagaatttagtaaaactgacaagcaataatatttattttaataggaattatttgtttttatgtttattgtcgaaaagtcc

SEQ ID NO: 25551 - DNA, 1514 bp, Heterodera glycines
aagtcgttatgccgtctctttctttctttaaattttcttcattgtaattaaacaaatgtttgatcttttgattagttttaaattgatttatttgaaatattttccaaaatttaatagaattaatcacaaaacgaaaaatttgataatttacaaataaaaaatatatttagtaatatgtattttaattttataatttttaattttaattataatataaattataattatgctctcataaatttgatatttgagtttttattttatagaaatattatattgatcgattagtaatatataatattctcttatgcgatatttattcaaaaatctggttaataaaacattttatctatatatatttttcataaaattttttttactaataaaagacttttaatcagaattaaatatatatggcccgatattatagtatttttatttttgataaatcttcgtcccataacataaaaaccatattaaattccaatcccaaagtggataaaaatacataaataccataatgttaaatattttggttttctttaaatctttaatcaataaattttgtatcgaatgtatatttttataaattgtttagcctttattaataaaaatcaataaattaacttatatctaaaaattaattattccgaatattatttatttttattaaaatttttttatttatatttatttaatctttaatttcctatcagaaaataataagaacttctcggacatgatttatttactcgcaaaatatatttataaaatcaaaaaggaaaataaaaaataatgatatatttacttgatcttcaaataaattaatagtccttattctattaaattcatgaattaagaactttgtgcaaaaattttgaagcagccaaagcccaaaataaacgcaattcaacatggcaaatcatcgccaaatcacaaaatcgcggaaatggtcgccaaatcaaaagttttcgggcaaatcaaaggcaatagccccgccgagcaattgcaatcgttgcggagaattgcactggacacaggactgccagagaaggaaaatatttgccgcaaatgtaatcgcagaggtcccatcgaaagtcaatgcgacaaaatacgagcatatcaccaaaacaaaggccaaaatttcaacaccaatacggttatgctcccagcggcctacatcaattccgtccattcatcaaatctgcttaaagcaccgattaatgtgcacggcataacaattggcttcatcctggacagcggtgcggtgataatcatcatcaatgaagatgattacaacgcaatgggctgaccgccaattcaaaagagttcagaagaggcacgctttttcgacggaaagtggtgcaaattgacatatttggacgacgtcatgatcgtcaacgcgacatttgatcaacatcgccaacatttggaccaagcgaattgcgttcatttttgggcatggtcaattactaccaggaatttgtccgaaatttccggtttattcgacagcc

SEQ ID NO: 25552 - DNA, 1286 bp, Heterodera glycines
aaattgagaattttgaccatatttttagcagattttcatttaaaaaattcataattttgtcgattttcgaaaaaaattgtaattttctggctaaatttgggtgagatttccgtttgatactctattaaaaaccaaaattcaaattaaataattaccaaacattatgccaatttatcaaaatttaaaagattctgaggattttccccaaaagcctcaaaaatcctcaaaatttctcaaaaagccacaaaaatcctcattttccaaaaaaatcctcattgacctatcaaaaagccacaaaatgaagataaatcctcagatctgcgaaccctgggttaattagctaattaatgattattttgtgttggcattttgcccattcacttgtcacaattgcacatgtcctttttgcagccgacgttaaccgaagtgcatttgattgtcggacgacttttgggcaaagtgacataagcttttccgcgtttaattttttcataagctaaattaggcaaaaaaatttctttttcgaaataatttcgttaattacctttataattgcttccgtcacatgtccaattgtatgggtaaaagaggaatttttgcaacacattcttacaggaagaattcacataacatttctcatggagcgcacaacacctaacaaattgtcatttattatttaattaaattttaaccaatttcagtgcttttccttatttccccccccccccccctctctttttcaataagattttgccttattttgtctttctgtgatattcagaaatttattgcgaaaaaagaaagaaaattaacatttcaccgaatatttccttactcatcaatggcatcaactgatttcttcttaattccgtcgttcacagcgcacctcaattattataaatatattttttaaattttggttttagacatattccatttaaattttaattatttcattttaccagcatccatggccattataaacagaaatatcgtagcccaaatggcattttgccatttcatgcaaattggacaaattttttgcgctcatttggcacgcaaatgaaaggagaaaaatttgagaaagcaaaagaaacatctcaaaaattaaataaaattataaaattataaaaaataaaataataaaaataatataaatgaaaatagcctataatatttaaagattagcaaaatgcgaagaaaaacgtcaattgaatgaatcaattggcagcattaaaatgacgtaaaatcaaatgaattgattgtccaatgacataatacgatga

SEQ ID NO: 25553 - DNA, 2125 bp, Heterodera glycines
  misc_feature (103)..(103): n is a, c, g, or t
aatctcgaaatctcattttcgagttcaaatttttgtccaatcccataccatccaatttttcgaaattttattttcgagttcaaatttttgtccaatccccatntagtctaaaatttcggaatctcatttccgagggtctaaaaattttttttttgtttgtgttttgttttgtttttttttttgttttgtttttgacccaaattgtccaaactatccgctcttgataaaatcagagtcttagctctgacagtgcgtggtaaaaaagtctcacaaatcgtgaatcgtgtacccttccccctttctggtttttgtttccccctttctggtttttgaattactgattctcaactcagaacgcagttcggttattgattaaattggagtctcagttccaaagttttaaattgttcggtcacagttcggttattgattattgaattggagtctcatctccgaattttcgaatttggtcattgatttgagcaatgacagcccccatacaggcattaattagggggtgtgccagcaaattgggagcattattgggtaccgaaattccacccgacttgggaataaatgccctaccgaatcaatgccaaagaaggctgtacaaattcagaaaccttcttaatgacttagaaagggtggtacaaaagattgaagataatttgggtttggctaatgagtatattggtaaactgagtcgagacaatgcaatccgtaaggaaacggaaatgcaggaattaatgcaggagttacaaattaatgagaaacaaaaggcagctgacgttctcattccaattttgagggacaaaattgaggcattagaagagaagttagacataactcacaacacggatggtgacactacctccggcattggacccctctcaaggagcgtgccaatgcgtaaaaatttgccaaaaactgagcttaagagatttgatggtagtccatctcagtggataccattttgggattactttcgtacaataattcatgaggactctcatgtcccaaaaatcgataagttcagttatttagactcatgcattgaaggcaaagccagtgccatcattcagggtattccaattagtgagagtgggtatgatgatgccatagatttacttttaaagacatacggggaaaccaaacgtctgattcgaacgttgaaccgggaacttatgtcgcttccaattagtgagtcatttgaagacgacgagtccttgtacttgaagtctgaaaagatttttcgacaactgatttcaatgaatcagaatgtcgaagatggtatgtattacagtaacctggagggcaaaatgtctccagaggtgttagataagtactgtgttatcaaggatgccgaagataatgatgattgggatacgtcaaagtttcggaatgcattctcacgtgcattggaccaaataaagcataggcaggaattaaggaaaaatgtgattgagcccaaaagggacaaacatgaactgaccatgtctttcacggcattttccaaaaatgataagtaccaagggaggaataaatttcctcaaaggaattcggatcaatcgcaccctcgtgggcggaaatttgaaccaaggaaatttcgtgatcagaggcacgataatagtgactcatcagtcagccattcaccaatgagggataggaggaattctccttatcccaaaagggattggtcaagctcaccagagcgtgaaaaatggaagaaggatgagcagagaaaatgccaattgtgccaaggtgagcacagtgcgagtaaatgccataaatatatggatgccatctcacggcgcaataaagtattgaaaatggaattatgtttcatttgtctaagggctggtcattgggcaagtcaatgtactttaaagggatataagtgcaacatttgcaatcgggcgggtcatcacatctcattgtgtagatccaaagacaaacccaaagatagaaggaatagtagttcagaaagttcaccagttcggtcaaggataaatacgactcaagacttctcagagtctgaagaagttgaaaaggaaataacgtcggtcacttcgtgtgtacaagcaggggggagaaattgtctttgctgaaatgtaaatatgttacc

SEQ ID NO: 25554 - DNA, 1697 bp, Heterodera glycines
  misc_feature (1673)..(1673): n is a, c, g, or t
gatttcctttcatttccattttcagccatttcgacgcccctttcgccctgtccaatccgtccaacggacgaaccttggcagaacgaagagcaatggcgaaggtaattgaaaaaacacaccaaaatgaatccattggctattttctgctttagcattgcgtgggaaatctgtgccagcaatgaccgactgccaattcaggcattttacgaccgtttcccgaaggttttgcagcagacaaacggaggaaaaagggaaagaaacggtgccaaaaatgaccattgaccgactaactgaatgatattcacatttatttattttcattccaattcttggcaaagtgttaatgtctcccaaattttttctgtttacacttcgacacattccgtcggcccactttttgtgcgaattcattcgcccgtctttcccccccccccccattttctttggttttgtgatcattcaatccgcacaacaaaatgtgatgagtcctttctttgcctttgcttttctttcattcgcttttccttttgcttttttatgatttccgtgacttttttatttatttattttttgccaaaataataaaattaaaattggtccaatttcacggtgctaggtcgaacctaaaaaagtatcggttataataaaaataattaaatttaaatgttataaagtgagtaaatctaataaaattatattatctaataagcagtttcaattacatactcattttatgtcacataaataaataatgattttgcaatttaagaaccgaataaatgtaattttttgaaggaaaattcgttgatgataatatttaaaataataaacacttattctagctaatactttctcataaaaattgatatcgatgtttgaattaaaatacgaaaagaagtaaaggaattgtttattacttgattgaatttatatgtaagaaaaattgcaaaatatgtaaataaatatgtattaaaaatgcaaaaatatttatgaaacatgcataaaaaattggaattttataggatttactcactataacatttaaatttaattatctttattataactgatacttagcaccttcggcaacgaatggggaaaatgtaatgagaaaggataaatgaaaaatattaagaattaaagaagaaaatccacaaattggcaacaaaataattgctagcaaaataaaattggatattccaatttaaaaatgaaaaggaatttgctgaaatttcgaatttgtgctttctttagagttgtaatattataagaaataaaattaatattcacattttttaggtttaaaaaccttccttattcgaaaaaataaaatattttaaaaattttaagtaaaaatggacaaattttttgaaaatttggtacttttcttctcatattccattaaaatttccaaaacatttttccggcggcgcgcctatcggcaccgccgggtcccattgaaccattatttttttgaaaatttgaccccaaaatggcaaaaaattctgattttttggcgcaaatcactataaattttctgctttctcgccctagcgctaaaattttgaaaattatactatagaaaaaattttggccgaagagcaaaaaattaggcccttaatttctgtgtttttgtcaacaccaagccacaacggcagtatttccaatcccanaagaatacctcaccataaatctcg

SEQ ID NO: 25555 - DNA, 1962 bp, Heterodera glycines
  misc_feature (52)..(52): n is a, c, g, or t
  misc_feature (86)..(86): n is a, c, g, or t
  misc_feature (109)..(109): n is a, c, g, or t
gtagatataaaatcaacgaaatattaagttttaatcattttatttaccattngataagaaaatacaaatattttttgttgtaaatntagaatattttcaaattcaattntgcgataaaagtaattatttctcaatttctcatcgtttacatttgaaattttataaacatattggtcaatttttcttttttcaatctcaattttttataataacaataaattcaacgtattaaataacttattaataccattaaatattaatattattaaattatgtattgcaatttatttaaattatttgagaaatttcagtcgcttattttttttaatactttttagtgggatctaccttttatttacacgaatacatgaactggcaacggtgaaaatcgttcagatttacagaaattgtttatagtgacttggctctgcgatagttatttagaaaaaatttttgttttattatttcattgaaaaaagtgaggattttgaaattaatttaaaacttaaaattgatggcataaaataaaaagattaatttaatatattttctttggttttcttttatttattgatgaaattatatttttatttaagttattgactaaaaattttaatattcttactgtccatttttatgggagggggaagtttgggcaccgggaagtttgggcaccaggaagtttgggcaccagaagtttgggcaccgggaagtttgggcaccaggaagcaattttttaaaaaatcgaaaatatttttcttaatttaaatattatcattgttaattattgtaattatgcttcttatataaaataaaaaataaattaaactaaatgaaaaaattaattaattaaaaagtaaatggctaaattattagcatgtattttcttttcattattacataaataatgtgagataaatattaattaaaataaattgaattggccaacattttgtcaactttttgagatcgttatctttcgtctgcacatctgctgtttacataaacataaacacaaaggatgaatgtgaataaaaatattttcataaattacttaagatgggaaattgtccattataatttttttctgtttttgtgtttaattaccaaaaattttcggtttttacaatttaaatttccttccatcgtcgagcggaagcagcttaacgtgcctaatacaatggcacacctcgaggatggagaatttgtgtcaagcgattcatctgagggggcagcagaaggggcccctcagcacataaattttttggaaattgtttcaaaacgccatggccaggaaggaaaagcgcttttaacacacaatggctttgaatatgcgttcgataaaacctcgaaagtactaaaatattgaaatttaccgggaaaattaatatttttagtcaaatgatatgcacgaattttggcgctgcaaaataaagtgtccatattgcccggccagaatcactgtttcacgcatttggcaacaaaatgaacaggggaaacgcttcaaaatggggcattataataatgaaaatcataatcacccgccaagaacagggaatattatggtactgtaactttaaattacagtatactataatttttagtaaatacggtagaacttaattaattttgctaatattttaatgcaggtacgaaatgctgaagacagattgaggcaggaagcaaggcaggccaatccgatgagaacgagggatattgttgctgaagtgagatcttcaatccctgttggtgtacgggtggccgtcgaatctggcactccatcatcttctgcaatggttcgtgcctttaactggcacaaaagcaatgcccgacggcttcaaggagatgaaggactcgatttggatggtagttaattgattatacaatcgtatctatttttcttatccaattaccgtatcaaatccgcgtgctgtacaaataccagcttatcttcaagaattg

SEQ ID NO: 25556 - DNA, 1909 bp, Heterodera glycines
agtaggcggtgccaacacacaatgctgccaacgcgtttcccttgcgcctgccatcccgaggcctcaacgcggtggccgtcacccgtgcgaagcacacagttggtcacggcaagtgggccagctggcgtcggctgcgctggacggtggtcaatcgacacgacgatcaggcacagcggactaaaaaatactcgcgcacaatttaattctagatttgaaacttaaacttacggcaatggctgacccaatgcagaaacgcagccattcaaaaattgaaggttgttcgtgccgtccgcacagaaaggctcctgaaaaggcaaaattaaaaaaaaaagacaaaaaaaaacaagtaagcaccgccatttgctggtgggacgcgttgacgaggatgggttgcaccaactgcgcaacctttaaaataataaattattagtttttttttatatttttaaattatgacttggccaaagggcggcatttggccgaaaacggttggtagctgctgagccataaaataaaggacaattgaatttttcgctgtaaaaaaaatagaaaatttgtttttttttaatattgcgtagctttcttttcttaactttagaaaaatttctgtttatttttcttggcttttcgtttgcatttctttttaatttcgcgctgcttttcttttcttaactttaaaaaaatttctatttatttttttcttggctttccgctttttttaaatattgcgcagcttttcttttctgactttaaaatttctatttattttttcttggctttttgtttgcttttctttttaatattgcgctgcttttcttttcttagcttttaaaatttccttaaatttttcattgcttttcgtattgttttttaaaatattgcgcagcttttcttttctgaatttaaaaatttcaatttatttttttcttggcttttcgtttctttctttttaatattgcgcagctttttcttttcttagctttaaaattttccttaaatttttcattgttgcttttcgacttgttttttttttaaatattgcgcagcttttcttttcttagctttaaaattttccttaaaattttcattgttgcttttcgacttgtttttttttttaaatattgcgcagcttttctttttttaaaaatttctatttatttttttcatggcttttcgttttttaaatattacgcagcttttctcttcttcattttaattttccttggcttttcgtttgctttcttttaaatattgcgcagctttttcttttcttaactttaaaatttctatttatttttcattgcttttcgtcttttttttaaatattgcgcagcttttcttttcttaattttaaatttcttttctatttttcttggcttttcgtttgattgcttggctttttgttttgtttgcttttcttttctttgttagattaattaattaaataattttgttagtgagttataataaacaaaattaatgaacaaatataaaaatattgaacgggacaaataaataaaacggataagaaatcaatacaaaatggagaaatggaaatgaaaatgatgggttggtggagaacggacagttgcagatgaacaaaagataagaatctaaaggatgggaggggtccgcgtcgctgtgcacagtgaagtgagaacagcggggggggggcatatttgaattgttggagaagttcagacggcacattaggtcgtcaatacaacaccccctaagctgaacggcgaaagaatttcgcctcaggcaccatttttagcggagttttcccgacgccccgccccttcgcgcacccctcccccattcgtagcaaaactcgcgcaccccttgtccgattgacttcaaatttcataggccgtcattccaccaccacctaagctgaacggcgaaa

SEQ ID NO: 25557 - DNA, 1367 bp, Heterodera glycines
acacgcgcacttcgcatttcgccattggccatttgccggtgggcaaatgtttctgattaattggcgcgatttgatagagagcagcgaaaggccgagcaccaaatcgaccagcagcagagaatggccgggaagaagcacacaatcgcagggcgagtgaagcaaatgaccgttcagagacaccgattcgacgtcgaaatggcagctgaaaaagggaatgccgaagaaaggaaaaagcggaaaattggcagaggagggcattttggcattttgttgctctttcttttgccttacccttcgccaatttctgtcctttcgccgttcgctttttccgcccaattcgccgcttcttcccccatttggcgcactccgttggccaacgcttttctcacttcgccaattgtgtccgcctctttgttactttttgatggtggcatccgaaggcgctaaacggatagaatcaaagtttggcatgagtctagcatcacaattagtattaatatctccattagcattgatcattgtccaattagcattgctaattgccattattttcccactgattgcctcagatggtgccgtttgccctcgttgcaattcgcacagtctgtccaccaattccagggcctctttggtgttcctccgcagtttgcgttcgtattcttccaatcgttccatctcttgcgtcccttctgtttctgttctctccataaatcgcactccttttgaagggccttcttcccttttcatctcttccaacttttcattgtgttcttttcccttttcatcctcttcttgttcaatttctttctccatctgttcctctttttcttctttctttcccttttcctcctcctctttttctctttctttctctcttttttcctcccttttctttttctcctcttcctctttttccttttcctcctcctctttttctctttctttctcccctttttcttccttttccttcgcttttttgtttccttcttcttttttgaatattcccatttcactgtttaccgcttcctcttcagcttcttctcctttcttcagtgtattttgattttccatttgacttagaaatattccatttattttagaatttcttattttattttaatttgtaaggaagaaacatacataaaacgaatcaacagagagaaagaaaaaatgagttggaattgatctgtcttccttccgcggatgatccaagccaacccgcgggggtgtgatcagttcatcgcattgatcgctgcccattgttttaagcggtgaatgggcaaaaacatgggaagtgcgtgaaaatctgcatgatcagtgaaaaactctaaagaggacatctgtcccttccctttctttacctagcg

SEQ ID NO: 25558 - DNA, 1160 bp, Heterodera glycines
atttgtatggtacaaaatttctcgcaaaaaaagagatagccattttcgtgacatagagaataaatttaaaaattccctgtagaatagaatgcacattgctctccgcgcccctctgaaaaagagatacccattttctggcatagagaataaattaaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccatgctgggaacatttgtatggtacaaaatttctcgcaaaaaagagataaccatttttctggcatagagaataaatttaaaaattccctgtagaatagaatggccattgctctccgcgcccctctgcccacgctgggaacatttgtatggtacaaaatttctcgcaaaaagagatagccatttttctg

SEQ ID NO: 25559 - DNA, 2376 bp, Heterodera glycines
  misc_feature (2289)..(2289): n is a, c, g, or t
atttgcaaaattcaaaatccccgcgattttcaattcccccctgtttggaattcgaaaacttaaaaatgaagagcataataatatttgtcgaagttttatgagaatggcataatgttttgctttattttttttgtttttttgttggcagctgaaaatattgggggaacgaacccccaggggatttttgggagggtcggaggtccaataaatcatccctcccccaccctccgaaattcggcatgcccttcggcgttttgggtggcatcgaaatgccatcccccgaggcaagttggcgggctgtacgattttggcacgattaaataaaaatgagataggcctgaggattttgagaatttttgataacataaaacaggggatttttatcatttacccgacaaatttaaacttatatttttaaattaaataaatttaatagaaaaataaatggtttgaaaatgaaatatttaaaataaacaaataaaattcttattaaataaaaaataattatgcaaaaaataatattaaaacaaataagcaattaatattaaataataaatttatgttttattgaaaatgttaataattataaaaatattatctgcgtaaaaatatttggtgatctttttattttgatagtttaaaaaatatattttagtttattaaattttttttttattaatattttctaagttaacaaaaaaattttaaactaatttattttattaaatctcaaattattttattgttgtagtttaataataaattatttaaatttattaaatatttttaaattaattttaatttaataaaaaaatttccttatttaagtttaatttaatttactaacatttaaatttttgttttgtcactttaactaattttgatcctttattattccattctgttgtccccataaaccccctccaaaaatcattatttttggcattctaattgctttattggcattcgatacacttattaatttaaatttttgtttggcattttgtcccccccccgtccaaccgttcggcatcgcactccgcgcccacagctggcggagcacgcgccccactcgccggcccaccattccgggcgcgcctcactgctgcacttgcgcacgtccaccttcaaaatgttaaatgccgctctaacattggagagctgatacatataattacaaaattccatttataaagccattccccatttgaggggggggaagaaaatgaatacggtagactaattaaggaaagtacgatagtgtagctaaggaaagggtggtagtgtaattaaggaaaggacggtactgtgattaatgttaagttacggtaatgtaattaaggaacgacggcaatttctagcattactactgctgatggccaattagcaccaccagagtttgttcaaggattgatcaaaatcgtgaagctgatcacaactgatcagtaagtgggggttacaaatggtgccaaaattggtttggatttttcgaaaattaaaaaaaaatccaaaaaaaaaatttcaccggtttttggctcggcaagcagtgttgcacgttcacacgccggtcaacattggcatcaacccgttcaacacagaacacctcacgtcgctgttgcccggtgccgcaggtggccgaacagtcggcccattcgccggcaaaccatcttttagggaggggggggcaatggcacaaaaattgtttagaaaaatggcaataagaaaacaggggcaaaacataggctagcggaataagcataacatttagcgatttaaaaatggcatttcttggtaaacaaaaagaaatttttggacaaaataatggcaatggttaagggaaaaaaccgaaggtggcattttgccttggcaaaagttcgccaattttaaatattgacattttttagaaaaaaatatatatattgaggaatggcggcattttcgctttgttgaaaaattcaataatgattgatttttcccaattttacatatgtaggatatgccattttcatgacaaaatccgaggatggcattttcttagaaaaaagttggatgaattattttcttagcaaaaaaaaactacggatggcattttcgaaaaaagcaaaaataattgaaaattaaattggcacgcaaaagcaacagtttgaactgcttaaacagcttggcatgagcgagaagcatttgaattgcaaaaaatgacgtgacgacaaccattcactgaacacacatgcgaacaacaacgaacctggtactgaaaagcgaaatttaaacggcacaaatgcgcacagntcggcaaaaatttcagggtaaaaacaaacttactgatgcctaattttgggcttcatcgaatgactagaaaataaattttaacccccc

SEQ ID NO: 25560 - DNA, 1882 bp, Heterodera glycines
aatctttcactttttttttgtcattcgtaccatctcccaaaaaagaaaaatctgtaacaaatatccccgagggtgtcagctcatcgccacccacttgaagtaaatgcgcccatcatttttcgtcggccctttgcgatttagacaatgttcgcccgcaatttggtccaactgtttgacatcggcggccgcttcgacgagcaaacgccactctttgccgaatcggtccaaatagcaattggcactgttttcgttgtcaattgcatcggcttttggtgtcgtcgtcgtggaaaagatcgtagaacaattgctactgtcttcagctgcagttgtgttcattgtcagcacagacgacgaggacgacaacggcggagtggcgggcggtggcacccgaaaatgttcaaaagtggcatcgaatggaatgtctttgctctgtgccgatggtgccaatggcggaggagtggcgggggatggcacccgcgcaaatgattcattttggttgggcaaatcgccgatttgaatgtcttcgacccactcaaagttcgaaatggacacggatggtgacgacggcacaattgtcgaaaatggtgtttccgtgccatatccgcgagagtggcacaaactggcgccttcttcagtgccggacaatgcttctttctctgtgccattgtcgttgctgctagtattggcaatgccagtggcagccagcgaagaagccgaatttggcacagggaactgctgaaaaatattaaaaattattcttttttgaataatttttgttagttattaaattgcttaaattaaaaattaaatttaaaaagtcatcaaacacatattaccggagattttcaggtccttttcaacggccctgagatcctttttgacaaattttgaatcataattcgatgaaaagttgaaaattcaaaatttttgaaatgtgcattctgttttgttcgaaatttgaaattaataacaaaaaaatattggtgttaaaaatatttttaggaaaatactcagaaattcaaaaatgcaagttagtattttggcgtttgtttccctcggccccgggaccaaaaatacatttatttgatataaaaacagcaaaatctaatatattagaatcagtgaactgtttgcgtcaaatccttcaatttttcgcatccggtgacaatgctctcatttttaaaacccgtcaaaatttatttctaccttttggtgccccccccccatttgaccacttcccctctatttggtgtaaatggcccttttaccccctcctccacttttggcattgtgttgcccggttgttcgctgtggtggtcaccaaattcgagctgttttgccagcaatttggccgcatattgcggatgtttttgcacaatgtgcgcggtcattgcgcccaattccgacgtattaaaactgacaaattgagaatttattgccaaattacaatcgaaggattttattaggttctattgcactttacgagtcaaatcaactgtcatcctgagtttcttgaatcagaactttttgtttcatattgaacaaatcataggatttttggtatcagtttaacgcacaaagtctaaaaaaaagctaattatacaaatctaagtgtttaggcaattgtcaaaaacgatatatgattaattagcaattcttgattatttttgtttgtacctttttaaaggttagcatgcttatgttttatggtattattaccttattcagacttattattagtgcttttggctgataacaaaaaatatagggtttgtttgacatgaacaaaattattgtaaaggtatggttaattgattagactcataaaatgggttggaatcattatggttaattgattagactcataaaatgggtggactca

SEQ ID NO: 25561 - DNA, 1805 bp, Heterodera glycines
  misc_feature (41)..(41): n is a, c, g, or t
  misc_feature (82)..(82): n is a, c, g, or t
  misc_feature (102)..(102): n is a, c, g, or t
  misc_feature (106)..(106): n is a, c, g, or t
tatttaagttttaaaaattttaattcagaaataaaattatntggtaataaacagtcaatttcttctaaatgactttgttaanaattaaactttctgaagatntatntattcaaaatctttaaaacccaaagccccaagctaggcaagtttcatataacatttagtacatatttgcggtgcccctcaaaacgttgccgaatgatgttttggactataattttcttgttgctaaccaaaataagcattcttagtgatgattgatatcccagaatatttaaaatttttgctaatctccaaaaatttcatttagtttcagaaaaaatggtccaaaaaactcaaaaatttttttaaaaaaatatttttggcactacaaaaatttttaaactttgcaacttaatgagtctgcgaagtgctttcaaactgtttcaagaatgtttaattcgtttaagaaattaaaaaagagttcgttctgattcaaaaattcgtccgtcgatgtttcgtcccaacgacgttttgtcccatattccgtcggatattaagacagctatgggaagtttgtgctgcttgtgagtcggaattccatagcaaatccatgagaattgtggcgtaaaaatgcgtaatatacctatacaatccatcatcatcctcttcttaggtgatgaatgttcgactgagttgggtttgggtgcatttttgggtactttgtgttgtccccgcgcgtctctccgtcctaattcaattacatataaattaactctccttttttcttttattttttatgtgtgagtgtttggtgtggcagctaggccgaagaatttagtggacaaaacaaagcaaaaaaaaaagaagtggtaatagtggtaataaagaagaaaaaagcgcgccaaatcattcattcctttattttgccctatttgtatggctgactgatcagagtcggctgggattgactgatcggtgggttggtcggttggtggtaaattattgtgaaaatatgggtgtggtcgctttggacggttgcggtatgtgtgactctattctcaccaacgcaaccccacaaagttctttggcggggaagaacatcaacaaaacgcaaaataagcaaaaaaaaaaaaaaaatgggaaagcaaagaatcatccgccacgccaaaaattttcaaaacgcgaacctaccatatttagcaatctattttttttatagcagcacattttaagagctttgaaaaaggattcaaattttaattcggcggtgccgtaatcattgatcatttttgacacaaaaagctttaagaaattcagctaaatttttcattttttcgctgccaatagctccatgttcaaaaatatttgataaatttcgcagcaaaaaaaaaagtttgcgcttttttaactggtttcccctaatctacattaaaaaaataaaaaaggcctaaaaattttatagaaaatttttaaggtgaaaatttatttggttttttgaattccatttaaaaattttaaaaataaagaaacaattaattgaaacaattaatgaacttgcacgcccgccaattacagcaagtactttcttgtacatgattgctgtttgcttataaatggtggtccccccgtcgccaactgtcgctgaaaaaaatcgcacaaaatctctcgcccgcgttcgccctcgagggcacacaatgcattgtgacgtcatcaaaaaacgaacgggcgaccgaacgggacaattcgtcatttttttgtgctactaattaccattgagtgctgatggtgacagcataattcatacgcaatttgttgttgtatag

SEQ ID NO: 25562 - DNA, 1664 bp, Heterodera glycines
  misc_feature (1631)..(1631): n is a, c, g, or t
caacagactggctgctgcacagcagcacgcgtctgttcactgtatgcccctctcacccgccgctgcccgcgtagacagacaatcagacagtgcactattttcccacctttccctcgctctacttttttcaaattcatttttaacgcaaaactcaaacaaaacgccacacaaattcaaacactggacacatgatacagacactcaactttattatataagatttttctaatgaacattccaagggcactctgttcgaattgcgcgctcttttgaacaccctttgctggctgataggctttttcaaaattatagtctttcaatttaaaaattataaaatatttaataatcataaaaagtagggttcgagccccgtgggcgggggtggcttttcgcgggggcgggggttggcgggggtcagagtcgcgggggcgggggcgggggtgagaaatttctcgccaccggggacgggggcgagggtttgtttttaattagctccaaaaaatctcacaaaaaattaatttttatgaatgatgtgttgtttggctccatattcctttattcgatgtatcgcctcgattcaattctttttaggtataattgcacagatattgtctaaaaatgaccaaatttaaggattataaatatgccagaatagtcaatttttatgggtgtttttgtctaaatccagggtttctatttcaaaattttcaaaataagaataaaggccaaaaaataagattttagggtcaaaaataagaacattttgcaaaattgcttcaaatatttttacattttattcgatccaaaatgtattctattattatatttttcataaatttcagtgcattcgggatcactaaatcagatttttaacattttttgcggcatatttccaaaaaacttggtgaatgtgcgaggggagaggtccggtggtgccgattggcgccgcaagcggaaaatttttaaaactatatgaattttgttagaaattagccaaattttttagaaatttccctttttagatgaaaataaggtactaccccaaaaccagaacatttcttagaaataacaacatagaaaaaccatttattatttggaaaaaaaaataaattcaaatgaaaacgtcaaccggtgtcgaactcataataaaaattattgttaatgttgaagcactaaccataaaccacaaatattttaaaaaatataagcaaatttactttatttcataaaaatttataaaagatggttaaaaaattcaaaattgtataaatttttgcctttaattccacgaatctgccattcttaggggtgtgtttttcacccccgtgcccccgcgggggcgatcgcgggggatgcgggggtcagagtcacgggggcggggacgggggtgagccccaaaaacctgtcccgcccccggagacgggggcggggtccgaaccctagtgtattttattaaaattcatttaattattctaataatttttccgcactgaaatggcccttccctccgaaacacgcacattcatactttcatttacaaatttatttacatgttaataaggcattctgatgcttatattctctaaaagtgtgatgaataaaaaatttcaaaatttttaatagttttttanatatgcctataattttaggcttatattttaaaa

SEQ ID NO: 25563 - DNA, 481 bp, Heterodera glycines
  misc_feature (472)..(472): n is a, c, g, or t
aaaacatttgggacaattacgacaaagtcgctccattgaccgcacaaaatcgaggaaagggggggaaggcccaccacgaggccgcgaagcggccgagtgagtaccttcggtgcaggaaaattattaaggaagagagttcattatttatttgttttttgcataattaattcataaatatttttttcagaaagggttctgaaacgcaccaaattttatttacatgttagtttaggcactctgatgctttttctatcaaaaagggagatgaataaaatttttaaaaatttttaattgaagttcaatcactcatttttcgagtagtgatcagaagcgcaccagattttgcagggatactgaaaggaaaagaattaacctgttttatcacattagcttgtcatcagtttttataaaaaattttcaaaattctgagtctcctattattttatttttttttcaaaattttgaagggcgnggggggggg

SEQ ID NO: 25564 - DNA, 826 bp, Heterodera glycines
gccccgctcatcccgatcgcgacgagaacggctcgttgacagttcaacacgcgctttaacaccgcaaattcgtcttaaaccatttgaatattcccagaaaagaacaactattttacgttccgtccaatgatcgcactgcgtcttgcgcgtcgcgcgtgtcctcaaattcgacaaaggcaaaacctggaggacgacgagcgacccaaattttacgaattctgccgaacttgtggaagacgtcgtcgagctgaaattgtgacatatgaactgtgtaaattctaatttaactaaaaaattatttgaaacctcttcggaagttgcgtcctctggcagaccgtcaacgtaaacctttccctcaacattattaccaccgccgcgtcgagatgacattttgaaaagtcaaaaagtaaatattttagctacaaattatatcaatataatgcctcaaatgctttaaatttacagagaaagaaaaaacttaaaaaattacgaaattcaaggaacatttttgaggttttttgccaaccaaactggactattttgatatcattcgaaagctcacgttgagaagcttttcctaagcaaatgctaagcaattaaatacattaaaaaaagatatgagcgtttgaaaatttgttttttgaataactttttagctgaccctttttttgctcttaaaaacctttagattttgttcgtaatttttttctctatcgatttgcaaagttcaagcggatttaacataggacaaaaaaactaaacatagaatccgtttttctctaataacagagataaataaataatacgccaaaatgagagaaatcgg

SEQ ID NO: 25565 - DNA, 1180 bp, Heterodera glycines
  misc_feature (63)..(63): n is a, c, g, or t
  misc_feature (99)..(99): n is a, c, g, or t
agaaatggacaaaaataattcaaaaaaaaaaaatgcaaaatgaatttgcccaaaataataatntaatacaaagattagtgctcataattagtccatttnaaagaatgaacatcattagcagaattggccttggagacaaagcggaaaaaccgaaacagcagcagcaaaagaaaacatttggcattgttccacgccaaaatggcggtaactcaaaattaattttctaaacttaagaatttataaattatgaattcattcaattgaaaactaagcaaaaataaataaaataaacgcataaaaaagaaaatggtgagaatggaatcctttgggatgatttatctctcccgatcactagtgatctgagcatggaaaaataatacattgcttgtaaatttgcatttaattttaagcttaccccaaatttgcggcccatttcttaagagccattttcggatatttgcagcttcgtgaaaatattcattatccaaatttcaaaatgataattcaaaataaatatcattaaacaacccacacatataaatatttttaatttacttaaaatacaactaattgctgtaatcttagtgcctttctcttccctttgcatccacgagagagagagcgagagcaaaagaaaccggcattgccaaataaacaaactttgaccagtgaagagattaatgacacctgtgaattctcgtctctccccctttctcgtctcttcccttttctcgtctcttccctttttttcgtctctccccctttctcgtctcttcccttttctcgtctctccccctttctcgtctcttgccttttctcgtctcttgccttttctcgtctctccctctttctcgtttctttccctttctcgtctcttcccttttctcgcctctccacctttctcacaccccctttatcgtctctccccctttctcgtctctccccctttctcgtctcttgccttttctcgcctctccacctttctcacaccccctttctcgtctctccccctttctcgtctcttgccttttctcgcctctccccctttctcacaccccctttctcgtctctccctctttctcgtctctccccctttctcgtctcttgccttttctcgtctctccccctttctcgtctcttgccttttctcgtctgcccccctttttcgaatcccttgttt

SEQ ID NO: 25566 - DNA, 1790 bp, Heterodera glycines
  misc_feature (67)..(68): n is a, c, g, or t
aggaatgcattctcatcacctgtaaaatagaggttaattagttttgttggtgtggataatagctttnnaattattgccgtctctgcccgatcattaaggttagaacaaatttgacacaacttttgcaaagaatttaaatataattaaacaaaaaaatttaaaaaaatatatcaattttccttgtcctaactaatttgaaaattgggcgatttttaaatttttggactaattctgaactcgaatgagaaaatctttttagtttaattatgttaattctaaagaaagtttcgactaattatttttctttttacaattttttcactttataaaattcgagtcactaaaaatttgccttttaaatacaatatgcttcttttaattatttattaatttaaatatataattaccgctgatgcaaaagcaaatgaactgggcaaaattgacgaacaaataaaaattagagcaaaaatattggaaataaaaaaatttctttccatttctaggggaataaaataataaatgaattttttttttctatatcttacccatttaatagaactatttcttatgtaataaagcataaaaatattttatgtaatgatttgctaaaatcaataaaagaaattaaaaggaattttcttttttcattttacatcgcttcttctttataattgacgtgtattttataattattccaataaatcaattcatacataaatcataatttaaatgaaaaaataatttctttttttttgtcttttttcaatcaattaattttcgtaattctaacagataattattactttttaaaaatttgcaaaaaagaaaaaaagcacatgggtttttttttgctataatttaggaattttttaaaattttgcattcagccaaaaaatgaaccgagaatgtcaatgaccataacatcaatcgcccaagacaactttatatgaatagtatatttaaatctttgcaaattcccaagtcgcaacggtgtatgacgtcactcaaaaactaatgaataattttctgtcaaaattttttattttgatgattctttgagcaacgatccggcacatcatttaaaaaaggaaaaaaaataatttaaaaaaaaataattaaattttaaaaaactcaactgcgcaagttttccttgcttctgcctaggctctccttttcgttttgctttgtggtgtaaataatttagatggtagaatatgaaggtctgagtggagacaaaaagaatttatttttaattaatttttgtgggaaataattcaattgaaattttcggttttttttttcttgggaaaatactcggttggtcccatttgaaaacccagcagctctctgtactgaatgttttagtcccgttttgcccaaaattatcggtcccgttctatactaaatttagccaaaaagttttattatttttcgcttgccaaattttatacaattttatttatttacaaaaaaaattaatttattcttcatttatgaattttcttttctctcgttattggaaagtcaataaatgcatttgatggacagcacaaatcacttacatatttagtcattccaagataataataaatgtgatgattcagaaatggatagcaaaatgtgtggggaaatcattcaatgaattaatttaatttcgttatttcgcattcacaatttgcaaaaaactgataattactataaaatttgcttcttcaaatttagtcacaaatttcaaaataataccaaataaaagctaaaatgaaatcaatgtcagcatactgtatcatatt

SEQ ID NO: 25567 - DNA, 2391 bp, Heterodera glycines
  misc_feature (828)..(828): n is a, c, g, or t
  misc_feature (861)..(861): n is a, c, g, or t
ggctaatttgttggtttaaccatatttgtaatcagagaaaacttatcagaatttgttaaaaataattacgaaaattttgtggtgccgcggtgtcagggagaaaatttttgaaaagtttaatgatacttttttataaaaacggatttaattaattgaatagtaaaaaaaatttaaattcaatcctttaggaaattgaatatattttctcattaattttccaagctattagaaaatggcgattttaattctttacaaaatggtaaattgataaatttgctaacttatttttttatgttgatcagtagggggtcggaaaaaacatggagataaaatccagaactattccaccaaataagaaccaataaaattccaaatttaaggctaaattattcaaaagctcttcaacaccattatgctttccggttattctcagaaaagacattatttccgatttttttttattttaaaatgaatagtttttggttatatgaaataaaatacattttttcggttcttttattcttgttttccggaaaagtaaaaacaaaaacagaaagtgttttccggaaaagtaaaatttaaattcagaaattgttttgtgcatgtccagttgtgttttataattgaaatttttttacgtaaagcccgaatttaccggttgtgttttacaattatatttaataaccggaatttctacattttctggtaaggtatttacaattgtatttttattactataaaacacgcattttcattcggtgttttacaattgtattttttttactattaaacacgcattttcagtcggtgttttacaattgtattttntagcaccataaaaatgcattttcaggatatttntaagaattgtaatttataaacggaaaataagcattttcgagtcgtgtttttgaattgtatttcaatttagtggaaacacgaattttccggccttatttagtaattaagctttttttattttttaattttaaaaaattattaaaaatttttttaaatttttttttggtaccacagatggaggatttccaacctttggctccaattcgggatcaccacttttgggtagcatcagaacccgaaaattgtcccaaaatcaatttaaaaatttctaatttactttagaaaaaaattccctcaaaacaaataatttatttttggtgtatttggggtggggaatccatttctgcattttgttttgcaagtcaaacgcctggggcggcggctgagggtccaaaaatgggtgcccaactgggagattctggacccaaaaagagcccccgagaatcccgaattttttgttccatttttgtagagctcgaaatgctctattcaatgggcccactctggtcccaaaccattcaaacctcataaagttattacgcaaaaagtgaaaattagtttttgaatttaggggtgttttcaaaaaaccgcgattttctgaaaattttctgcttgtcgccaattagttcacacggaccattttgtagagaatcaatagggctttcgaatggtaccggtgtcaaacggatcggttagatattcgcttgctgccaaattgtgcaagcttttgcccatgcttttttatgggggtaacagttattttttaattattttttaattgctttagaaatattttagaatttataatttatttttatttatttcccacttatttgggtctgtttttatttatttaaatttattttaattaatttaactgtttttaaattattttaatttttttttatttttttttaccaattttccattgattttccatttttattttattctgcttttctaacacatttcaaattaattctgatcattctggatcacaacagaatatattatcagaataattctggtgtgtaccagaattatcagaagtatttggcgcgtaccattagtatcagaagtatttggtgcgtaccattagtatcagaagtatttggtgcgtaccattagtatcagaagtatttggtgcgtaccattagtatcagaagtatttggtgcgtaccattagtatcagaagtatttggcgcgtaccattagtatcagaagtatttggcgcgtatcattagtatcagaagtatttggcgcgtatcattagtatcagaagtatttggcgcgtaccattagtatcagaagtatttggcgcgtaccattagtatcagaagtatttggcgcgtaccattagtatcagaagtatttggcgcgtatcattagtatcagaagtatttggcgcgtatcattagtatcagaagtatttggcgcgtaccattagtatcagaagtatttggcgcgtaccattagtatcagaagtatttggcgcgtaccattagtatcagaagtatttggcgcgtatca

SEQ ID NO: 25568 - DNA, 1822 bp, Heterodera glycines
ccatttgctctgctaattgccccgtttggcctccccgccctcccttccgcttcttctgccccaatgccgcgtccgcttttccctcttcctttcccttcttccgcttctccgcctctctctgccattcctcgcgttcgtttcctcactctttccctttccttcgtctccgtcgtgtttttcctgctcactttggcattttctgtgctcattctcaccaacatcaatgccctgcacacggaagtgatggtggacatcgagcagttcaaagtaaatttgggaaaggttcggatagtgagtgaattgtgtcccatggctaagggcgtcgtaagcaaagcgtgggacggaatggtcgaacttcaagcggcggacggaggccaaaacaacgggaaaagtgccggcaaagaaaacgcacaaacgacgattgaccgacagaaaagacagtacggcacaatgccatcgtacagctcagcctatgttaacaaacagcagacatccagtgagttggcaagcacaagcaaaaagataacaacttcctaaagattgcgctgcccgagcaaacaaatgccccgccggacctccggggcccccaggcgccccgggattgcccgggggtatgtcattagggggaatttcctaatgaaatttggttggtcagagccaggaacacgtggacaagacgggattccaggaatgcctgggatgagtcagagtttcgacagtggctatcaagatgttgtccattttcgccatgcaaaatgccctttcgccccttaagggctgtgtccaatgccccccgggcccaccgggcgttcaaggcattcaaggcgtgccggggactcctgggcctgacggacaagtgaaaagttggacttgacaaatacacagaattctttagccaggaacacccggcacaaatggaggagggggctacgcaggcgcaccaggaggttatttggctaattactgatcaatcgaatggaaatcttttagaacccggagaacccggccaaccaggtgaaggtggtgcggaacaactccattcgaaaatgatttaggcactcccggcaccaacggatctccgggccaaccaggccaagcgggacaaacaggaaaaggtgggattaagcgggaggagggcccgggagcagagcgattttcaggtccgcctgggcctaaagggccaatcggaccggcggggccaattggacagcccggacagcccggtaagtgaagcgatggggaggcggcatttagaaaaagcaactgtcaggcgcacccgctgcaacgggcgcacagggccaaatgggacgagtgggctcgtcgggactgaatgggaacagcggtgggatggactcaattgaaaatttgcaacaaatactttttaggatcaccaggccaaataggaccggttggacaatttaatgatccctaattgaggagaatgacttgtaaattacagcctgggcctccaggagcaccggggcaagatgccggatagtgaggagcaatggccaacggcaccaaaaataagcaaacattccgttcagttgcccgtgcccaccccgagtccaagcggcgccgtacagacagaagcaatgaacaaagaatcgaaagagaaagagaggaagagaagcaatgatatgaaaatgatgtgtttttctaaatttagaaataaacgatttgccattttgggtgccattgccaaaagtatttaatttttaatttcaatgaaagtgcccttctcctcctccgtccctctctctttttgccacttcttttgacacttctcttctcccaacggtcatcatttccatggaaacag

SEQ ID NO: 25569 - DNA, 1427 bp, Heterodera glycines
  misc_feature (33)..(34): n is a, c, g, or t
  misc_feature (58)..(58): n is a, c, g, or t
  misc_feature (67)..(67): n is a, c, g, or t
  misc_feature (72)..(72): n is a, c, g, or t
  misc_feature (1335)..(1335): n is a, c, g, or t
  misc_feature (1406)..(1406): n is a, c, g, or t
cgattcggaatttaaaaatgagaatgaatggtnntattaagagactagattggtgatntcggggacntctcnggataaaccctcccccccaaaaaaactgactgctctccgatggcagtcccttcagcactgtgaccaccatcagtcgcccgttcgtcttcagctgcgtcttcaccgtttgtccaattgtcctttcgccctctccgtccgcgtgtcgaaattccacaaaacgttggtcgccgtcaatgagtcgaattgcaagcggaaatttttgtgcttgtttcagatggacgacgaaacggtcgctgaattgtaacggcagaggcggacaaccgaccctttctttgcatcgtttgctgaaattgagggaggggtaaaaaccatatttaaaaatgggtaaaagaaatgaatttacattacttactgaagtgcagccaacagttccgtcttcagcggtgtctccaccagggaacagtacgaatcggcgacagaaaggagcaccaagtcgtcttgcaaagtgctgacagtgaccgcttgaagttgggtcaacggaatttgccttagggtggggggaatgattatttttgaatttatttccccattttatgcgctttacctcttcacaacttccaccaatttgcctttgtttacgccgcttttcaacggcttgcgaccgaccaaaaataaatatttggccgtgagcagaaggtcaattcgggaagcctttgaatgagaaagtgcaccaaaatgccataattagttgtttacccgaaatcgtctgtcgaatttgacaacagcggcagcaaagtaaagacgttcacgccgtccgatgatggcctgcagcccgggccgttggtccatgccaatgtaatctgtggggaaagaacagcgaaattcggatgggaagtgcaacggtccgtaaggagttagtgaatcactctaattgctcactcacccgcgacaaatcggcgttccattgaaaatcggcacctttccttacggccttgcaacaacgaaacggcttcatcctttaacaatgccaaattagtaatcaattaaattttaaattgatttggccaaatgtatcgttatttcgaaaacattgctgctgttgtgatactttttgcttggtcaaatgctttttggcggtgaagcgtcggaaggcgcgttgaatcactcgagcaaatgcgtcaaatttacgctcccggccctcctccaacagaaacaacgactcgggattcttcacaaaaattttggtgtgtccgagtcggaattcagtgtccgccaattcggcagagcgacagatcaattcgcaaccctttctgaattaattgngccaaatcaacggaccgacagcattcacttaatgatactttggctccccgtgccattgtggccacgtttgngcacacaaaatcgcataacgc

SEQ ID NO: 25570 - DNA, 922 bp, Heterodera glycines
  misc_feature (26)..(26): n is a, c, g, or t
  misc_feature (55)..(55): n is a, c, g, or t
  misc_feature (122)..(122): n is a, c, g, or t
gcagaaaaagagatagccaatttccnaattttcccaaacaaacgcgcgagaaacnaaattccagaacaattagtatcggcgtaattattctgagaatgcggttggaattcctattactgtgnagcagaaaaagagatagccaattttccaaatttttcccaaacaaacgcgcagagaaacaaattccagaacaattagtatcggcgtaattattctgagaatgcagttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgc

SEQ ID NO: 25571 - DNA, 1582 bp, Heterodera glycines
  misc_feature (110)..(110): n is a, c, g, or t
agtcagcaatcgttgcatacttgccagatcggacgggtgcgcatgattccactgttccaagcaccccaccaaaagcaaaacgatataaccaaaatataaggaaaaatttntaaaaaaatttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcacgcaattatggggagcaaaaatccaacgcagaattaaagtacagactatagggaagctaatcccgaaggattcggtctccccataaatctgggcgcatcggttcggggggactgccccgaaaacaaaaaaatcgatttttcaagtgtccgtttggggtactcaaacaattatggggagcaaaaatccaacgcagaattaaagtacaggctatagggaagctattcccgaaggattcggtctccccataaatctgagcgcatcggtaggggggacggcccgagaagccaaaaaaaaattttttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatataaaaagcatcagagtgcctaaactaacatgtaaataaaatttggtgcgtttcagagcattttctgaaaaaaatatttatgaattaataccacacaagtattatttttcgaaaattatttttttcatttgatcacccaacattctagactgatcggaagctcaccaaattttgcagggaaactgctgagaaccctacaaatgcttataaattttcttagaattttttgcctggaagaacacagttcttcacacttagcacaccagcattattttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacacaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaatatttatgaattaataccacaccagtattatttttcgaaaattatttttttcatttgatcacccaacattctagactgatcggaagctcaccaaattttgcagggaaactgctgagaaccctacaaatgcttataaattttcttagaattttttgcctggaagaacacagttcttcacacttagcacaccagcaattattttttttaattattttttgcatttgatcacccaacggtctagactgatc

SEQ ID NO: 25572 - DNA, 1184 bp, Heterodera glycines
aaaaaaaaaaaaaaacctttttttttttttaaataaaaaaaaaactcatgtcagagcaggccctccaaaaaaaagacaaaaattttttcgaaaaaaagtaaaaaaatggaaaattaaataaatttacaagtgaaaaaggaaaaaagcttacaacaccttcgattctcaggacgtctccgttccaagtactaagaaggcccaacgttgcttaacttgccagacggacgggatggcgtgctttcaacgtggtatggtcgtaagcaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaagaatgaaatataattaaaataaatcaaaaagaaaaaaaatcaatttatttttctaaataaataaaaaacattgtcagaggcagtgcctgccgaaaaaaagacaaaaaaattttcgaaaaaaagctaaaaaaattgaaaatttaaataaatttacaagtgaaaaaaggaaaaaaagcttacaacaccttcgattcccaggacgtctccgttccaagtactaagaaggcccaacgttgcttaacttgccagacggacgggatggcgtgctttcaacgtggtatggtcgtaagcaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaaatttatttttctaaataaataaaaaacattgtcagaggcagtgcctgccgaaaaaaagacaaaaaaattttcgaaaaaaagctaaaaaaattgaaaatttaaataaatttacaagtgaaaaaggaaaaaagcttacaacaccttcgattcccaggacgtctccgttccaagtactaagaaggcccaacgttgcttaacttgccagacggacgggatggcgtgctttcaacgtggtatggtcgtaagcgaaaggaaagccatgaaagtaatttaataggcatatttaaaagagcctatttttt

SEQ ID NO: 25573 - DNA, 1251 bp, Heterodera glycines
aaaaaagacaaaaagggaggaaaaaggaaacaaatttccgggctttgccctcgcgttggagaaaacaatgcgcagaataacttgggaggctttagggttagcgcatcaatatttttttcagaatgtgatcggggtacaaaaaatacgggtcaaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagatcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagatcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagatcggcatgaaaaaagacaaaaaggaggaaaatgaaacaaattcgctgatttgccctcgcgtggagaaagcaatgcgcagaataactgg

SEQ ID NO: 25574 - DNA, 987 bp, Heterodera glycines
  misc_feature (159)..(159): n is a, c, g, or t
cgccatggccatttatttttcaaatattttatattaaatagatatccagaaaaatggctatctcttttttgagaaattttctatgcaacaaacgctctcgaacatgaaacgaagtgcggtgcgccatggccattttatttttcaaataatttttatatntaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttatttttcaaataatttttatatttaatagatattccagaaaaatggctatctctttttttgagaaattttctatgcaacaaacgctctcgaacat

SEQ ID NO: 25575 - DNA, 1246 bp, Heterodera glycines
  misc_feature (153)..(153): n is a, c, g, or t
  misc_feature (155)..(155): n is a, c, g, or t
  misc_feature (157)..(157): n is a, c, g, or t
  misc_feature (275)..(275): n is a, c, g, or t
ttttttctgggattatgactataaaggtcgccccgatggcgaatattccccgtagctgggaaaacagacgggggttggggatttgcccagggtcccgaggcgggtatgtacagcaggtcttcatcggacgagaaacaggcgacgccttcctgncnanagtgcggaaggcgcttaaaaaatttatttaaattttattttaaacatttttcggcacctcaatgaccgaaattgtccactgacgaattcgtttgatagtaaaaagttactttcatatntaagcaccatatatattgactgaaagaattatccgctatttgagtttaaaatacattaaagaaaataagtatgtatatatgtagaacatttaacgtgaaaataaagtcactgacgaaaatcactgacaattcattcaatgacgaaatcgtttactgacgaaatcatacagcgcccaacgcagcctcaggacgggcgcttcgcgcccgttttttaatttttgggagacattcgttcgcttcgcggcccaggaatttcaagaaaaaaaaattaattctatacaaaatttctgataaaaagaaataaaaaaatataaaaacaatacaaatattattataagtacaaatatgctggatttttcgtcttagtggtctgtgagttagtcaccaaaaggggggtctcaagttcaattcctccttgtgtttgtgtataaatttcaattttttaaagcaaataataaaataataataaatacagaacgccaaaagaacaaatacaaacagtaaaaggtacacactatattttacccttgattttatgaaatttttttagcttataacttggtgaatactagagcaaataaaaccattttatgctcattttgaagggaaaattctggagaatatttctaagttagtcaaaagtttaaaaaaattgtttattggcagataaatgattcatgtgttattttatatgttagagagaaggaaatagtacgcccaaatgagagaaaaagaaaaacctttgtccttgaaaaaaattttttcctattgaccaattttcttaaaattttgcataggcccatattttgaccccctctatcgaattctcttttgttttttgaaagtttcttttctaactcgagatcggctcttccatttttgcaagggaaaatctccggaaaattttaagttttgcaaagttttggcgttctgattactaaataaaaaataagcataattgtactgggagc

SEQ ID NO: 25576 - DNA, 2427 bp, Heterodera glycines
  misc_feature (2363)..(2363): n is a, c, g, or t
  misc_feature (2388)..(2388): n is a, c, g, or t
ttaacttttttaatagcactacttccattcatcaatgatagatttgaaaaactagcaaaaatattagttttttaaaataactaaattaatttattaaaatatttttattgtattttttattgtacttttccataaatttaatttcctcttattaacttgtttgttcgtttagtcaattgtgtaatcggaataaaaaatatttatattattttatctttatattttaatatttatcacatattgtaattccttcataaattcttgccgttttatatgttatgtacaagtaaataatcataaatacaatattattgcaaatgtttaatttttgcatttatttaaaatgtaattttttattctttgttttaattaattttttatttaatatcttgattggaaatgaaagaaaggcatttttcttgttgcaaataatataagaattgaaagctccagataataccttttatttacattaacattatttgctttttattcatacattgaattattttataacggtttaattgtctttaaagaattaattttatttttgttaatataaatttttaaaattagattaagtgggttaaatataatttgtttctttttttctttttatctttattttgattacttttattaaaaatgaatttttaaatattttatgcataaataaaaatttttttattctttagttgtttatcaattgaatcatacatttcttcgaagaaaaattctatgatttttaatgtattaatataatgtgccttgtctatctatatatgaaatctaaaaatgtaatattcatagaaaataataggaaataattatatttataaattttttatttgggtaaaaataggataaacccgcagacaactgaaagaatatgcataaaataattcatgtgcgtagataaaaaccataaaattgagatttttgggagagtgacgcagatgggggagtgtctgcgccgtttgttccgatttagccgtcgccaattgcccaatttgccgcccaagaaatcgcaccaaaaatactccgcaagtttatctcaaacttgggtaattaaaccctacacttacaataaatgtgcgagaaatacaaaagggggtggggaattgtgtcaatggggacaaaatgggaggggtaaatgcaaaggaaaaatggcacaaatggggggcacatcaccggagaaaaaggggggaagggtccgggcgaatttgatctcccgcaaattcgcctctttccatcaaatgatcgccgggacattcgcggctgacgttcagtcgcgacattccgacggctttgaaaacgtcgtttggagcggaacgcgatcatttgtcgtttcagctccatcacgagcggtgacagctcgggttcctcttgttgcgaacttgccgtttcattcgctctcatttcctggggcattggaggcggtaccagctcaattgcttcaatccttgaaattgccggtgctcgccgtgtgcctcgtgtagctctgttccgctgcgtccattgatttcccgtcaccaaattgcggatggtaacgatgacgggccccattaagtagacccataccaagggtatcaggacatcgcgccctaaaatgaatgtgacgtaaatgaagcatgccgttgtccagtaggagacgagcagccgaagtttgtccctgaaccattcttcggtgaggccaatcacacgctcgggagagctcctagtgtgagcgcacgcgccgttttgtgctccttctccttcgacttccattgatccaaacgcagccattcgtccaagtgcgcgaatagcccttcgcctggttcgttgtcgatcgtccatcgatgaaaaactagcggcgtgatttccaacaaagatttgtctcccgaggcttcgtggatctccgatgctgctggagtcgattttctggatcgtagcggtgcgtgtgtcgattttgatccaattgccctggctcagctgcagataatggtagcagaaatttccacaatctgcgaatggtgatgacgctgtgagaatgtgaagctccggatccaggaatggtagtagttgttgactgcttgatattccacattttgcattgcaaacagcgcatgaaaaaatttgcatcgtgtcttcgtttagccacctggccataacatccttgcgtcgtaaaagtcgtctggcctgaatggtcggatttcctcctctggaacttctacggcattccttggaaaaaagctacgcgattgatcggcttgtggcgagttgtcctgcggttaattgtgctgcgagttgctcctcctggatggctctttttcccaatccacgatcgttgacgatcttcaggtactcatcctccaggattccanacgattggtccacaagcgaatcggntttccgttgcatgctgtttccattttcgcatctttgcta

SEQ ID NO: 25577 - DNA, 1321 bp, Heterodera glycines
tcgaattaattataaaaaataatttatttaacaatttgaaaaattttcagatttttgactcaaaaataagattttttatttcaaatttctcctttataaatttttctatatatttttaaaattcgaacaaaaaatctaaagtttaatttttcgaatttcgtctaaaaatggtttaatgatcttttattgcatgagtggatagctttcagtttgtttccatgtgtttaagtcgttttttgatgaaaaagagaaattggataattaaattttttattttttgttcgagtttgggtccggatttcggaattgttcgaaatgaacgtcatattcgtgatcagcgaccccgaaaactccagaaaaaaaaattaaaaattattttatgtggcgtaaagtgaaaaagtaccaaaaattgaaaaaacctattttcacctattctggcgttttgcacaaaatttaacaaaaatgtaaaaggaaaaataactattaagaatcggccccaaaatttaaaaaaagggcctaatttgtaagaatcgaccctaaaattttctcaaaaattcatcttcaaattttatttttttgaaaggaaccatttttagggctatttttgggggtttcttaggacctaaaacccaactattttggtacatagtttttagaacctataaatataagccttgatagtcatcaatagggatgcgacttttagtgacgaaaaatcccaaaatagttaactaaaatagtgagtaaaaatgccaaaatagtgagaaaatagtgccaaaaagtccgaaatagtgacgaataatgacaaattttcagccaaaaattgagcaaaaataatttttattcactatttgcagttgcaaatgagtaggactgggatttttgagggcaaaaaatacaaaataggttcctaaaaaataatttttagaattaaaaatttttgcaaagaaagtgaattttgtgaaaaatttttcatttcttaggagtgatttttgaaaatttttatgtcgattcttaggggtgtattttttgaaaaaaaaattttaggtcgattcttaggggtgtattttttggttttattgcgtttttgttaaggaattttccaaaaaatgttgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaatcaattgagcaaaaaatttagttaaaacctaaaaatcgcatccctagtcat

SEQ ID NO: 25578 - DNA, 1420 bp, Heterodera glycines
  misc_feature (21)..(21): n is a, c, g, or t
ccctagcagggtggggtgctncactcggaaaaagtcccctcatagacggattcaaattgccgcatttttgaatgtttattgcaaaaatatgcccttgcttgcattttaggtgctcatccacatcattttggcaaaccgtgacaccgattatggcgtgtacgcctcgggcacaattgcactcgactgcaactcgcagagcaagtggcttgtgccgttgaatgcaatgcaacaccagggccttgaagtggacagatggtcatgtattcagtcggatttggcggcggccgctgcccgtgccgcggcggccggctgattgtgagcaatgtgttgtgattagtgcaagcttttgccgaaacggtgctgttcgagcgtcgaaaatttcccgggaacagacatgaagacgcgtcgcgaaaaccagagctgagacttgagctcgagatccagtctagactccgagtcttgaaattcgagacggagacgacctgagtcttgatacccaaacttggcctgagtcttagtcttgggacccagacctgaccttaagtcgcaaaaatcgatatggaagtttgacctaacttctggaccttgtcttattatgtccagttctcgaaaacagagatttgacctcgagacccagtctgattatcaaaaccgagacatagaccaaaacgtgagaccgagactgcagaaaaaaccgatacttttctcgaattaagactctagagtctcgaacagcacttgtaagccgttccccctcacatggggtggcgctaaagaagaaaaaaaaacaaaattttaatttattttttaagtgtgtcttaatttttatgcatagtgccctcctattttcaagtacgtacttgccattcaagtacaagtgtttcttattttaaaaactgcccaataaaatttttttttgaaactcacccaccgtacacccagtgccgttacagtaacactcgaaactgttcacacggcagggctgggacgcgaccgcgatccgcgatgcgcgatccgcgattcgcggcgttttttttgcgcgatccgcgaccgcggcaatttgaatccgcgatgcgcgatccgcgaccgcgggatttttctgtgcgcggcgcgccgcgcattttttagggcaaaatttttataaagaaaatttattgaagcgattttcttttttgaatatttagatttgaaggtataaaattttgaaaacgaccaaaattcgaattttctcgcgcatttaaatggaatatgcaatcagaaaatatttatacattcatcgttcattttatagacaattttactctttgtaatttagaccaaatgaccaacgaaagactctatttggttttattttgacaaaattcacaattcttcttatgccaaatgtaagacatgcaactataaagttgacacagggccg

SEQ ID NO: 25579 - DNA, 1016 bp, Heterodera glycines
agtttggcaatacgaaatcccgtatccaatgtttgcctaattttgtgtgctatccgctaattgttatgtatgatccattttaaattaggggtgcttggtaaaaactctcgaaatatttttggtaatccagtttggcaataacgaatcccgtatccaatgtttgcctgattttgtgtgctatccgctaattgttatgtatgatccattttaaaattaggggtgcttggtaaaaactctcgaaatattttttggtaatccagtttggcaataacgaatcccgtatccaatgtttgcctaattttgtgtgctatccgctaattgttatgtatgatccattttaaaattaggggtgcttggtaaaaactctcgaaatattttttggtaatccagtttggcaataacgaatcccgtatccaatgtttgcctaattttgtgtgctatccgctaattgttatgtatgatccattttaaaattaggggtgcttggtaaaaactctcgaaatattttttggtaatccagtttggcaataacgaatcccgtatccaatgtttgcctaattttgtgtgctatccgctaattgttatgtatgatccattttaaaattaggggtgcttggtaaaaactctcgaaatattttttggtaatccagtttggcaataacgaatcccgtatccaatgtttgcctaattttgtgtgctatccgctaattgttatgtatgatccattttaaaattaggggtgcttggtaaaaactctcgaaatattttttggtaatccagtttggcaataacgaatcccgtatccaatgtttgcctaattttgtgtgctatccaccaattgttatgtatgatccattttaaaattaggggtgcttggtaaaaactctcgaaatattttttgttaatccagtttggcaataacgaatcccgtatccaatgtttgcctaattttgtgtgctatccgctaattggtatgtatgatccctttttaaaataggggggcttggtaaaactct

SEQ ID NO: 25580 - DNA, 1492 bp, Heterodera glycines
caagttgtattggataacaataaaaaagttatagtgaaaaatgtgcgctcgtactaaaacgggcccgtactaaactgactcggtccgcattttagcaaatctaaaatagattacaataataacatagttagattaatcaaattgatcgaaaatgtaagtgagaaattttgcgacttagcggaatcttacgggcgcttcgcgcccgtttctaaatttgttgggctattaaggccgcttcgcggcctcagacgggcgcttcgcgcccgtagattatatgaacaattcatcagaatttattatatcattagaaatcaaagtgctccaaatattaatggtattaaattctaaaaatagaaaataagtagaaaaataaaatataagaattgtcgaatatacaatagaaaaaataacaataaatgcagaaaagaagttgaaactatcgattagaatataaaacgagaaaattattatttagatggatgaagacactttggcatgatattaattgcataattatcttttgctttcaattttttaatatttcataaaagtgtacgtactaattgtaataaataatcatttatttacttcatttatttaattaagtacaatgtattgttacgattatatgaaaataatcatttatctttttatagcaataatatttaatattatttgaataggtttaaaataacttcatagcaacttttttttttgaattgttcattaatatatcttctttatatactttgatttaaaaaataagcaattaaattaaaatatttatgaataaataattatttttgatagaaattattcaaaatattaataattaaaatgtttttaatgaattaatttgattattaggataattattatttatttaaaaagtctttctttatttatttattttaatttcattctttgccctgactttactttgtgatacttctcctcatttacatagatacattataattatggattaaaaggtatttatttattttttaaatttattaattttatttcaatttatttacaaaacatatttttttggtatgaaaatttattttttcaatattaaaccttggatattaatttaattttttttttgccaacatacttggttatattaaaaaaaaatattatttgaaaatttaagaaacttcaaaacacacataataaaattgcacttaaaatacttgttgggaaagattattggctttgctatttagaacaataaaaaaattttgatttataaattcaaaatctattaaaataagctaattttcatttccaaaaaaagatttaggtatttaaaagcaaaaaaaattgtttcaagaattagatttatttaagaatgaataaattttaatatttgttaattcttacttatttatcacctatatgtaaaatagtcatttgattttttagcaattttaatttataagaagtaaatgtatttaaaatacatttgtatattgtgttgaat

SEQ ID NO: 25581 - DNA, 1196 bp, Heterodera glycines
  misc_feature (58)..(58): n is a, c, g, or t
  misc_feature (63)..(63): n is a, c, g, or t
  misc_feature (98)..(98): n is a, c, g, or t
  misc_feature (105)..(105): n is a, c, g, or t
  misc_feature (122)..(122): n is a, c, g, or t
ttacgtgttggagattcgtggcatggcatcggtcctttgatgaccagcaaacggcganccganctgcgcatgctgccttgaaggggaggaagcgccanagacaangctgacccttcccgaangcctcactttgtccgtgttcgctttgccctctgtccaagtgcgacttttcgtcaccaaaaggcacttgtccgattggcatctgcggcaaagtgccgtcctttgtgccggaaaatgtcggcgcgatttgtgcctttgcggggccttggctggcaacggcaaattccgccgggttcagtcggtgcgttgccatcgcatcgcagccgtacattcgattgatcttcgccagatcgctaaatccgaatttttggttcactcctcaaaagttccgctacaaagtctcacatctcactgaagtccttggcgtttccgattgtggccgcaaaacattggggggaggggtcggaatgaatggggaggggtgcctttgtcttacctcctttttttggcaacatcgtcgggaatccgttcttgctgaatgccaaactgtcctaattttcatttatttgccaaattcaagacacaaatcaaaggtcaaacgaacgtaatggaggatggatttgtagtcgtacggctgaccgtaataactcgttttggtcaagtcaattttgccgaattggtcaagggcacctcaacaaaatgaccagagtaaataaaagtgattttccccatttaatttttaataatttaataaaattattgcttctaaaaattcgcataaattttaatgttgacacttcgaaactccgacattttggaaacgcaacattaagtataaattacttttgtcgatgttttgccatattatgtcaatgtaaaagtcgcggtcccatcgctctgaataattaataattatgataattaaacactatcatttcatattagctgattaattaatgaaaattaacaaaaatggaccgtgttcgtggtaaaagccaacgacatgcattatctattggaaagggataacaaactcaaaagtcattttcccattgaatggttttattacctcgtgaattattgtagagtaatccatgcaactgaaatggttggaattaattactctttttggtttaattgcccatttaattgccgattaattacccattgtccagcgaaaggacttgactccgctg

SEQ ID NO: 25582 - DNA, 1177 bp, Heterodera glycines
gcgggggggggggggcgacttgaagaaatcaaacaaatgggggaagggagggataatcaatgggaaaaatgatacaatttttaaattttattaaaaataaaaaggaatgagtgcggttgcactttgttaattggaaaagggggaagtgatggacaaatcgaatcgaaaatgttgtgaatgacggcgaaggtggagtcatcaagaagagagagacgatgataaattgaatgggacggagggggggggggactttcgactttcccctcgcattttgcgaccatccaaatgatttattgcccgtttgctaacaaggctcctctataaaagtacgtgattttgcaaaatgaaatggcaaaaaattgaaagcgcgagaacgaactttgacccgcagtcattttaaaataatcaggggaattttccgagcgaaatgataagctgataagaataaaaaaaataggactgataaaagcaactgcacataacgatatgtataagggggagtgcgctgaattatgggttccgacttttttgggttcggaattcctcttggaagtcgttttcggattctatttttcaaaataaaacatacatttcgccaaaccgaatgataaaatttgcgatttttaattaaaatctggctgaaatttccataattttccgttttcccggcgacgccgatttatttcacctacatagtaattagtggagaataccgtcactttcattgtctgtgtcggcattctcttcttttatgtatctactcactgttaacgaatttgtgtcttttaattcattttaaggctttctcaattctgaatgcttcctttgctgataatcgatcaaagggaatcaatcatcaggcaattgataagagaaagaaaggcgagacaaaaaatggaactcggaaataattggccaaggaaagagccaacggccaaagacagcgaatgattgggcggcaaaagggtcgttttgtgctctttttctcgtccgccccattctttgcggcttttctttgtcttccttcgtccactatttcttccttcaacacactttctgattctcattttgcattggaatatttgtggccaaagcaaagtcggcgaatggcaattgcaaagggccgaaagaatggcacggacgagggaagagaaagagagggcgggggggagatagg

SEQ ID NO: 25583 - DNA, 1470 bp, Heterodera glycines
  misc_feature (11)..(11): n is a, c, g, or t
gtcccgtttgntgtcaataacttgggttaacacagcccgttgctgtagcccgtcacaaatgcaacaaacaaacaatggcacaagcagcaggaatagcatcgacgagagcactccaccgtcaagaaaacagtaaaaaatggccatggaaaacagacaaacggttttggccaagttcgacagaaaagcgggtggacactgctttaatctaaaatatttggagaatttaatgaaataaattttaaaaaattagttgtgtatataagagcattttattcgtttataaatttgaaattattcttatttaaaaaatatttatttaaacacatgaaatttgatcggactattttttaatacaaaattaattgaataagttaatatcatctaaatggataaggaagaacttttgaagcaccctaataaaatttgaattaatttaaaattattaaacaatcgaaattcattgatttaaatttcttatattatgtacaaaaaaagaaaatatttttaatcgaaaaaatgcaataataataaaatttataaattaaaatttactttaatgaagcagggtatattacggcaccaacaattgccgaaacgtggtggacaaggtgaaaaattagcggaaaccaatgcaaatgctcaacgccagaagattttcggagaaaaagcaatggaaacaatgcccttgacaggccaaaagcaatggccataatggccaaggtcataggatcgagatgggattgggacaacattcctttactaaaatttaaaattcaattttctcaaaataaacaaaatttgataggagtgatgaatttttcaattatgatttttttcggtatttgaactctttttggctaatttgagttttaattttttttttctgaaagaatttttgagacattaaaaattttaattgattaaaattaaataaaaaattcaaatatttaaacaataacactaaaaatggcattcaatttcaccataaaacaaattacaaaatcacatcaaccatttcgagtgccatttttcttcgaatttaaaagataaatgccggatcatcactattaattttgatgtcatcatatcagaaagcacacaaaataattgctttacgccccaaatgacgtaaaaaaataaggcaaaagccgcggtgtgaaaaattcgccgccgcacagataagccaaacagtgaagatgacggcacggcactgtgaccgagtgttccgtgccgacaaatttgcctttctctcgcccccccccaagggatgatgttggggaggggccgcgaagtgtttgtgccgagaccaaagttattgaaacgaaaaaatggggattttttgacactgatgaaatgccattattgcagatgaaaaattggagggagagagcgagaaacggattaacagcggattggcactgctaatgatgaaaaatggtcgaaagcatataaagaaaaaaaatggtgaaa

SEQ ID NO: 25584 - DNA, 2277 bp, Heterodera glycines
  misc_feature (104)..(104): n is a, c, g, or t
agcaaaattaaacatcacaaagtaaatgttgttttcctaattatgaaaacaatagatagtacgttaaaagagagaaaaattagagaaaaaaagattttgttttnttctctgcactctctcttttttgtacacatctctccctttttcgggtgtgtgactcagaaatggttgccaaaagattcttttccgcgacaaataaaagtcctttttctccgttcttcgttcactctcattcatattttttgctgctcatttcgtgagttgtcatcattttttatctgatttccatattaaaattatccctccaacatttcttaaatgtccgaattcggctcattcattaagctttttctataaattggtggcatttaatttatattatttttgacagttaacaaaatacgccccctaaaaataaaaaaagaaatctttccaaaaaatttctatctctttttgtaaaatgccatttaagcaaaattattttttgatggcatcgtccgacagaaaaaaagaaaagttttcctccgacaatcgccgactcatttcttctgccgcaattggtgaacatgaacagcagcaaccgatgggttcacatggaaaacggcgaaatgttcgcgtggccaagaaaatgaacaaatcgttagggacgacgaagccaaaacggtggaaaaattggcaaatttttcttttagggtccatttttttggattttgggagaaaaactcaacttttgccagttaaagcaatttatttccccgtatttcagttgctgttggatttgcgctgatgtgtggatggacattttccccttttttaaccgtcctcaactcggtctcaaattggcaatgctttcgccgcgtttcaatgttttggtggacaaacatttcgatggcaaaagcgaattgacacttttgagattggtggaaattcagaagccgggaacggcaccgaaactttctgtgcttttcaacaatcgcaaattggtgccatttccgttgcctttgcatccgttgcccagcaaaattcactttacgaaccttcgaattgtgtaaatcagagcattattattaactggtaaaagcccatttgtttgcttttcagttactttgatcactccgtcgtcgcttttctccgctcaaatcaacagattttcgccagaggaggcctcaatttgtatttggtggttcgagcagcacataagcgtcttctgcagccgactttggatgttttcgtccgtgaaattttgcccgtttttgcgccgaacattcgccattggcaatttgccgaagatgattatttggacgttttgcttcgactcacttcgccctcaatgctcaccgatctcaatcagctggcttcaatcaattccaattgtttgctgccaaatacaacttctgctgctgctggcaaagcgttgtttgaatggttgcactctccgacgaaagatggccaaccgaagcgattgctttgcactgtttattgttcatcatcaccaattcaggactgtgtcaaccatttgaaagaagtgtggccacattcattttcgtcgttaaattgccattgattttgttttttctcatttttaggcatttctccgtgccatcactatttcttccgtctgctacagaattcaatttaatttgttcaccgacgaaacaattgagccatttgaattggtcaacgacagaagcaatgaaacgctgactctgagcaaacaaaatgccaattgggtgatgaagcgatgccaaattggacaaatggttcagtgggaggacgaaatgccgaacaatttgaacaattccggcattttttatttgagcggcaacagaaagcatcctggctggaacaactttaataatttgtgcatttgtttgtgtggcgacaacacatcctttgggtgagtatgggcagaagcaacgatggcattccgaggcccaaaaatgtttaagaaaccgcaattccgtgccatccctatggtgttaacataaaaaagagaaaagaatttcaaagatgtacgttcgaattgcaatttaccaaaaaaagattttggcattttcaggatttggataatccttcgaaaaaaacggactctgacacatttcattttggcccattaaaactcgaataaaaattcctttaatttagaccattttctccaccagcggcgggtcaaagcggcggaaaagatgagaaatgatcagagacattttggagaatattgaatggacaaattgatctgctgatcacgtttgatgctcatttttgctcgttaatttt

SEQ ID NO: 25585 - DNA, 1775 bp, Heterodera glycines
  misc_feature (1747)..(1747): n is a, c, g, or t
ccaaatttttgcgttttgaaaaatgctttttgcaacttctagatttgatttttgaatgtctattattattttttgcataaaatgaataaagatactaatgtcatggagcggaccgaacaccgtgttttgtaaatggtccattattactacatttttcatcagcgtaaatttcatcatccatactcaattttctgcacgggagaattagcgttttaaaaaatacctaccgcgaaatgaccatttttacattattaattcaaactccttaaaaaatacgtttccattgggattgatctcttgcttgaaaaatggcaacatatttcgaaaataataggggctatttcgaatcatgattttggttagttgaatttatattcaaaaaaaacttctaaaaaaagttgtgcggaaacttatgtttagggccgcaacttttagtgacgaaaaatcccaaaatagttaactaaaatagtgagtaaaaatgccaaaatagtgaaaaaatgtccgaaatagtgacgaatagtgacataatttttagccaaaaattgagcaaaaataatttttattcactgattgcagttgcaaatgaggttaatttttttgaagtgtgtaacgatggggcatttcacgtttacaatatttttccaaaaaaattttgaatttttcattctccaatttttgaaaggaatctttgctgagacaaaggcttcacacaaatcgaggttaaattggtttggaacattgtttggtgttgtcaaaaattgctgctgttgtcctccattgttccgttccaattttgccttgtgttttaccgtttcgttgtgttgtttgagatgcgcgaattgcgtgcaaggaatctgtgaattttttatttgaagttgtcgttgttacctgttgttcacataactgacaataaattattttgccagttattgaataaaaggcggttcctccgatccgtcgaatccattcccgaaagttggccgattttgatttaatttttggcatatagtaaataaaataaaattaaataatatttagacggataaacatgtgattttcgcaatatattattgcattttggcaaataataataataataagcataaaaacatattgattgttatttccgtaaaattgcattttcattatttatatagacgaaagaaagaacaaatttatttattttattcacaaaaatgatttctacaattttattttttggatttatttggttttttacccatatttttctttgttcggccccaaattccgtgaataatttgacgttaagcaaaggtttttatgcactttatagcaacaaaaaaaaacaacctatttttaaggctttacgctgtttgacaaatcgccaaagttttcgattcaaatgaaatcggatgaacaaaaaagccaatccgatatggtcaaaaatgttttgaaccggcgccatttttcagcacaaacgccaatagaaatttgtgaattattttttattgatatttttaattccataaaatttttcagcacataaaagggcggtagaagcagcagctaaaaagaaagacaattcgtcaattccgccaaatttcaaatgctctctcaatgagtatttggccgctgttgtggcttataacggtttttatttcaatgttccagtgaaaacaatcgcaaaaattgtattgagtttgatttttgctgttctgtcctcccaaaatttgtccacaaaacagcagcagaattctaatgagancatttttgatggcattttgacatttgac

SEQ ID NO: 25586 - DNA, 1300 bp, Heterodera glycines
taaccatcggaggcgcgctcgcttcgctcgcgcacctcgcgctagtcgagctttgaaaaaatttattatcttctcttctctcccacctctctttctttctctctctcctctttttctctctctctctcttcctcctctcttctatctctctcctcttcctctctctcctcttttctctctctctctctcctctttctatctctctcctcttcactccctcctcttttctctctctctcctcctctctttctttctcactctcctctttctatctctctctcttcctctctctcctcttttctatctctctctctctctccttttttctatctctctctctcctcttctctccctcctcttttctctctctctccttttttctttctctctcactctcctctttctatctctctctcttctctcccttctctcctctctttctttctccctcttctctctttctctctctctcttcctctctctcctttggtctttctctctctcctcttctccctttctttctctttctccctcttctgtttctctctcctcgatttttccaataatgaagaaatatgtgctcgctcataacacaaaaaagacgtaaacaacaaacagaaaagaaaagaaaaaaagactgaactattttccaaaaggaattcgtttcgataaattgtttacttttaaatgtattagttacagcgcaaaattaatatatagattttatgaattttgcaggcttatagcccttatgcctatgccaaaatttaatgaaggcttaaaaatttctcgcccaactttttatgatcactcttgaacaacgtatatttctctctaacaaataagctgatcaatgatcaccagcaataactaattttaaactgtcaaagattcggcactgatcagacagtgatcaaacagtaaaatgatatacggatttaaatgacattgataaaaaaattgttgataattttcgtacaccaaagctgatctgttgctgaagctgttgtggttgttgttgttgctgtgccgtcggtgccgtcccggcggcgatcagtcgcattgtccactcggcattggcacgcgcattttcatcgcacaagcggtgcaatgtcacaaccaaatcctgtgaattttatttaaaatggatatttaaaatttgagaaaatccgttttctgttcgaccaaaattttggtgtgacccgaaaccaaaactctaaaagcacataaacattaactgttcagatggcacgcagcaaaagcatctcgtatattccaaaattttcgggaccgaaatctc

SEQ ID NO: 25587 - DNA, 1299 bp, Heterodera glycines
tatgacataaatattaatattttattgttttagttccgattgtaaattcaaaaaatggcgaaaacgaatcggcgaattgggggaacggcagaagcaaaatcattgtgattaaatatatttaattaaatgagttaattaagcaatggctgttcaaatcgcacaattggcggatgaacggaaaaagtacaagaaaaaatgcgatgaattggaaaagcaactaaaacaacaacaaaaacaacatcagcaggagaaagaaaagggcaacaacggtaagggaaggatattataaaaaaaattcataaaataggcaaaatgattttgaaattctttaaaaaatatgcttatagaattgttatgcgattgcagataaaaaagctttaaaaatatttaaagaagggaatggcattggcaaaactgagaaaagctgtggaacttcttccgctgatcaccagcaacagcagaaggtgaactaattacgctatatttagtttcggcgggggggggggggatacggtggctgagtcggggatacggtggctgagtcggggatacggtggctgagaatttttcttttcaaaaaataagatgattttttagctttaaaaatgcaaaaaaaaggatggtgtgatctatacatatttattatgattgccattagatcattaaagaattaattattcttaattattctgtacgatggctgaaatttaaaagtctgttaaaactattttttagcaatttgttcaaatgtttattgcgaaaaaggaaatggaattgataaactcagaacagaggcgacaaatttcgaagttggaaattgaaaatgtgagaattttaacacaacaattgatattttagttaaattttaatcacattcattagagagcatttggagaagaattgaaacgccagaaaatgatttcatttgcattggaattggaaaacaacaaaatgatgatggaaaaaaagcagaagcaaaaagaggaaatggcaaaggcgaaatacggtaagggacccatactgtagagggatttccgtatacagtatacacatcactttgttaaaacggcccttttgacctctaataaccgaaaaattttccaaacaatcaattacaaaagctctcgagaatattaaaaatataatataactttctaaacattggtaaaaaatttatgtcaaaaagttttgaaatttctatgcatattttatttaatacctagtgcttattatctaaattcaatttaaagggaaaagagcagttactgctggtcaaattgaacatttgcaaaatgatcg

SEQ ID NO: 25588 - DNA, 1635 bp, Heterodera glycines
catgtgtaagtttaacctgccagacagggaaactgcgttcggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaaggatttcggtccgattttatttggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccgacggatttattcgccctggtggggagcttcccggaaacgaaagtcttccgcttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggac

SEQ ID NO: 25589 - DNA, 2034 bp, Heterodera glycines
acccaaccattattttgggaaatatatgatagtatacaaatgaaaagcccgcctgtacggatattttgtctactggcattcgcctattcacctcaaatcggacgtttcgtcaacaggacatcttgcttatacttattattatttttataaaaatgataaaatctaaaaaccaacttttggtcaagaaaaaataaatctttttgggaattttgttaatttacaccggtatttatgaatttttttcgttttattgcgtttttgttatataattttgaaaatgtcggaataaaaataggtattttaaaatgggcctagaagctccaaaatatatgaaaaatgtgtgtgtttttcgtgttatgttggcgaagcgtccgattttggattaataggcgaaacctaagttttttttgttagtagttgaaatgccgagtaagcgagatgtcaagtaggtgaaatgttcgattttgcctttgtgggccaaatgtcatgtaaccaaagcccacaatgctataaaaatcttttttgttttgttgtaaaaattgcatattttttttcaattcctttgtatgttgttttttttttttgtattttttcttgacagaattagttactttgaaactacaaaatcggcccgcacgcaagctctttgtaattattttttttcgcagggaactcaacaaaacgccatacaaatgtgtatgcgctgagaaggataaggacagcgacgaagcagagaaagaaaacacgggctggcattgaaaaatttaccgtttgaatacctcagggcttcgattgaaaaattgttaaaatcagaatccaagactaaaaaaatcagatttaagatcgaaaacagaaaatgatgactttttttttacttttcattttatctttttgttttctgtccgctatatataaaagatttttgagaataggtggagtcggaggctgcgccaacaattttttttgaaattttagtcattttttaatttgcatcacaaattgccaatttgggcaaattttaaaattaaggattagtttgtgaactataccaataaaaaatcaaatttaatgattgatttatgaaatcagaaaaaaaaattgtcactgccccaaatacagaacatttctgaccagaacagagatcgaagccctgcaataaaaaagaatcgcttttgatttgattatttattcatacacccgacattcacttaatgaagatgaattggaaatgaaataaattcttttttttaatttttaaagctttggcatgagaaacagagaatattttgcattttatgactagagctcggaattttcaaatttgcggatccgcatgtgggattagaattcaaaattttgcgggacgggatccggcagggactaatacctcaagtcccgcatatttcgaaaaaatgcgactttgatgacttggatcccgcaaaatcccgcgcgggatccagtcccgcaccgggcgggctctagtgtacaatgtttttccaaatatttcttttctgtttttgaaaaaaagaacttagaaatacaaatttgaataattaaattgaagagttgacaataattcattaataaattttaaataccaaaattcaaacaaacaaaaaataccttttaaattatactgtcactaaaaattctgaacccttttttcaaaaaccccgtggggctcgctccaaaaaatttaatcaataaatttatgaaattccttttttgtattattaatagggttagacgggtccgggtatttgggcaaaaaccgggtccgggtattgcctggtccagaaaaaccgggtccaagtttttaaaccgggtccggggtcgggtacccggtaaaaccgggtattaaaaaaaatccaaaataattttttttttcaaattttttcaagaaaataaaagcttatacttttaaaaaagcatgaaaaatataatgttttacaaataaacgctttattaattgcccaattatttaattgttatttaaccactttttttggggtgcgctttttcgaagaacttttc

SEQ ID NO: 25590 - DNA, 1412 bp, Heterodera glycines
tctagagtcaaatggtgaaataaaatttataaaatagagctaaaaacccgcggatttttgtagcattttacttttcctgaatatcttttcagaagcgagttataaatttttttctgaaaattcgaatttttccagaaattctggaataacttttttccttttttagatagaaattccaaataaagtccataaaattctcctgatttttctctatttttaaggctttaatcctgtaaaattgatcaacccttcgatttgttatgaatttttaaatattaggccaaaatcccgagggccaaaaaattgccaaaaaataaaaaatttttaaaaaattccaaaaattctgaaacgtaaaacaaacatcagattcgtgctcagcacatcaaaataccccagaaaaatatttttgacccccattttcaacccaaaaaaaatttccgaaaatttctagggggcctagctcgaaaaattttgaaaatttttgaacatgtagtacaccattcgatagcatttaaaatgctctacaaaaatgttctaagacaatttttcgctaaaaccaacccctaacgagttatggacccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaattttaaaaattgcaaaaatcgagctcattgagctctacaataagtctgctggccaccctgcgctcaggtcaaagcctaatgagttattcaacggggactgaactggaaaaagttggtactgaatttttagccaaggctacagcctcgggagcccaacgtagggcttagggttcgctggcaaagttgtcgaggacactccaacttgggtccctcccagcgggaattttttgatccgagttttagaaaaaaagttatgggctaacaaacgcaagaaaaagtgagaaatcggtccccgggactcagtcgtccgcgctgaatttttctctatagttttcccggatgcgcctcaaaaagttgtaagacccttccactactttcagggcgctcccggccttcggccgggagaaaatggttttagcaacgaaactccttgtcaatataacgtatatattaaactagcgtgtcgcgcagtaattgctcggtgtagacagtatacttctggtatatatgggcgggcgctgacatgagcgcttcgcgcaaaggacttcgttgctagtgcatgcgcggctgccttaatcgatgcgtgtatgggaacatgcatggggcacccccaccc

SEQ ID NO: 25591 - DNA, 843 bp, Heterodera glycines
tttcactgaaaattagccaatttataggtaaaattttgaaaaattttatagggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacatcggcccatccctgcccggcactgttcaaaattcgctttccgcttttgtcaaatgaggaatttacgaggaaaattggtaaaaaaataagtcaaaatttcaaactcgttttctgatgagatgccgtaaaatattcatagtttttgtggcgatttttaaaaatgtttttaaaaatttatttttcaataagttaatacatatttacagttcccttcggtgttttgtcaaaagatgaagtgatcgccgtttatcagttcaaatcccttccaaattgtcatgggatttccgacggaattttcccaatgccattttcgactaatggacggatttctgatcgaaaaaagggcacacttttgatggacattgaaaaagtgtcagaatttgcacgagaggaggttgagagcagtcggtacagcgaaaaagtgtacataaatggattaccatggaaaatattggcacaaataaaaatgaaaaatggaggcactgacaatgagaaatggttgggcttttatctttggtgctatgctccaaaagaaggtgcaaaattactaataattaatatatatattaacaacaattaattaattgatattgagcagaaaattggagctgcaaatgttcggcaactcttcgaattgtctctctaaagagcggagtgtcggatttc

SEQ ID NO: 25592 - DNA, 1584 bp, Heterodera glycines
  misc_feature (1409)..(1409): n is a, c, g, or t
  misc_feature (1411)..(1411): n is a, c, g, or t
  misc_feature (1422)..(1423): n is a, c, g, or t
  misc_feature (1426)..(1426): n is a, c, g, or t
  misc_feature (1452)..(1452): n is a, c, g, or t
  misc_feature (1465)..(1465): n is a, c, g, or t
  misc_feature (1471)..(1471): n is a, c, g, or t
  misc_feature (1477)..(1477): n is a, c, g, or t
  misc_feature (1480)..(1480): n is a, c, g, or t
  misc_feature (1489)..(1490): n is a, c, g, or t
  misc_feature (1496)..(1496): n is a, c, g, or t
  misc_feature (1501)..(1501): n is a, c, g, or t
  misc_feature (1515)..(1515): n is a, c, g, or t
  misc_feature (1517)..(1517): n is a, c, g, or t
  misc_feature (1522)..(1522): n is a, c, g, or t
  misc_feature (1526)..(1526): n is a, c, g, or t
  misc_feature (1539)..(1540): n is a, c, g, or t
  misc_feature (1546)..(1546): n is a, c, g, or t
  misc_feature (1573)..(1574): n is a, c, g, or t
tgcgctctgatcgaagacttctttccaccttcctgatcagcccccgccagcaattctaaccaatttggtggtgccatcgcaagcggtttgtagccagttgcgcttaaagcggcacgtgcaacgaagcacatttcgacgcatttttcgagcgctttgacttggtcattttcctgtgggaatttcccggtgccaacataatcccctcgcttctctgaataagtggccatttccatttgtggtccacttttaatgatcatttcgacgaatgttcgggctgcggtgtttgaagtgactgtgccggagcgaagcagaaaaacggccaaaagagcttgaagcggcgactgtacgatcatggcgcctgggccagactgtccaagaacagggtccaattcgcccaatttcagagtcgtgcagagttcgtgctcggcatctttttgactgcaaaccgaagtccaacaaatcccggcgtccgtttgcgtttgtcctgaaaaattcgcctttctttccctttttaccttcaatttcaggtttaggcaattaactctgagaatttttgcactacttttttcctttccatatttatccgcccccacacattctttagcaattgtccccaattgccaattttcggtcgcacgttttggcatattttcaaaattcagttgggccgaaatcatgaaaatcattgcatttagcacatttttatacgggttttttccccgtggtaatgttgcgatgtcggggactgcctttggcacttttatgagtctttccaaaggaacagtaatagggtcagcagctgttttatcaactgggactaattcggcggacgattcggagatttttgtaatggtgtaagggccaaaatgattccacaataattttttatgtcgtgaattgcgatgcattccgggaaaagccaccataactcgttccgaaatttcaaatttattggctttcacttgaggttttgcatcataccaatctttacttcttttccggtactcatccaaattttgtttggcctcattttgaatattaaggaggttttccaaaaacaattgaaaataattttcataatcaattgtgtataaggggttaaaattcatttcggtgatcttatccatcggaaattttcgctgatctgccaaacattaaaagaaatggtgaaaaacccgttgactcggatggcgttatattgtaaccaaaaactgaatataaaaatcgttcgtcccacgtccaattacttgctggaaacttttttaatatttaaatcaaaactccatttactctttcccccaaaccggttggcctgggggtcatacccagccggaaaaggccctctcaaacccaaaaatttggtttattcttttaaaaagggggtcataaattcctttcctttgtcggantnaatttttttcnntcnttccaaaaaataacaaaaatttttcnacaaatacttttnctacanaatctnctnatttattcnntattgnttcanccaccaagtacttntnaaatnatcnataataacacaannatatanctagtggaatgacgtgacttggcccannacgtccaaaa

SEQ ID NO: 25593 - DNA, 1115 bp, Heterodera glycines
ttgattttttttggacatttctttattaccaatgaaatgattgtctagagaatttagaaatacagtagttaaggtgtttccctccagcccgcttagaaaaaaaaaaattaaaaattactagggtaatacataagtagggttgcgattttaatgaagaaaactcgaaatagtttttcatgaaaataagcaaattttaaattttctcgcatgagagtcgatttcaagtacgcacttgccattcaagtacgaatccatgctatgcgctcaacattcaaatcaaaaacaagatttcgtgcatttgaacgtgcatcgatcggtgagaattacaaaattcggaaaaaaccctaccagcagagctcgtttttccacgatagcttttttctttggcatccaaatccaacaaatgctctattaaccttaccaaaatcgaaaggattatcaagcctggaaaaattttattaagaaaaaacttcaaaaatctcgacttttttaggttttaactaaattttttgctcaattgttttgaagaaaggagctcaaaaaacgcatttctgcattaaaaattttcgaatctgatgtcattatcgttcactagaaatagaaatcactattttggcattttgtcactatttcgaaattttttggaaaattccttaacaaaaatgcaataaaaacaaaaaaatacacccctaagaatcgacctaaaaattttacaaaaaataccagttagaattggaaaattttcataaaaatttttccccaaaatttttcttcttgacaaaatttttggtttaaaatttcaatatttgctaaaaaaattaagaaaggaatgtacctcatttgtaactgcaactagtgaataaagattttttttgcttaatttttggttgaaaattatgtcactattcatcactatgtattttggactttttgtcactattttggcatttttgctcactattttagttaactaattcgagatttttggtcactaaaagtcacagccctattcattacccacgcattacccacactatattttaccaaaatttgtttgactcttatttcttacagagggtaattcattttataactaagtgaatttgataaattta

SEQ ID NO: 25594 - DNA, 1184 bp, Heterodera glycines
  misc_feature (99)..(99): n is a, c, g, or t
atcagcccacaaaagaggtcactaaatttgtcttccaaatattattatcaccctctctcatagccaccgcggctcatcgttaagctttagcgtgcttcntaatttctctggagctgcgatcagcccacaaaagaggtcactaaatttgtattccaaatatcattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatatcattatcaccctctctcatagccaccgcggcacatcgttaagctttagcgtgcttcttaaattctctggagctgcgatcagcccacaaaagaggtcactaaatttgtattccaaatatcattatcaccctctctcatagccaccacggcacatcgttaagctttagcgtgcttcttaaattctctggagctgcgatcagcccgcaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatatcattatcaccctctctcatagccaccgcggctcatcgttaagctttagcgtgcttcttaaattctctggagctgcgatcagcccacaaaagaggtcactaaatttgtattccaaatatcattatcaccctctctcatagccaccgcggcacatcgttaagctttagcgtgcttcttaattctctggagctgcgatcag

SEQ ID NO: 25595 - DNA, 1336 bp, Heterodera glycines
  misc_feature (1193)..(1193): n is a, c, g, or t
  misc_feature (1232)..(1232): n is a, c, g, or t
  misc_feature (1250)..(1250): n is a, c, g, or t
  misc_feature (1261)..(1261): n is a, c, g, or t
  misc_feature (1279)..(1279): n is a, c, g, or t
attttatctttttgaaatagtctcgacaaaaattttcatgccttgagcataatcacatcaaaacttagaatttaccattatcgataatcatcaacataagaggaagcccaaattttaaccaacaaattaataaattactgatagagaggcgatatcagtcagcaggaagagttaattttaatgcccaatcactttgtcttctgagaaatctcccgagagtctcgactccatgtcacgtttggcatgggcacaaatacgcatttttggctgtgagtgctttgattgtgccgactctcattcattgttgtcacaagcagcagcagcaaaagcattgtcatgtgctcccattttagctttgcttttctgctgctgttagtccgccattgtccgcttccaactcgcctcgattagatctttttcccgttcaccgttcatctccggaacagagcaaatcccctcatttaatttaaccggtttcttttccctccgtccgtccgattcgggtggttgaggaaagggctgagaaagcgatccacgggggaggggagacaatgcttggagcaaacaaagcgctgggcgtgggtgggtggcagcatggggatgccatcctcgcccacctctctccttgctgccctcaccctcacgctttttatatgttcagcggccctgaaaacggcatgacaaattgatgccacctatcgctaccattttttgaataaaaatttaaattcgattttttgaatttaaaaattataaaaaaaattttttgtatgaaattgctttcattccttcccaaaaattattgtaaacaagttcatcttttttgcatttctctaaattaatttaactcttcattctgaatttggtgcctcgttttttgctttttctccctaaatgcaatcgttgtacaaaatccggctttttctttgcgcttttcccattgctttgatgacggccacctattgtcggtacacttaacagatgcgtaatgacaaaactgtcccaaaggtacttctttccctccccccccccaaattgggttcatctcatccaatcatttattcttccatcctccttctgtcacaatgttcatttgcattttcttccatcaacttcgaccatttttgtgcaagaaaatgcccattatccaattctcctccatttgaatccattccgccaccaccagcacttanaattgtgagtgattgagtgtattttttccaatggaattntcatttttaggaaatcantaaaaaattanacaaattgtcattagtangtcattagtatggaaaagaattatatggatataaaatcgcgaaatatgggctataaa

SEQ ID NO: 25596 - DNA, 802 bp, Heterodera glycines
tagtactatctcgtcgtttctctttttctttataatttctctcactctggcgtactatctcttcattttaattatgtaaaaaacaacatttacttctctttaagaaactttttttcccgtcaatagattttctttaaattttgcttatcgatagagaaaaaaattacgaacaaaatgtaaggggttttaagagcaaaaaaaagggttaactaaaaagttatggagtgattaaaatttttgcatttcctttcctctcgtgttggcgtactattttcacatctctaacacacaaaaaaaatcaaattcgtaaatgctaataattttggttataaggatacaaaatcactttgtacatttagaatcaatagagaaattaatagttttagcatttttggtgaaaacagcagtttaggacttgacttataacgtgataaaaatttgaaagtatcacaactttttttctgagatgtcaaattgcttagcattcgcttagaaaaagattctccttttcaaaaactttttttagataccaaatttgttcagtttagttgggaatgaagtgagttatggcagatcaaaataaaaaaatacaaaaaaggcatttttcagtgtaaattttgaaatagcgcgcaaattacgccaaatgcgctatttggcgttatgagcaattttgtctgacactggggcgtacccatagtgcagtcataaattcactctctgctgatctctctgccaatgctaaaacaattaacaattttccgatttattcatttttttttatttttgtttatttcttttattt

SEQ ID NO: 25597 - DNA, 914 bp, Heterodera glycines
cccagtccgcaatcccgcatttttttggaaaatgcgggatttgcgggattaatctcacgggattccgttccgcaaaaaaaaaaaatgagttcaatcccgcagcgggatccgcaaatttgattttttgtgcgagattttattgttttttttgaaaatttttctaagacagaatgccaaatatttttaaataaattaaataataaatttaattaaagttaactcatttttcatcgcaaatttcattcaaaatttgtgaaatttacccggcgacgcctatcggcaccgccggataggcttttacttaataatcctgtagaaattgagtcaaaaactgcgtcatttggtcaattttagacaaaatctgtaaacaaatcgcattaaatttcataaaatttctcgcagatgtcgataggcaccaggtatagcacggaaagacttccggtttccgacatttttggggtcggaattccgacttccgaaatttttgatgaaaagttggaaattttttaaattttttttttcaaaaaactagtaagttttctacatttctgttatttttaaaatttcccggcggcgcctatcggcaccgccggacctaaaaatccctatttttcttgcaaaatttgctcaaaaccgcaaaattttgtaattttttggacaaaatctgttaacaaaattttcccggcggcgcctatcggcaccgctgtaccctcctctaagttcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttacttggttaagaattaaaaaatttagc

SEQ ID NO: 25598 - DNA, 1712 bp, Heterodera glycines
  misc_feature (26)..(26): n is a, c, g, or t
ttaattttgtattttttattataaanatatttattttgtttaaagaattgttgatataaaaaaaaccttttttaggtaatacttatgggtgtccaaatgggatatattattaacctcacagagttagttacatttgtcgtcgtaggtctaaaaagtaaagcacatatgttaaaataattttttttttggataatttttttggaaataaaatatttagaaaaaaaaaattctgaaattcacctatcggaaccgccggactcttttctactaaaagtctttagaaaaacgcgccgcgaaaaaaatttaaaatttcaagaaaaatattaatattatacaaaaatattcatgataaaacagaaatataaaaaatataaacaaataaaatgattattatggaaattaataaatattttttcagagtgatctgatcaatttattgcaaatgacttttttgatcagtacacaaaactaagctaaaatgaatttttttagattttttaatgctcaactcgaaaggttacagtcttctaaaaagtgtctctattctaatggaacaccccaattttggaaaaaaattcgtaaaatttttttccgacatcctttcgtattcttattgttagaatcttaatattttcagaattgctatatacagttaaaatttcaaatcgatcggttcatgggaagtggtcaaactcccaaaaaatagggtgtctttattataatggaacacagtgtagttaaaaaaataaatccaaatttttagtcataaagtgtaatttgagtcgccatatgtcaaatcctcaaatgtcgtgtagcgaaaaaaggcatatgcctcaaaatactggctctactaataacataaactcattttaattaattggtccgttttattaataaattaaataatttttatttctataattcatagatattatttttttaaattgtttttttttatttgtaatataaagcaaattatctcaataatgaattattttctttatcgttgattgaaaaaaagaatgatattgattcgagaattaaaatttacttaaaaatgtatcctttttatgtgaactatgtgattatcgaaatgagaaaacataaaaagaacaaaatttgagattataaaataattataattattcggattcattttgatgaaaaaattttttccaattttacactcaaagggttttttggcggggattttgaaattatgatttttggtcgcttttaaatttggatgtgtacataatttttgaactttcctaggtttttcttcattgatgctttatctttggttaatttgttgttatttaggataatattagtgtgctctttcagaatatgctattggttttgctctatcttttcttattaaatagttgttggtagtggagttggatgataatttgattgaccaaccgttataaaatttgtcatatctcattgttaatttcttgttttttttttgccggacaaagcttaaaaaacatcatgtgaaaatctgtttagaaaatttaatctgaagcaattttaaacagaaatattggcatttatatttttgtccttttttcatttaaggcataatatctcgaaaactgaagtcctaccctatatttttaaatagctcattttgaagccgtttaatagctcatttttaagccgttttcgagctctatcgatctaaaaaatgtatatatattata

SEQ ID NO: 25599 - DNA, 1744 bp, Heterodera glycines
aaatttaggttaaaccctaaaaattacacagccctaggttatatagatttgaaaattaaaaaagaatgttattgtattaacatattaaaaacatcttgtttccaatggccatatcggaatataaattaagaataattaaaaaaatattaaatatttttttatttataaaaaagaataaaataatcaactttgtccaagtgtatttcaactaaataataagactctaatggaaagacagactcttggagactctggaacatcaacatatttgaattgaaaacatctcctgcatctttatttttaatttttgacatgacagtcaccctaaaatcttttttcatttttcaacaatcgaattccgtaatcgtgcagtagccgggttcttaaatatatagacccaaaaaatataatttaatgaacatagcaaactttgattaagtattctttccaaaattagtaaaaatgagtaaataatatgaaacgaggatgaagtcattactattataaatcttagttatatgttgaaataaataaatattaacgtaaaaaattacgataggtgcaaaaaagattgcgtccaaagctcgcaaaaacagaaacacataatcattttagcggtgtaatagctcactatgatttaaaatccggaatgagaaaacaccattttctctcatattatttatgtcttttttcagttccactggcctctgttgaatttaatttttcccggctctaaaatgcatataaaatttatttattttttatttaaaaatagaaaatttttatttttcgctttttaaaaaaatttaaatgcaaataattgcttaaatctttcgaagggactaatcccttttccttaaaattcacttatctttacacttaattgcttctcttttcatggtgccatagatcttacatacatacataacaatgcataaaccaattaacgaggtgctaattaagttgttcaaaacaattcaaaaaattagattgtaaacaacccaattaatgattgggctaattagtttaatgcagattagcaacctttaggctccccccattttatatgatatatttttctgtacatatgcacaaaaatggcaacatatttatatgtaatagtcccactgactacatacattatgtaaattatgcaacaattaattcacaaatccattttattagtcagccgattgttacgtaaatttacgtaaataatcccgaaagagtgcctttaattcctatcataaaaattatagcgatttttttgatttaaaaaatgacttataatgtaaattttcttttttgatctaatttttaatttttcaattaatgtaatttttaaataacaaaaattaaagtgtcattcaatgatgggtaattaatgaattactaattgggctaattaggagtgtgctctcttcgatgatcgatgacagttgccatttcttggcccgagtccaaaaacatatagtattcgacgagcttagaagaaggaatatttgattgatttgaggatgattgtttcccaataaaaaagcccaattaaaattagctaaatttattcatttgaaagcattgatctcttttggcgcattgatttttggaaaaaaagattaaaaaatatatataaattaaatctcctaaaatcataaaaaaacatttttcttatttttcaattcttttcgcgatatgactaatgtcccctataaaaatttaaattgcccgcttcaaataatttttt

SEQ ID NO: 25600 - DNA, 1011 bp, Heterodera glycines
aaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcac

SEQ ID NO: 25601 - DNA, 1846 bp, Heterodera glycines
cttcagttgcccgtcctttctcggagtgtgcaaccatttgaacaacacttggctagcagaagctacattcggctcatcatcagcaattccatgaagaaacagatattcgaaatagattgaaatcaattgatcaagatcggcgagaattgtaggcgaaattcgacggcacagagggtcaaaatgttcggcatcggtaaggctcagactacgaatgcttggtgcaaaaattggccaaatttcacgcgccaaaacatcccatttgggctgtttatcatcaatttttgtttccgacattggcatttccaaagtggcgcctttgctgtcccaaatttgtttgttggcacggagaaatgtgagcacagtgtggtcaatgtacctgaagaatatttgctcaacaaaaaagcatatttttatataattggaacgaaacaattaacaaaagcatttctgagagaaaaaagcacaacaaattgagatcgatcatttctcagatataattaattttcattgctttcatccgcttcttcttcttccgctggcagcgacaatggcctaaaattatttttattttttcaacaatcaaaaattgcttttgctgctcacccaatgcaactatttccaccccacacctcaaataggatattgttcaaattggcgcccgaattattgtcatgccgaagttcaaatctgatatagttcaaattggcacccgaattttcacggttttcccacttaactggcgccgtcgccgtctcctcaattgggcaccgttgcaacagccaattaaccaaattgtattctttgctctgtttcaatgtcagcttctcattggtccgttcattcaccaattcaaatgattcaattggcattggttccacaagaaaataaagttgaatattgtaactgacagaagtggtggcacggcgaaatgtctaaataaaaaattggaaaaaacaacaatttatagaaaatatggctagacacacctctttgaagttgttgacccattcgagattcagtggacccaacaaattattgcgatacaatcgcttcggttgcccattttttgtcggagtgtgaagccatttggccaaaacttggccagcatttccatttggcccatcatcagcaattccatcggggaatagagcaccagaatcaattgaatacaattgatcaagatcagtgagaagtgtcggtgaaatgcggcgacgcaatttgtccaaataatcgccatcgtgaaagccaaaatggcgaatgcttttcgcaaaaagtggccaaatttcgcgggtaaaaacatcccaaatgagcttgacgtcggtcatatataaaggcacaaacaattccaatttgatgccacttctgtcccaaatttgcttgttggaacgaagaaatgcgagcacagaatggtcaacgtaactgaaaaggggaaaaatgaagattggttttctgtataatttttgatttactaaatctgaaggtccttaaaacggattttgttgggcaacggatggtcgggaaatggaaatgccacgcatttgtcatcgatcagaacagacagtttcgcttttggtccttcgtcctttacaattttgattcttctccaaattgtcaattccgtttttccatcaaaatgtttgtccactaaaaagtcgaaacggtcggaaatcagtgccattttgagtccgagttggggacggtcaaaagatggcagaatgtccatccaaacgtcgccacaaatccaactgaaacaaggaaaaaaattgggtagacaaaaattttaatttttcacaaatttccttaccgtcgattcattttggtggctcgattaccacgcttatccctt

SEQ ID NO: 25602 - DNA, 1810 bp, Heterodera glycines
  misc_feature (30)..(31): n is a, c, g, or t
  misc_feature (33)..(33): n is a, c, g, or t
  misc_feature (43)..(43): n is a, c, g, or t
ttttatttttctttaaatatttatttaacnntntcagctcatnaattatgtaatgatttttatgtccgccatcatttatttaatgattttcttataaaataaatgtaccatccggtcggaaactagtcgtttttcaattcattagatacttttttttgtaaatatgctcagcagcatttttaattttttaacattcagtgatttgaaaatccatttgggtcacgttttaccattttctagattttattacatttaaattttttggattattcttcttttttttatatttacctcttttaccgatgaaaagaagtttttttcacatagataactgttttaaatgttttattttggcccttttttagattaaaatttatttttgtaacaattataatttcgtttaaatttcaagccttaagtgtaatgtttaaactatacgtaatatttgtttcttataaatttagtttatttaggtttatttctgaattactagtttaattttgataattataataaccaaattttttcaccaatcgataatcattttataatctgacaaaaaaaatattgaaatattcttttttggaaaaatcgacaatttgattctatgcaaataaatttctgttatcccgttaaattttttatgtattatttggttataataaaatcatagaaaatgtaataaattaataataaattttcaaaaaaaggtaattttttggacaaaatcagttaataaattgacaaaattttcaagaaaatttcccggcagcgcctttcggcaccggtggactgcctgttcctcaagagttttttaaaaaagcgcaccgtataaaacaacttaaaaagcatcgtaaaagcattaaatttatggattgatcccataaacaatttggaccataaagtattttgaagcccgttttaaaggcgaagggttattttttcatacatttttaaaataatttaaaaatataggactttttgttgtcagtttggcagcaaaccctggtcgaaaagcacaattcgttggaaacgcgtcaaaaagtttaggctgatattttaaaaggttgcgtcgaacctagcgcactaaaatcgatataatctctccaaagtttgcagggcttctccattgcagaggactaacttaccctgaaataatgccaacgcttgttgatgttaaaatttttcgaaattctgactttttcattaatcatttattatttcggaaaagtacttcataaatattttttacaacgcgctctgaaacgctccaaatgttaattaaacgacaaataaggctctctgatgctttcactatcgaaaagggagatgaataaaaaatctaaaaatttttaattggtttttaagtttgcgaaagattgtaggcttatatttttgagagtctcatcgaacctagcgcactaacaatcgatataatctctccaaagtttgcaggacttctccattgcaaaggactatgttaacctgaaaaaatgccatcgcttgtcgttatttacatgtttcgaaattctgcctcttccgttaattactaactatatggcgacattcattcatccatactctttacaacgtgctctgaaacgcaccaaatgttaattaaaagtagactaaggtctctgatgccttcctttcaaaaagggagatgaataaaaaatctaaaaatttttaattgctttttaaatatgcgaaaaattttaggcttaactttttttttataaactgatcagaagcgaaccagattttgcgagggcatcaaaaagacaaggaaaagcactgctatgatgctaac

SEQ ID NO: 25603 - DNA, 1904 bp, Heterodera glycines
  misc_feature (635)..(635): n is a, c, g, or t
  misc_feature (1895)..(1895): n is a, c, g, or t
agtcatagtgacttggggtcttttgcatattgtagagcattttgtgctctttcagatgcatataatgattttttccaggtaattttaataccattaattaaatattttaaactataaaatttaaaaaaaaccaaaaagtgaaaaaatcaatcaaataattgaattccatgaaatgtttattaagcacttgatcgagtgcacggaacatcagcaatagttcaataatttaattttaaaactaaaataagaaaataattccatagcccgccaaagtagtacaaacaaatcaaactaggttgctgccataaaataaaactaatattataaatgaagctgcattggtataaaaaaaaattaaaattaataaatataatgatattcattttaataaacaactcttaattatcgtaataccttaaaaactatggacaagtgacacaaccagccaaccagccgctcaagaaaaactaaaaaatcaaataattttatttaaataattttttctgcattttaacttcagttttattttttggtttcaatttatataaaaatttttaatatataattgttttataaataatctatttatatttaattacagatgttcagccaacatgaggaactgcatatatttntattaataaattatatataaaattgtttttatcttttggtaaaatgtgagcttatactttttttttattagagccttatataaaatttcaagctagtctccatttgtttgttcttagttctgcgtgtctctgacatggtttattaaaaaaatacaataattttgaattatttgtttttaatctttttgtctccttattgtgttttctgaaagaaaacccatgaaaaacgttttctatatttgttttcaatttcaatatttttatacatttccaaattatttttctcaaatttttttgattcttcaatgtaatatttttttattgttttatttaaagtttttaaataacaaagaaattttaattttgccatttttttatctctcgcacccgaccatatatctataaatttaatatattattttttaaaaatttatttatttgtaattacctatattgaattaaactattactccagtagtctagttgaacaaccattaattaatgcttagtagttttcttactaaaacataaatgactacttatacataatttggctttgcaagagaaatataaaaaagaagaatgaagcttttgaaaaaaaagaaattatgaactccaatgagtcgagcgagaattatacgattaaaaacaagaattatagcaaaaaataaatgttattaaaattttataagaaaaattaaaagttaaattctatggaaaaaattcaaagataaaattgttttagatataaaaaagaaaatcaatttattatataacttcgttgatagtaaattctagaaaaagcataaataaacaccaaattttaaaatcatgtattatgccttttacaacattttcaataagtaccatatgggaaagtcttatttaaattaaaattgcaccatattaataaattaatgcaaaataattaaataaatatctattatctatattctatgaaattaatgactctatcccggtaatgtacttctttggaggagttgcacccaagcatgtgaacaaaatttaattttcaaattctaaaagtaattattgaaaataaataaataaatgttccttaactcattaatcaccaaggaacaattgttgattttcgtttagtaaattactgcgtttttacgagtataattaaaagcaaaacaaagaatttgacattaatgactttttattgcaaaataaggtcattgtaagaaatgtaaattttggataaataatataaaaagaatttttttttgcaantataattat

SEQ ID NO: 25604 - DNA, 1778 bp, Heterodera glycines
aatttgacaattcataattctatttttcatctgattctctttattgttaatatcataaaaataaaggtcaagatcgattttcaaagttgcaagtactgttttactctaatttacaagcaaaatctaacaaatattatttcaaataactcttcttaattttttatagtttgatattttcgtcatcttcgtgttttgtctccgttcattttcttctattataaattgagagcgaaattatctttatatttctttattttttatccttaataagtgtgaatatgagttttcaattaatgctctttggaaggctcaattaagttgtgcaatcctatgatatctccatattttatcactttctctaattatacttgttccacaaaaattcccaattaatcactgattaatataagattctgtggcctaaattaatacatttttaaaattcgattataaagtacaattttactttgacgattatgcttttttcgattcaataaaccttacaatataagaaattaacaaaaatacacatccgaattattatgtttatattcttcttatttgggaaaagatcggagacgaaggggcaatagagagagaggcgtcttcgtaaggcaaaataattaaacaatttctaagattttttcaaattaaagattaatgttaaattttcgcccattccttttatttcgtgaatttatgaacaaaaattcataaaaaatttactagataaaattttggaaatctaaggttaaaaaatttcctcagagggtgccaaaaaccttcattttcattaaaaaaaatggatcaacatcgcaaaattagatcattttaacgaaaatttttaagaaatcacattaaaatatatgggaaaattttatgaactaagaataaagttgacttcataatctttcgtctccgaccccccccccccttaattatatttactcacaatggccaattgtgtctctaacattattgctttgattttaaacattaatttgtaattcgcctctatctgttatgttgctaaatatgtcgttagtgagtgtcaatataatggaaattaatgttttttgtaatgttcaatttgctactgttatgttcttcgtctttgaagactgtctgtgtttattctttagcagttattattgattaattaatgaacacttacattggcactgatatgggggaggacacatattaaagaaattgctaaaataccaagtaaccatggtgacgaattccaacaattttaagccaaaaattccaactgctacaacaacaacaatgcaattttgctacgacaaaacgaaacaaaaacaacagaaattgcgcttttgtattccagccgaactcattaatgagcttctcctttttatggagccactaaaatttttgggcgtaaagcgtttgttgagaataagcgcaattttttaccgtttaattgtctgcagaaaaaatattaaaaattggcgaaagccattctcaattattgtaagtgaaaatcgttatctttaacgtcgaaattatttcccttaaaagcaataagaaaaataaattttatattatataaaaacatgtggcattattattcagccaaattcagttttttgatttctttttattcactacgacttttaaatatttcagtgagaaaactcacttttttgtctttaagttggcttttttaatgctctttttagaaaatagtattttgttagaattaatttgatatagaatcgtgtggtaatattattcagcccccaatttgttta

SEQ ID NO: 25605 - DNA, 1627 bp, Heterodera glycines
aactacttcaactaatttcgaatccctgacccaaaatcgactaaaacagaagtcaaaaacaaatttgaaaaattgatttttgttcacttttggttcaaattcggatctggggttcggaattagtcgaaatggatctcattttacgtaatcagcgaacatgaaaacccctgaattctttttactctccctttgttcgtttgataaaaaaaaatgtccccccattgtatgcatcgcccccccctactttaaaaatgccaaatgttcttatctaagacaacatttttgaagatttttctctatcttttttaagtgttgcggcttttcggttctttaaggttaataaagctttcttagagctttcgaatggtaccaagtttattgaatttgatgacaacgaaaaacatgtcataacccaaaaaataagagctggttgaacaaagagccgaaaataaaatcaaaatgaaaaaacgaaagaattgtttgaggtgacaaataggtaaatcgattgcaacattttgtttatgtgttttttgattcgttaatattcattcaccaccggtcgaaagcagcaaaacaaaaaaaaagtggaaaggaaagctttcgtgtcgataaatttttcaaaaaacagcataaactgcgtgacatacacattgaattagtatggttaattcttcatttttattggcttatcaaatgcttccgtctaatcctgacgacaaaatagatgaggtcgacaagattctttcaaaacttgatgggtaaatacttcatttattcattttttgtgtttattagtattaaaatttgtttattaagaaaaattgaacgtaaaatggaccctttgatgtgtcgccataacccaagacagaaatgcacaaattgtctcccattggacgtaccttttctaattcagaaatgaatattaatttatttatattttaatcaaaagtccttttctctcattcatttttagccctacgatgaaaaatttctgcatgaaaaggacatcaaacatttgtcttttcatgctcatgtgcacaaattgaccgatttgcatggccgagggacgcgttcaaacaatgtgttggagaatgtgtgctgcaaactgcgcccgaactgcgcgggtggccatttgccatacccaaaaggcatttgcacgcgttgccgcccctcaacattgacactcaacagacaggtcatctccattttggccatttaagcgaggaatgagaaaattgggccattaatatcaaatgccaattccgacacaaaaaagaacgaattaatcaaattgtccaactaactggcatttttgcggtggcacagcaaactagggtaatagttaagatggttgcccctatttttgtcggaaattttcaaaatttaaaaagtcctttcaaaacaagtttttagaggttttcgaggtagttgatcacgattctggcatccatttcgcccaatttcgaatcccggacccgaattcgaacaaaaagtcgaaaattcaaattttcaagtttcgcatttttggtctaaatatgacttaacttttagaatgttttcatgtatttaaaccgatattgaaccaaaaatgcgaaatttgaattttcgactttttgttcgaattcgg

SEQ ID NO: 25606 - DNA, 1541 bp, Heterodera glycines
  misc_feature (49)..(49): n is a, c, g, or t
  misc_feature (120)..(120): n is a, c, g, or t
caatttaaattgtgctaaaagtatgtttaatagcttattagaaccgccnaaaaatttgaagtgtgccctttctccaaagcccaagacgctatcttttaccccaccattccgcgtagagcngacaactggcgcccaccttaaaaaatttgcgaaaattttcaaaaattttctgaagaaacttttttttacgcaaaaatttcaaaaaacgctttccaccaaatcgatgcagaatccttaaaaaattttgacgtatttttgaattggaccgatccgagccactttgaagagagttattaaaaaaactgactgaaaaccccgattttcctcttatatagagaattttcgttataaattgtttagtttttttcttcatatcgataaagtattctctaagtgttttctattagcctgcaaaattaaaaaaaattttgttaggtttcaaaaaagttatggccaaaaatgtttgaaaatccgatttattgggtacttttggtcataactttgctcaaacttcgccaaattttttgagatattaggtgagctaatagagaaattagggctatcgaataataccaagaatgtttaatttggttagctttgacaaaagttatcgggcagttttttgttggaaattttcatttgatggttctttatatagtgccctttttgatggtttctattagggttcagccccgaccccgagccccccgacccgacccgagacgttttttggacctattccccgacccgacccccgacatgtcgtcccccgaggtccccggcccccgactttttgccccccgaccccccgacacgaattcgggggattggggactccgagcgttgtaaaaatttaaaaagttaattcaacaacgaagaggggaaaggttgaaaaatttagaatttttttaataaaattgattaaaaattacgaaaaactttccggcggcgcctatcgacaccgcctgcccccaaaaacaccaagttttttcttaaaaattggctcgaaatcacaaaatttagacaatttttggacaatagtctcttaacaaattatactcattttcaaaaattttcccggcggcgcctatcggcaccgccttaccacttccccccaccccaagtttccaaaaaaagttttttgaaaatcgcgcagctaaaattgttcaaatttatgagattaaaatttttgtgcctcgaaattcgattttcagtttctgaaaatttttggagcctgtgatgccttgttataaaatgccaactcaatcgattgcctaatttgctggttgcccattgaaaacttcaaaagactcattttcatgtaaataaacattcgattattagagatcgggtttttagttgctaaaaatccaaaatagttactaaaatagttgctaaaaaagtgcaaaatagttgcaaaaaacccgaaaaaggccaaaagttgcgtaaatagttttttaaaattggaaaaaccaagtgtatttacgcaaaaaaatcccaaaagtaactcatttttgatcaatttcacttgcaaattgcaa

SEQ ID NO: 25607 - DNA, 967 bp, Heterodera glycines
tgcagtggaaataaatattaatggtcgaagtgtcaaccaattggtgggaaattgaagcgaaaagtggttattggccacgggaaacgccaaatgttggcttcgataatatgagaagagcaaatgttggccatttagtcacagaatttgccttaatttacgcgaagagcaaaagttgccatttgtccctcagggatatgagacgagcaaaatttggacatttggtcacagaaaaagcaaaagtttggcctcagggatatgagaagagaaatagttggccattttgtcacagaaaatgcaaaagtttgcctttgaggccgttagggcagaaatgagatgaagggccaggatgagggtagaaataaaatgcaaaatcatgcaaaaactcataaaaaagaccaaaattggctgcaaatttttttccttagtgtcctggcataatttttaattttgtccacttctgattacatttagaagaaagtaatggatgatactgatcaatattttacttttacccataattaaaataaatttcaaatttattactcccaaattcaaatgacaaatattagtagtaatttcatcacaatagtatctttttttgcatttcttataaattaggtcaatttattaaggtcaattggtatgaccgcttttctgagtcctttgtctgttccgggtccaaatggccaattagtacaattggcatttttggcgaatctaaaattaatcaatttccctgataaatcaattaattaataattttaaatttaccattttcaccagcagcatcttcctcagaaaatcagcttaagcaataatgaaaaatgccaaaaagtgaaaatattcactcggttttgaatcaaaacgcccttagacacgccatttaatttgccagccctacttcttcaaatgctagttggcagatcttgcaaattaaaaaaatacgagattttcttttttcttttca

SEQ ID NO: 25608 - DNA, 1137 bp, Heterodera glycines
  misc_feature (1126)..(1126): n is a, c, g, or t
gaaatttcccaaaaatggaaaaggccaaaggatagagacactaaattatggacagtcattggtaggaccgcccgctttttgaggacaatttggtcaactccttcgggaggccgtgcagcccggacaacgaacgccatctcgtcagcaccacgggtaacacggaatggcggagaagagcaagataaacaaaaaaaacgtatcaaaagatgggattgggtaaaattttggtggtattgtgccagaagtggaagtctctcgattgctctgggtgattgttttcgtcccctcaggcgccccatgccgaatttacaatgccatgccatgccgaacatttcgccacatttgccattcagaagaatgagttgaagccgcgggcaaacaatcggggctgaattgacaaaggtatgtaaggcttggcaaaatggaatcattttggcattgcaatttttatagcaaaatttgtggatgtgaagcaaaggtgtaacagaatggtctcaggaaatatgggaaaagcatttaagcccaagaagccccgcattggcggcatgtcgggatacgaagcccaaaactcgagaaatggacaaaatatggcaattataagcttttccaaagttcaaacccgaataaataggtatcattcgagatctcttaagagctgtgggccagaggagggcatatgtacatttaatgatattaaatgtaatttttggcaatttcgtcatgtttcaaaactgttaaaaaaccagtttaaaggacttgccatatgaatttttaagattttcctttcattttaagttgggttgggcccccgaaatgtcggggttttatgaaagccgtcaattgcacctgaaattagagatcggaccggtcggtttttttcggtatttttcggtttcggtttttaaccgaaaaaaaccgaccgagaaatttttgagtttttcggtttctgtttttttcggttttttaaccgaaaccgttcgaccgaaataattaaaaaaccgaaacaatcgccgacttttttgacaaatcagttggccattttttaacaaaattcattaaaaattcttaaaattttcctccggcggcgcctatcggcaccgccgaccccccaaaaagctatcttttntaaaaaattag

SEQ ID NO: 25609 - DNA, 979 bp, Heterodera glycines
ataagcagggattccttttttatgtaggaaaaatcgcgaaatatgtaaataaaatatgtataaaaaatgctaaaatatgtatgaaatatgtacaaaaactcccaaatatgtacgaaaatatgtaaataaaaatttttttaacggttactttttttggaaaaatttttcgtaaagggtgaaatatgcataaaatacaataaaaatgacccaaataggcctagaatcacattttagtactttaaaaattaattttggtatctgtttttgaaaaaaattgattttttagaggtatatttctcaaaaaaaaaatctaaatttcacaagaaatttctataaattctcaaaatatgaaaaaaaatgaaaatatgtacgaaaaattgctaaattttggattttttggggcatttaataaaaatttccttaaaaaatcctcaaaaattgaaaaatatgtacgaaaaaatggcgaaaagtccaaaatatgtataaaaatatgtaaataaaatatgtataaaaaatgctaaaatatgtaaaaatatgtaaataaaagtcccaacttttgttcgcaaacacaaaaaagaaagtgtttttccaactaattaggctatggagaatccaggaaaaaatatgtatttacataaaaaaggaagccctggtgataagtaattctaaatttcaaaaaatattcgaccatttagcccaaatgattaattgcttcaaataattgaagaaattttgatttgaaaattttctttaatttaatttagctttaacttttggattttattaaattaaaaaaaaaattacttttgtattatttttcttgaaataaattaaaatttgaattttttgattttttaaaatcttttttgaatttttaaaatttcccggttggtccctgttcccggtcccgaagaaaaatcgaggtcccggtcccggcttctcaggtccccaagtcccggtcccggttttgcccaaaatt

SEQ ID NO: 25610 - DNA, 1930 bp, Heterodera glycines
  misc_feature (21)..(21): n is a, c, g, or t
  misc_feature (1852)..(1852): n is a, c, g, or t
aattaactatccgttactttntgagttattataagttccttctttgcgctaaaattttccccgagggcgatatcgacattagtggtaattatcaaaaacacccattaaagctcataattgatcattaaattttggccttcggcgtgtggtaatcctaaattgattaaaatgccgactgatcaaatcccgttcaatcactttacatattccatgccatttgcgaaatgctttttttactgctaaccagagaaatcacccataaaccattccagccagcctaatggcagcccatcaccagcatccgcatgccgttggcgcaggtggcatttcggcagccggactgctccagcagcagttgcagcagcaacaactgcagcagcagcaacaacaacaacaacaacagcagcagctacaaaatgccacaaacgccgtcactgctgccacacagcagcatccgatggccgccgcatttgcagcgcaagcacaactcacagctgccgcggttgctgcagctgaagcttctcaacagcagcagcaacacaacgccagcaacaacaacagtggcaacgccaacaacattggatccggcgctatggcaactgtgcacacaacactgccaaccgcaacaattgctggaattccgtcagcgaacgcgttgcaacagcagcaacaacaacaccagcaacaagtcgcagctgcagccgctgcagctgcgcaacaccaacaacaacagcagcaacagttggttgtgtccagtcaccaacaacagcagcaacaacaaaacaacgctgttgcaacacagcaacaacctccagtccaagctgtacaaccacttcagcagcagcagaccgcaatcccatcgttggcgtggccaattttttatgtgagagaaaattaaagttttcattgaccgttcatcagtactttttgaaaattatggtccttttcagtttgttttatgggtagggtgaggatttttagtgacggaaagtgttttaagaataagaaagcctttcagttaaaatctttgaaatttgggattttttaaagttatttcacaatcctattaaaatttaaacccttttagaatgaaggtggtcttattttaaggtttttttgtgtgaaattccaaagcttctgtgaggctttcaaattgcctctttgttagtctgatcacattcgaaagataggagtcgaatatttattaagctgatcttgagtcccactctcgactcgagaaaagccgaatttgtgggtatagccagcatatcgggtctcggctttttagtctcggtctagagtagcactaaccatcaattatatatttccgagagcaatgcaaataaatccccattaatgtttagccgatcgtgaatatcccctacttcgacatccccacttatcaacgcgtcaatttggacgcgttgccgagcgcaatgccaaacggaatggatttgccgttgcgcgacatcaacacgctgcggtttttcttcaattttggcgtccaacatgcacgtgccatcctcctcaaacagcacatcaggtggattctgaagaatttcggcattttgaacgagatttcaattatgttttactatttattatcatcgcaaatattaaaatatttgctttttaaattaaaaatatttacagttcacaaaatcagccaacacagcaacagcagcaacagttggcacttcttcagcagcaacaaaatgccacaggcattgggcaacaaacgggcggtggccaagagtatgttttggcactttctgaaaaaaaaacataaaatttaaatataaccaaataaaaataataatatttggcatacaatttccatgctgcccatctntgaaatagtattgtttttcctttttggaggctcaccaatgaacagcttcaatgcaacagaaactgttgactgctcaca

SEQ ID NO: 25611 - DNA, 1466 bp, Heterodera glycines
gccctccgatcgggcgcttcctttgaatacttacccgaattccctgaccgaggacagcgaaaatgagtcggatggtcaagcggaggacaaatggctgctttctccgtctctgtcaccgcgcggtgacggtttgcctgctaagattctcagatgaacattccccccatttgaatctgaatggtatcctcaaatcgagggacttaaaacggagcaacaattacaacaaatcaatgcccacttgctggagagatgggctacgctgagattaccgtgctgttcctgggatcaattaccgtatcccggtccagggatcaattacccttccgggatcaattaccatcctggtcccgggataaattacagtcctgatccccaggatgatttaccgtcccgatcccgggatcaattaccgtatcccagtccagggatcaaacaccgtcccgggtttaatttccgcacgatcccgtgatcaattgccgtcctgatctcgggaggcatcgtctcggtgccagaattctggttttattcaccttttttggcaccggtaattaggagaccggaagcccgtatttagactattttttttataaatttcagacgaaaccatttaggcattttcgaccgcctcatctcccgtcaatttcatcatggccttttccttccccttgtgggccaataatatcacattgggcccattcgtttgaccaatctttggaccggcgaacggttggcactgaaacagctcgaccaatggcgctttttgatgatccgttgtccaattgtgcgcgatgagcaaaagtgggccaaatgggagaaggaggcgacggagtggcgctttgtacgccaatggaaccgaattgacattgccgtccacccggacgagttgccagacaaatacgcgtaagtaaattatattttttagttcggccggacaaattcccgatttccccaggattttggcttttttgaaaaatgaagggatcatcggatctctgctaaattccatatccgggccttgaattttaaacactatcctttttatatgattttttgagtttaggttagcaaattcccttcataaaacactcatttaaaaaattttgaattgaaaatttaagcggcatcttttgaattaatacgcaaagtttactttattatttttgacaaagttctcaaaatatttttaatattttttagagtaaaactaacggattggtagtgatcatactactcggatgatgacagatgatcatcatcaaatgaagcatatattatgtaaagcgatccaaaatgtttaatttgttgattattcacaataataataatgcatttgttagttccattgaaaatatattgaaaaagcccataaaaacaaaaatactcaaaaaatgtggcgagttattattgaaatgcttctgagcgtcgaatctcggaaatgttagcccttgaaaagtcataatagttaa

SEQ ID NO: 25612 - DNA, 1515 bp, Heterodera glycines
  misc_feature (1403)..(1403): n is a, c, g, or t
  misc_feature (1411)..(1411): n is a, c, g, or t
  misc_feature (1501)..(1501): n is a, c, g, or t
tgaggagggcgggcaggggacgaatccaagacattccttcttggattgttacccaagccttacaaatagacacaaaaactagatcgggtaaattaccgttttatttggaaaatatttttaaaaaatggacagttttctggcattgtgagttcatggactatccccatggctacactttgaagaattttatgtttgaaaatttaagaaaaagtcagggagtgcacccccgtcaaaatttctattttgaaaactttaaaaaatccccagcgaggcacgacttactccccttttgaaacatgctgctgaccttgacaaaaaaatattcccttttcagtgaaaatttgcatgatttggcgccggagccccacacaaaggcaattcgcagtttccatctgttcggtgtgcgcctcttcgagtgcaaaggcggcctcgagcaccgcgtggtggaggagtaccgggacgcatcggagcaattcccaagcggcaacgacgcgagaagacgcgcgtttttggcccttttacgacgcgaaccattctacgggtgaccaataaaaatggttaatcacatggtgatcggtcggtttgaccaatgatcatgtgatcaaaaatgggtgcacttcattcccccccccccgcatcgtttcctccccgagaaattttatttttaaaaattgctaacttagaaatttttcaagaaaaaaaatcttagaaagttttttcataagaaaattctaagaaaaaaatgttttgagaaattttcagcgattttttggaaatttttttgaaaaatcttagtaattcaccataaaaatttctcaaaaaatttttttccttagaattttcttgtaaaaaaactttctaagatttttttatcgaaaaatttctaagttagcaaattttaaaaaaaaaatttctcggggggaaccgaactgggggggggggggggggacgagctgctcccatcggatggagccaaatttccccaacataataatacttttgagcgtcgtgcccaagtgcgtgttgcattttgtacaggaaacaattcgaaagggcagaccctccgtcgccacttcggtcacttcctttgccaatttatcagtgttttggaagagaatgaacgaattgctgaacacaattttccgctcgcccggcagccaatggcgcgaagaatcggccgacaaaacgggcgaaaagcccaaaataccctcgccagaattccgaggctgcaccgacgacatttccaaatgagcaccgcaacaatcggaagaaagggcacagaaataatccatttggggtgccgtctccagccaatcgtcgttgggaaacacaccaaacacaaagtcactgaaaatgggcacaaaaagtagggtgaacgagtaatttagggagcagaaacatgncaatggtntaatgaagtgccgtaaataaatataatgccatcaaaaatctcaaaatccaacagaccctttgctgtgcgagtgaaatcaatgaccgcatncgcgacagttcacg

SEQ ID NO: 25613 - DNA, 1522 bp, Heterodera glycines
cttaatgatttgacaaatatttttgcttttcttcctaagttttcgattttacacccctaaattcggaactttcttgcaactatttacccatttttagcaactattttggaggtttttagaaactaaaaactaattattttggcagtttttagcaactataaatccgagccctagtcatgaagaaacaaaaatagagaattcgtatttaaattggcaaaatttttcatgaattttcctttttgccggcgacccgccgctctttccatctttaattgcaacattaaaaatttacatgtttactttttgggagttgggtaaacaaaaatttgaaattttagagtctattttaattcctcaaaactttttcaggattttgcctgccaatgtttgcgttacatttgtcaaaatgcggacgaattattcgaatctgatgaattcttgcaaattgaccagaaattgttgtgtgaactatttgactgtgatcagatggtgaccagcagtgaatttgaaatttggaaagctgtaaaacaaatatttaaaatttaattatatttgtttattttccaaggcacttaattgggccgatgaaaagtgccgtcaaaatgccatcgaatgttccgctgagaatcgtcgatcagcgcttggcccggcactgttcaaaattcgctttcctcacatttcaatggaggattttaccgaaagcatcggtagcaatttttaaaataaaacaaattctttatgtatttttgcagttccttctggcgttttgacaaacgatgaatttgtctccatttatcagttccattgtcaccccaatctccgtggtgtgcccgagctttacccattaaaattccgatggcatggacgaatttctgattggaacatagccaaaggcaacagagggaccctggcgatggaaattgagaaattttctgaatttgcgcgagaggaagtggggagcaggcgaaacagtgaaatcgaagtgtcaataaaaggactttcttggaaaatatcggcagaaataaagacgaaggaaaaaagcactgatgagaaatgcctgggatttttcctttcgtgcaccgcttcgggaaaaggtgaactcaaaattaagattttttgattacattacctaattttgattgccaaagatggaaattggagttgcaaatgttcggcaacccttcgaattgtttcacaaaagaacggaacggaggatttaacgaaaaaaattgaccatgtttttaacaaggaatgggccggctggggattcccaaattttattacttttgcggtgagtggcaggcaaaacaacatttattggcttaataaatagtaaaaattaaggaattaatggacccgagcaaaggattttacgacaaaaataaggacaaagtgacgctggccattgattttacggtgggagaagaaaaagggacaacaaagaggaaattggccggtggataagcacatattccaatcactcattttctgttgatttgacaattagcaaattttattcaat

SEQ ID NO: 25614 - DNA, 913 bp, Heterodera glycines
caggaaggaaagggggggggagggaatgccttcgcccccccccattcattggcattttctgtgctttcatttcgccccttttcttacaaaagcgtaaaacaaaaaaagggagtgggcggtgaagaacaaacaaagattcatttatattttttggatgttttaatcagccaatgaaatgatttgcttatgatggaaattctttcttccttttttttgtgctaatttcccaatttccgtcgcttccttttgattgcttttccatatatttttatttccaatttttaatttagattttctgcctcccctcccatccgtcgcccttttcccatttttcgtccgccaattcgtcgtccttttccttccagtgcaacccccccccccttttttttgctgcatttggccaatgtttcccccttcgccgtccatcgccgaatgccctcccccgtccacttcctttgccaaaatgccgtcgtcgtccgctctgacagccgcgcccaatcagtcgctgctcagcagccaaatggtcgaaattcgctgcttttgccacttcgatttgcttggtgctcaattctccataactcacgacgaccaaacgaagtgcgatgagtaattaattaatcattgtgactaattgcccaattagctcatgttatcggaatgagcacagcagaatttggtctttgcgcttcgttttgtttggcattttgccacacattcttagcttaagctggaaaagctttttctgctttcaatttgttttctcttgccatttagcatttttgtaattcaattttttgtgtttcgtttttctcccatggcatttaaaccctccggcgtttttacttcccccccccccctcttttttccctcactctttcccctttcgcaaccttcgcttcttattgccccatca

SEQ ID NO: 25615 - DNA, 1648 bp, Heterodera glycines
  misc_feature (27)..(27): n is a, c, g, or t
  misc_feature (63)..(63): n is a, c, g, or t
attggcatatttaggcgctgagtttgnccttagtcccctctgttgtgacctccgcggttgcgncctgtgtgggttcattcgctgctgaacctcctcaatcgttgaggacatgtgaatttgcttccggaaacgtgctgtcagctgcatgctcgagtgcttttgcttgaattggtgacgtagtttaacgtccttatggaccaattgtcgttgcttttttgacgtcatttcggaccctgaccgtcggatggattgctagtttagcgtcttttcggacaatggttgtttggtggccggtgcttagctagtttaacgtcattgcggacaattgatgctttgctagtttaacgtcattgcggacttgtgttgtttgctattctagtttaatgtctttgcggacatttgttgttaggttggttctttagtttaatgtcattgcggacgattgttgtgtgggttggccgatgctttgctagtttaacgtcattccggactcgtggcagccgggtgattagcgtttcggacagttgttgatggcttaggctagtttaacgtcattgcggacgattgttggtgattagcttagtttaacgtcttctcggacgagtgctgttggcatggtgtcttactgattgttgccgagctcatgtttgggcaattctgttgactgcccttatcaattactgttgttgagtccgagcttctggccaatgtagcgacgcaatgatggttggcgcctgatccacttgcggttggcgacacggctttcatttttctgttgagttcatttgtttggcttgtttttgtgggattcgctgcttttccttttggttgtttgctggaagaaaatgctggtcgcttggcaactgatgaactcttccttgttggtgttagccgttgcactgccataggaattggtgccgttgaatgctcatttggtgatttggcttgtctatccctgactggattttgtatgatctcaatgccggatgcgtcgctgtctgatgaaagatcaatcacgattgattttgagctgatgggagccgattctctcttccgtcttgatcgcaatgttgcaatgctggacaagagtttgtcgcgttgatgccgtctcactttgtctttctctctctgttgaatgttctctctctctgagatctgttactctcttccgcctctctctctcctccccactctcctctttcttttctccttttttttctctctctctctctttctcccactctcctacccactctcttccctctattttctcctttttctccctctctctctcccacctctctctctcctcccactctctctttctctctttctctctctctcttttcttctctttatttctctctctcccccactctctcttcttttctctctctttctctattctatctctctctcttttcctctctcccacctctctctcatttttttatttatccctccctcataaagacaatcgcgtcagatcaaggggttttgatgtatttgggcctgcgatgtcgctattaaaaatttaacctaattttatgaattttttttttaattttgccgaatagagaaaatttaggtcccgcaaaataaaaaaaaaattaagtatagaaaatttttgaaaaaattttcaaattta

SEQ ID NO: 25616 - DNA, 1935 bp, Heterodera glycines
  misc_feature (1046)..(1046): n is a, c, g, or t
tcccttgaattttcttaataaaaattttttcgagttttttctcgaaccagttaggtaagtaaaagtttttgattatttttttttctaaaataactaaaaaaatgtgcgcgacgttatgtcccagcgacgtttcggctgtcgacgttttgtccggcgacgtttctgcggcgacgttttgtccggcgacgtttcggcggcgacgttttgtcctgctcccaaaaaaagttgcgaaaaattaaggaatattttcctaaaactttcattttcccccaaaaattgcaagaaatcgtttaatgattttattcaacaaaataataatgaaaaatacacaaattcattaaaattctcataaatttttgcactgtctctgcttggcctgttcaaggccaacctctgctgcaattttcacaaattccttcattttttcaaaaaagtcgtgcacaaaactgcgaaggatggcccatttgatttctaccatagtgtttccaatctcttctaccgtatcctcaatttttcgtgacgaaatttgccgctcaatggcgccaaacaaacggtaataaacgtgtaaattcaacaaaattttattctcattttcataccattgttttcgtgatgaaatgaatgatctcgagatgacattttgcaattttaaaatttaatttattatatatgttatattatttataaatatatttttattatgaaacttataaaaagacattttaaaatcattaatttggttttggacgattttatgtgtcccatgacatattatgtgtcccatgaatgaccatcctcagtttcttaggccataactttttacttatttggtaaatacctctattcttggtatcaaacgaaagcttaatgtatatagaagcttttataaactttatttttttagctaaatgcaatagacaaaaaattattctcgaaaagttgagtttcgtgttttctcattgtaatttcttttttaatgccagtatttgctcttttcttgcattaataaaatcccgatcatgggacgcataaaaccgaccagaatntaacattttattctttgaataaaatagataccatttaaaattgacattttactaaggaaattttcgaggaaatgtcaaaaattcactaaaatttggccctgtgtgggcaaatttcaagaaaaagatcaaacagattaatttcttcaaaaattagtttttaagaattaattataattttcaattagatttacagccaaaaccctcgggtttcagcttaaaatttttgaattttgttggttttattcaataatatagaataaatatttaattttagtcccaagtgtccctctattagcctgaaaaatttaatgaatttcgttttaactttcaaaaaatatcaccaaaaaatgcttgaagaagtaagtttttttttgagttttctggccgtcttttacgggttttcccaaaattcaaaaaatttttataggttttcaaaatgaaatttaactaaatattttgaaaacccaaaaaacattttaggttttgtgtctatcttctacgaatttatttttcattttggttgtttttgagtccgggctcattgtcagccccggatgacattccgaggccccaaaaattacacggaaacacgaattccgagccccaacattttttgtaagtctgaaatcggaattccgcccccaaaaatgacggaaatcggaagtctgaattccttgccatccctggtcagcaccattacccaccctcatgcttctcatcaagccggatgaggtctcatcgtcaaacattttgtcctgcagcaactctctttgggtccaaatgatgtactccttcaaattgtagataatccgatcagaactgatcagtgcgcacaacgctttgtccatgtcgaccaactcgaacatgtgccgatacaaaatgtcatcat

SEQ ID NO: 25617 - DNA, 1248 bp, Heterodera glycines
ccatgccagtctgtatattgttaatttaaaacttcaagtccaaaaactaacccataattgtttcacgtttccttttaaatttttaaaggaagatttcctgaggcaagtgttctgttcaaaaaatatttatcataaaattataacaaaaaatatggaaaatccacaaaagaataacaggattttcatatccattctatcaaaaaaaaaggatcatatagttagttatgcaatggtttttcagaacagaaaatccacctggcatttggataaaatcaaagaatcaaaatttttttctgtcgacggattccacacatattagccgttataaatttgaaacaatttattggctatatgttttctgcctgacaaagccctactctggagactgttgggactcggggacacccaaaatggggaccctcgtcgcagctccgggcgggccaaaatggccctaaacaccaagcccccaaatccgcttttcgctgtcctctttatttgctgagtggaaacccaagccaagcgaaacaaagttgaacaattaaccgaaagaatgaacgaacgggccaggggaattgagggtggaagaaaggggaggggcagttggtcaattgaggggacaaaaagtgatgagaggggctgacacaaaggaagggggaggaactccaagccaaaggggaaccccggccaatgaccatcttttcatcacattccccaccgacgacattgccgcgccctcgcggcaaaaataacaaagcgatgtggaaaagggaaaaagcagagaggaaaaagaaagaaaaataacgttaaagagagagagaaaatggaggaaaaaaaatgaaatgattttgagacaaagagatgcagccccctgccccaaccgacgaccgatcgctccagcgttgttgtggtcggatagcagaaaaagttagatgtgaaaagatgataattcgacatccaaaagtggtcatttgcaaaaatatcttctggtggtattcatttcaaacccctcttctcttttcattttcctctcagttttgtagctattccattttttagtgaattatttcggcgtaaaaattacaaatgcgtctggcattgtccgtcattgtttcgactcttcttctggtggctctgaattggccctctgctttggcttccgcagaaattggtcagcgaatgaattgcgatcggtggggcggggagagaaagagagagagagaaagagatgaaagagagtgagggcgagag

SEQ ID NO: 25618 - DNA, 1537 bp, Heterodera glycines
  misc_feature (1266)..(1266): n is a, c, g, or t
gacggaaaatggacatcgagttttaaaattaatatgaaggaaattatacacggtattctgataaacttactttaacaccagctaatctctgctccattcctttaatcattcaaacttctttaattcgttaaaaatcaagttatttccaaaactttttgaacaccgactcactagaatttttttccttaattattagtgttcaatttttatttgttggccaaaaaatgatatttgctaaaaatgattattttctcattaaagccgtccgcaaacgtcggtgcgcaaccggtgcgtaaatcggctggcagcccgcccatttgtccctctccgatgccaattatcttccccccaattggtcaatgcctcatttcacaattggacaaatcctatttcccaattggacaaatcctcatttcccaattggacaaatcctcattttccacttgccccaccgtcatcgccgtttcgtccatgcgtatccattccttatgcgtagcccacactttgatatgatagcggtcgcacttttgtcttagctcgctgttgaacacaactttggtcgacgtcctccccttggtgaacgacttgaatttgtagtcatcgtactcttcagaaactgtccatttctccacttttttgtcctcctcgtcaattttctgcatcctacttttcagcttatcatcatcacaaaacacgcgaaagtggtaaaaaaggtcaggcgtctccaacgcgggcccaatggtcagattgaaaaagttgccaaacataatccacttgttcagcccatcgtttgggatcgcatcttgcagataaggaacgggcttaacaaaaacccaaaaaataataattaattatgaaaattaatcttacaaatattccccggattttgaaaaacttgtgaatctttaaagaaaaattttatttctgcttaacaaatttcctaaagggttagacattgaaacattttttacccaagtgctcctgccattccgtgtcaatggattcatttcgattggcatttccgcattcattgcattttcgttgattggcatttccgtccagagcatataaatgcacacgtgaaaataagggcacactcttccagaacggaagttcagtgtgacaatggcttctccattcgcttgttcctctgcaaatgccatctcatgcccccccaccaaaaccccttcactgcgcattcgctgggccaggaattgatgtaaaaagcgattttgaccctcacaatgtccaaccacataatacacngtggtgggtgtcgggcacggccaagccggggatcagcttcagatgcagcgaattgttattgttgtgcggctgttgcgcattttggcccatccaatgggaggacagcaaaaggccaataattggcattagcatagcaaagtttgccaaaagaaccattgccttggtggtactgcagttttgaatgcgagggattttatttgagagtttaaatcagggcttcgatctcaaaattttgaaaatcctcattttagccataaaaaatcctcatttg

SEQ ID NO: 25619 - DNA, 1278 bp, Heterodera glycines
cccaacgacctgggaaatcgtcgactctgatctcgactacgacgattgcctctccggtcccgcgcgtctcgcagcactttggaaagctacccgggaggccgccgaccatttctggctcaaatggagtcatgagtacctcctcgccatcagagagcgcgccggatggactcataaaggtcgccggcttcgaactcccaccgccccccacatcggccaagtggtcatcgtcgaagaggacctccgcccccggaatttatggccaatgggcatcgtcgttgccctaaatggctcactccctaacgtgagaagcgtccagttgcgaatgccaaatggtcaaaccgtcacgcgaccaatcagccgtctttgccccttggagaccgaaaaccagaccccggaacccgccccggacgccaccgtatctaccccgactgatcaaagccccagagacgccaaaaacaccgaaatgtctgtaaacgaaatgccgccgatcccttcactttccggagaaccgacgatcagtaagcacaacggcatgcttacgcgacgaaaatcacggcttttcgcgatccctcccaccacgacaatgatcattgccattttcgtcactcacctgtgggcccaagcctccccggcacaaggaatttggccattcgacccggaccatcccgggccacccccaacatctaattgtgtcggaaatcacgtcaattgcacccgaaaaggcgtcaaaatctcgtcaaattctgcggtacaaaaggtgacgatttgttgttcgaacgcctgctttgatcgtctcgccgcctctgagatcagctacgagttgtcctccgacctcctcgtcaacgagtatgtctgctccgcgacattcggtctctcttcgacccgcagctgtaccgccgaaattgcctgtccggcagtcgacgaatgtgaattgatcgattgttctatctgcatcgaccgacccgccaattggcggtgtaatccccggctctcccttgtcctacttctggtcattgggtcactgatcagttgtctgaccggatggattgtctgtttttgctcctccgcccgcgtcgtgctcaatcgcggctaccaaatcgccgcattcctcctctcctggcccattcgactagccttcttcatcgccggccgtccctggacacgagaagaccgggaacgggttgcagaacgcctcgaacttggtgtccaaagggtccgacgacagacacggaaccacggacggcgagcccaaagggcggccacccgactcattggcat

SEQ ID NO: 25620 - DNA, 931 bp, Heterodera glycines
  misc_feature (915)..(915): n is a, c, g, or t
tggtatcaatgaaagcttaaggtttttagaaacttcttgtataattttatttttgcaaatgcaataattctcgaaaaagttgaatttttgagttttcttattgtaattttttttaatatcaatatttgctcttttcttgcatttactttcattggataccaagaatattggtattggccaagtatgaaaaaaagttatggccaaagaaactgcgaattgtcattcatgggcgcataaaaccgaccggcggaaccccaaattccctacccatttcgttgtcggccttctccgcttcgtcctgctgctctccgtctctctcttccgcacattcgtccgtccctttctcgcctcccttttcttccgtcttctccttttgctcctccgtcttctgctggtcttccaccacttctttttcagtcccatttttgcttttcaattcctcgccctgttcttcttctccttcgtcctcctcatcgctctcgtcaatgtcatccatcggtggtttaataggtagcgattcgagacgcgcaaccttcaagtcgggaaggggggttgtcattaatttcgaatttcgtgtcagttttcctccattcggcttgggggggggtacccttcacctctggcgacaacctttgtttcacaccatttttttgcgaaaaaaaatttggcgaccagagggcggccccggcggtgccgataggctccgccgggaattttttttatttttaatgagatttgttaaaaaattttgtccaaaaagtgacaaattttgcgattttgagtcgtttttagcagattttcttcaaaaatagtggtttttttgaaaaattaaaatttaggtgaggctggttctaaggggagagaggtaccagcaaggaaaatttaagattttagcaaaaatactatttttccctntaaaaaatttcgggtg

SEQ ID NO: 25621 - DNA, 1275 bp, Heterodera glycines
atataacttattgaatacataataaagtttgcttttaatgtattattattaaacgaaaaaattctggcggcgagattgccaaaaaacaaggcgcggcgagttggccgcggcgagttggccccgcggcgagaaagcgcgcggcgagttggccccgcggcgagatggccgcggcgagttggccccgcggcgagaaagcgcgcggcgagttggccccgcggcgagatggccgcggcgagttgggcggttcccaaaaagttgaaatggtgttttccccaaaatttgcatttatgcaacaaaaccaatacaaatgcacaacttccctgaatttgttttgcgccaacgttttggtaactgcgaaaatgttataattttttggtggcatgtctctgaacaaaaaaatgaattttaaaaaattggggattttcgagtcggtgttcggaatcatcggatgtcagatttgtgtgggaaaacacctaaattgttttatacttttcaattctacaaaaaaaaaaactcagaaaagtacggtatcattttgatggacagcgatcggcagcaatattttaggccccattttttccatcaaaaattcatataaaagacagagaaaaatggcaatgacggtcattttttgtacaaatattttggccagcaattcatactgcggtggccatgcaataaaatggttttttgtttcacacacaaaaaatgaaaatgaccaactaaatatgtaatttgttcttctttatataaaaattcgttaaaaatgattttacgggaacaggcaaataaagaaattgggaattttttcttcaaaaattcatataaaagacggagaaaaatggcattgactgtcactttttttttgtacaaatgttggttaatcagcaggcggcggcgccgtgcaaatgtttattttctttgcttttttagctcctccattttgtttctaaattatccaatcacttttttgtttaatttaaatagactaaaattagtttttttggttcacacaaaaagacgaaattgaccaactgaataattgtgtccgttttaaataaaagtccggtaaaaaaagattttacgggaacagtaaaatgaagaaattgggactttgctccctgaactctgtgttggaaaccatggtttacaaaaggaatctcctgatttcacataatttgtcttttttagtttccctaagctaatttaaatccgtcaaaaactgtcttgtaatttgcgccaacaaaatgtcagaccgcagaaaagaagcggagg

SEQ ID NO: 25622 - DNA, 1082 bp, Heterodera glycines
tagtggtgatgtgctcattaaagaatgagaaaacttaaaatactaaaaaccattcggcgctaattaattaccattttttctgaaaatcaacaaaattaggattttttagtaaaaatctcctaaaaatatggtcaaaattctcaatttttcccccggcgtcgcctatcgacccgccggaccccttgttccacaaaagttttttggaaaaggccggaaaaatgggttgaaaagcaaaaaaaaaaggtcgtcgcgcccgaggcggaggtacccccaccccccgccaagcctaaatcctgggaacatcactgatggccaatcaaaaatataacatttgaacattttaggagtgttttgaataaattttgtaaaaatggggctttttaatccaaaatgaggcttttgaaaattttcatttgcgagccccgatcatttttaattggatggatggtgagggtatttggttcttgtgaatttgaaaatttttgaatacggtttttttatttatttattttaaatagggttcgagccccgtgggcgggggtggcttttcgcgggggcgggggttggcgggggtcagagttgcgggggcggtggcgggggcacgataattccgcccccgcgggggcgggggcgggggtttgctttgaattagctccaaaaatctcacaaaaaaaatattttttatgaataatttctttggctccacattcttttattcgttgatcgccttgataatatttattttgacataaattgcacagattttgactaaaaataatcaaatttagcgatttttgggtaattttttaagaaaaaaaggtttttttttgggggggggggggccggtgccaataggagagaattttaaatttatttctaacagatattcaaatttgcaaaatatctactaaaatatgtaaataaaagtccaaacttttgtttgcagacacaaaaaagaaagtgtttttcctactgattaggctagggaaaagccagggaaaaaatatatatttacataaaattagcagccctaatcatgatttaactcagggaaattgaaaactcagatttttttaattttt

SEQ ID NO: 25623 - DNA, 1043 bp, Heterodera glycines
caataaaccatcttttcattatccattttctattaagatcacatgaacttcactatttccttaattttattttccaagatatgaacttatcgcgtaaatcttataaaagatttaaataatattaatttttaaagattctacaccgcgtttgaaaccttcaaatctgtaagtaaaatattttccacaaagtgctaatttttccgtttctgttgaatccattatcaaatgatttttttatcagagcattaataaatttcgatttatcatttatataactaaaatatttttaatgattaaaataatattaatttatttatagatcttgcactcgaattaacaccatttttttcaataaaccaccttttcattatccattttctactaagatcacatgaacttcactatttccttaatttttatcgcgtaaatcttataaaagatttaaataatattaattttttaagattctacaccgcgtctgaaaccttcaaatctgtaagtaaaatattttccacaaaatgctaatttttccgtttctgttgaatccattatcaaatgctttttttatcagagcattaatacatttcgatttatcatttatataactaaaatattttaaatgattaaaataatattaatttatttatagattctgcacgcgaattaacaccattttttcaataaaccaccttttcattatccattttctatcaagatcacatgaacttcactatttccttaatttgtatcgcgtaaatcttataaaagatttaaataatattaattttttaagattctacaccgcgtctgaaaccttcaaatctgtaagtaaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccacatttttctttatcatttttctatc

SEQ ID NO: 25624 - DNA, 1937 bp, Heterodera glycines
  misc_feature (1910)..(1910): n is a, c, g, or t
  misc_feature (1926)..(1927): n is a, c, g, or t
taaacatttaaagtttcgaccccaaaaaaaggattccgagttagatttttgaggtttaaagaacatttgtacgaaatcaactggctcagattcattgtctaatcatttacgcataatttaggtctgatttcggcacttagttccgcgaatgtcccgaacttgcaagacattttgcatgccgctggtctccctgtgcctgacggtaccaatgatcgcgtgggtttggtagaaatttatgaatgtcaattccaataatgaattgttggcaattagctaattgattcgatgtttaggcaaatgtttttctgaacagaagtgttcaggtcgtccgaattgtgtcaattgatcggtattttttgtttccttaaaatactttttgatgtgccatttttgccctctctgattaataaattttcttcagcctaaatgctgatttatttaattgcaattatatattattataaaattggttatctaaataatatcttcttttcttggttcaaaatagcggtgccgctgattgaccccatagataattaaggcccccaaaccaaatgggtgagctcacacaacaaattattcatttcccattaaaatgaacccaaaaaaactgcccaatgaattgttttttgaaattgtcattttgcagtttcacaaaaagtgggcccaacttcgggtgtcctctgtctttgatcactttcttcttgctcacatgtcccaatttctgatcaaatacaaaaattcggtgagaatttcgcaattagcactgatcaacgggaacttaaaaattcttttattatataattttgttattatttctttgtttaaggcggaaaagtgtttaaatgcggtactgaagctgtgcaaaatgttgttaaaactgccgggcattatccgttataacggaattgaagagcctttagagcattttgtaactgaccgcgaattgttttgtaagtaaagcaaaggtcgtagaaaaacaattaaatacataatgcatcactgatcggaaaaaaaatttgcgttttttaaaagccaacattcaaaggtataaaatttttttcggcgctgcgctgaaatttttgaattttttacaaaaaaagataattataaatttttaaaatatttcaatttttgtagggaaaaaataaggtaaaaataagaacaatcgtctgatataaataagaaaaatgtatttcaatgttatttttaaaatagaatcccaaattgcgacattagatttgctcattggtcttgaacgtatccgttgtccgcccaacataaaagcgcaggtcggccttccgccagaatgggaatcggaaccattggcgaaaaatacggtacagagactgagacaaaatattgtaaaaatatggcctgatttgcaatgagaatttatataattttaatttttgctgttttcgagtaaaattttgaaatttctgtgggaatgagttgggcggaaaatttgggaaattaaattgagtataatttcctgggacattccgtcagcattttttcggaaattaaattatttatttttcaaaatttcgaaacaaaattaattgtcatttgctttaagttcctcgatatgcgggcaatgattgttcaaattgtgggcattgtctgccagtggccagaaacgacaacagaagacttggcgaagttggagagcggtaagaacttgccgaaaaatcggtgatggattaatttttattttaagaaaaaatgcgaaatacatattgaaaagctttatcttgaccttaattaagaccaaggtttcaattttagccaagtgtttgattacccaaaaataacggaataaacagaacttgcccatttgcagtccacacttttgcgccttgtctcaataggcttaagtgtcttatactaattagcatgcaaaattntgacaattttcagaannagtaatctct

SEQ ID NO: 25625 - DNA, 1157 bp, Heterodera glycines
ttcctttcactctccgctttgcctcccctccggcgccgctttcctccgttggctttgtgccgctctgtctcctcctccgtcccccctcttccgcctccccttccctccgccttccgtcgttcctttcactctccgctttgcctcccctccggcgccgtttcctccgttgctctgtctcctcctccgttccccctttccgcctccccttccctccgccttccgtcgttcctttcactctccgcttcgcctcccctccggcgccgtttcctccgttggctttgtgccgctctgtctcctcctccgtcccccctcttccgcctccccttccctccgccttccgtcgttcctttcactctccgctttgcctcccctccggcgccgtttcctccgttggctttgtgccgctctgtctcctcctccgtcccccctcttccgcctccccttccctccgccttccgtcgttcctttcactctccgctttgcctcccctccggcaccgtttcctccgttgctctgtctcctcctccgttccccctttccgcctccccttccctccgccttccgtcgttcctttcactctccgctttgcctcccctccggcgccgtttcctccgttggctttgtgccgctctgtctcctcctccgtcccccctcttccgcctccccttccctccgccttccgtcgcccctcccccaccatcgtccgtcttccctcccgctgcttttccctccgatgtgatctctccccgtggcgattcgcttctttcttccctcttcgtcacaagtgtccttctcttcctttcccttcgtcctttgttttggcaacatcgacataacaaaaaatgccattaacaaaagaattgctgccaatgaggcgcctccgatcagtgccattgtcattcctttccgagtgattgcgcattctgccgatgggcttctcagtttctgaattttttggtctttaagaagagttttaagcaatgttagccaatgccaaaagcatcccatcggctgtgaaagggacctcttcggtggcaggaggcctttcgtccaaatcgtaaatcaaaagttggccgtagaagcaccggcgagtcattgggaccatcagaatgaccctggggaggccttaaaacgacgcttcgacttgtgtcggtttt

SEQ ID NO: 25626 - DNA, 1434 bp, Heterodera glycines
tctcgctcttacttcactcccttctttcacacatctctctcttcctctcccccactctctccggaacgggccaactccgtccgagccaactttgagtcaatataactcttgaagtttttgaccgaatcaaacaatcttgatatcattcgaaagctcttcacaggctctattagcctactaaaaattacagaaaatttcgaactataaaaaagatagaaataaaaaactttgaaaattctgccttttttgcggttttaaactgacaatttttttgagagctgattaatcactgagaaatagcttataaatatcttctaaacatctagggctttcgaacgataccatgattgtgaagtttggccaacaaagaaaaaagttatagctttttgaacattgctgagacggagttgacccctaccgactctctctgcttttttttatcatctcaactcttttgattctctcttttctcccattatctcgccttttctcttccctctcacccactcctctctctctctctcactctttctcccttctccgttctctttccccattctctctctctcatccacccccccccactctcccttcttttctcgttcttccctttgtctcctcctctcatccctcgcactctctcttatttttcctatctctcacttcttattccctcccgctcctacgctttcatcacacataagtaagcaactgtctggtcttcccttttttctttgtatatgctatttcttttctttttctcttctttttttcatattaagtcaaaacgccaaatgccaatttaattgagggggcggggcttgctctcatttaatataccttaggggattgaaacaattgagagaaaatgttggacaaatttgtgatcaaaagaatcagattttaaatgacagacaaaagagagaaattgtggaaaaatttcataaaataaaaaataaattaagaaaatgggaaagaaatactcgagaaaagaatggacaaaaattgaaagaaaaattgcacaaaaattgggaacaaataaagagaaaatttacaaattcatcatttatataaatttgagtagtttgccgttttattaaatcaatgagaataaaagcaattaataaaatggatttatataatcattttcattttataaaaatgaatattaaaataatattagttttcttattaattctcaaaaatctaaataaaatttatgctggtggaataaaggaagaaaaaaactttgacgaaatatttggccaaagatgggacgaaaaagaggaggaaaatgaagagaatgaaagtgatgaaaatggaataaatggacaaatgaatgatcaaaatgagacaaaaaatgatgaaaatatttcaaaattattacatgagaaacaatttaatgaaatttttgatgaaatttttaaagtgaaa

SEQ ID NO: 25627 - DNA, 1317 bp, Heterodera glycines
gcagtcgtttacgtatatccgtctccctcaaaatagcaaagtacccttcaccctttccccacccatccttccccccccccgtcccccggcgcgtttcatctccttggcttttgttgctgcgcttctgctttcttaaaaacttctttctcctcacgcctccctccctccctctctccacccattccttcctcctttttcattcgccgtgacgaaaaacgtcttcaaatttcacttgaagaagaagaagaagctgccagacgcaaccaccagcagaaagagcagcacaagccgaccgcttttcctccccccccccccctccccctatggcgctttgaggtctcttccgccgctcgtccgacctcttccccacccacttcccctcctttctcatccgctcttttcactgtggcgtggcggccaaacaaactgttcattttttgggaaattttttcgtttgggataacttttatgccttttggccccttctttctttctctctttcggtgcaatatttatgtgaaatttgatcgtttgccgctgcaaaaattttggtcattttgttcaaagaatataatatttttttggaaagaatgagaattcgtacagtcaaaaatatgggaaaatgcgacattttttgaaatttatccccattgtttctgttaccatagttgtttattcattcatcatttttgcaattatccaatttaattggccgttaatacgtgggaaatttggccataaaattaaaattactgacacctattccaactcactttttcttacacattttattttaaaattatttgttattttttctctttttgccaatattattttgttcaggctgttattaaattatcgcattgaaaacttattaaattggggaagggaataaatttccttttctttaaaatttattcaaaattgatcaaaactcacaaccccttttcacattaatcatttttgctgtaaaatcagcaaaatttccatcaaaattcgatctttgctcctcaacaagttcacatttgttccctattgcaagagttatgtatcccacctttctgaacggccgaaggggggggggggggagaatgggtggtattatttccacaaaaaaattttcgctgttttgatttttgcgcagtcaattatttcattcatttttggaccaaattaaaataacgaattttaatgtaaaaaattggtgttactaaagacttttctaatccccccccccaattcgaagagtgtcaaatccgtcccggccaattcgtctataaactgttataatttaacctacttaaacttcttgacagg

SEQ ID NO: 25628 - DNA, 1034 bp, Heterodera glycines
  misc_feature (69)..(69): n is a, c, g, or t
cctccgtctcatacgcaagcgcttttgtgaggtataccatttaaagaaaaaagagatagacatatttcntgggatagagccttaatttaaaaattccctcaaaaataaaaggtaaattgcgcaccgccctccctatcatgctcgagagcatttgtctgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatacccatttctctgggataacctctacatataaaaatcctctgtgaaataaaatggtgattgttcacatccatatgtgtcatacgcaagctcttctgagaggtataaaatttttcaaaaaacgagatacacattcatctgggatagagtatgaaaatttcagctcccgcaaaaataaaaggtctgttcaactacgctcctctctatcattctcgagagcctttgtacggatacaaatgtaggcaaaaagtgggataggcatctttatcggaaggcctctcaatataaagatcctgagtggaacacaatggcgattgttcatctgccctgcgtaacatttgcgaaataaatgttgaggtacagaatttatcacacaaagatggggaggtcgtcccccccccctcccccccggcgatggctgctgccttttcaacgcttttcctctccattttgttttatcatttgttatcagtccgatcgacagcttttgttcccctcccccttcttatcgccgccaaaaaatggcctccgaccgcgaaatgtcgtcgtcatttttgcgccaccggcggatggaatgaatcggcggctaatcgaatc

SEQ ID NO: 25629 - DNA, 1511 bp, Heterodera glycines
acataaacaaaaccataatcgcaatcacttttttggtgttgataagaaaaaaagcctctattacatcatcctgatcattattatttaattaaaacattggcattttttttaaatttcgtcgaaaatctttcaaaaaaatttctgcgtctattttttggaaatttcttaaggtcctttgaacaaataatctatgtcggtgttttttgaaattttttaaattcggaaaaccaaaaatttacaaattttccaacccacacaattaaaaattccaaagctttaattaaaaatttatttaaaaattgagttataggcgcttttttcgtttttttttaatgtgtaaggaccatctattcttaaaagaaaatttcatttaaaaacaactcagatttggctttaagcctttcaattaaaaatcacgaagctttaattaaaaacttatttaaaaattgaataaaaaattaaatttttttttcccaatttgaaccaaaaaaaaaaattgtatcgtataatttttttgcagatttttactgcaccaaaaatgacttttttccacataacgaattagtgtttttttggaactaaaaatcgcacccccccccccttccttcccccatttgttcagcgcgccttaaggccaccaaaacgatcagtgatttgctgattaccacaatcactgatcaatcgatcgatcgatcaaaccaattctcccttttgtgaacgtttcgtttttggagacctcacactgcttggagaatttctatttaaaaacaaattatttcgcgcttcccttttatgatgcaattctatttttgagccatccccgcccaaaaaaaaagtttttaatttttggttttttacgctattatttgggttccttttattttaaattttcaatttatttttgggttcggcggtgatgacaggcgcggccgagatatttaggcacaattgttaaatggtttcaccaaaaaagaccaatgttaattgttaatccgcgttttaaaaagcaaagaaaattctaattattatttttataattgaattttgaatttttccaaatatttacaatattaaaagtaaaatatttttttcaaataaaatttttactttctcccaaactcccaataataatttttctttcagaccataataccccattgttaccagtgcataaaaatttcgtatttcgtgccaaaatacgaaactatcaacatccctggcacaaacaaaagggatgtgagtcgacgccctcaaaatttcggcaaccggaattatttgaattacgagcccaaaaatttcggaaatcaaaaccagcaattttctaaaattttgtgtcttttaatttttaagattcggatcccctaagaaataatttttttttccatcaatacttggaaatgttatcttacaattccaaattggaaagatatatttgtcataaaaattgccccattttcccatgggtttgcgtctttaagagataattaatcccactttccttctttacgaga

SEQ ID NO: 25630 - DNA, 1503 bp, Heterodera glycines
ttccatttcaaagccgaaagaggcatcgatgataatgcggtcctagaaaatcgaaagaattctttatccaaatatccacaaaaaccgaccaaatcggcaatttttgctgcgtcgaccatggcatttatgtcatttggcacttcaaaaaaggtcacccgtctctttttgctggtcaccacagtcactgggccttaggaaaaatggaaacattggccaacaaaggtaaaacaaattgccaccttttatttcggataggctctgtttgacgtaattcttcaccagacagcgcaacagtgtgcttttgccgacccccgggggaccgacaagggcaacgagcagtggcgggaggacgtcgggacttcggtcgacaatcggaatgtgctttttcttctcgctgagatcggcagccctgaaaatgacttggtaaaaaggcgccgtgggtccttcgcccgccttcggatgagtttttgcgctttgatcgccgagcgaaatttgaacgcctttgggttgttgccgctttgtgccgtcgtatccccactctttctgctctttttcttcaaaacctttcctccctttttgtgaactaaaaaacagaaattaaaatgtccattctcaaaataatggaacacaaaatttacctctgtgctgtttggcattttcagtgttcgagcgcattttcaacaacaaaattaaatggaaagaatgggtaatggttgaaagtataaaaaacattgtaataaatctatccaagaggaaatctcgtgccaaacaaatagatttactcactaaatattttttaaaatggcaaacatgaggataatttgagaatgtaaatgggatggtaatgaatcgacttattgtgagactatcaaagtgaatgccgtcgaagttgtgttttaaatcatttcaaagatgcgagtgccgcggccgcttcctcctcctctcgcagtgtttcttggaaggcattagacgaagaagacgatgcccccgccggcattgggaggcgtatgccatgcagcaaaggtgggatttgccggttcagcgtttccgggctcgggattttcagctggtcactcactcttggctcgctgtcaacagaaacacttttcaacgacgtgctgaaggagtgccgtgccgaatgcaaatggacgccatattttaaagttgcaggaattgctggctgaagttgtgatggcagattcaacgctatttgggttgggtgccgaaaagggactctttgcggaggttccgcaattttccgctctttcctgaaattcaaaattaattttgcatttgcctgacctttggcaaaatgactttggtctgtctttgtctccgttttcctctttttccttcttctctgttggctttcgttgtctgttcggccctgttgctggcttggccttgaagaatgcggggtcaacttcgtaaatgtttggcaatttgatgggcttcagaaactgtaggcactcttttggcgggcccaaatcggcaacgacttgt

SEQ ID NO: 25631 - DNA, 1929 bp, Heterodera glycines
cgtttaatgtaaaaactaacctttagttttaaattttcgccaggttattgtctgtcggaacgcgaaggtgtggtcggcactcctgagaagccgttgtccgacttgggcaaagtcagctaccgttcctactggtggtgggtgctcatcggggtgctcgaccgagagcaggtggagtccaacatttcggtagccgaactctcgcgcctctccggcattcacacggatgacatcattgagacattcaaatcgttgcaactgattaaatattggcgcggtgagaaatgccgacgaatgaatataaaaaacatgcgttttccttttccgttgtcaggtgaccacgtcgtgcgcataagtcaaaaggtcgtctcccagataaaacaattgcatcttttccatccgccaaaattaattctccgcaaatctgcggtccgttggcgtcgcgggtcgacagtctctaacgaagtcggaagaaattgtagggaagaacggggccgttcaatctcagcacattgattcattttccaattatcaaataaatatttctgaagctatttcttcctgacaagttacaatatttgttttcgaacaatcatttttctttgcaattttttaaatcaaagtttattgtctttcaattagccaacaagcgacagttatattgtgtgactcgcccaaaatgtcgaagatgggccgaatggaatcggacacggacccaaatacggtgacaattctgaggaagcaccaagcgccccagcgtgtacttaagtcggacgcggctgtgagtaattttgttttaggattaagaaaaatgctctcgataaaggtgttgtttggaatgaatgaaaaatgaggaaaaccgacctatttcacacgcattacaatttgattttttaaaaataggttaatgcggcaaaaaagcgcggcgacgacgtggaaacgacgaagaaatatttcgcaggggtcagaaaaaagggaataacgcgagaagcatgttaattgtaagtttaggtgaatcgtcagcacaaaacggacaaaaacaccgcggttttggacgcggagacggagcaattgcaccacgaaaggtgagagaaaataggcaaaccaatcggaaataaatgtttcaaaattaagggtttcgctcaaattgggcactgtgattcagcaggcgcggcaggccaaggaatggactcagaaggcgaattttcattccctctttatttacattttttattttaggagttggcaacggttggtatttttgaattgtcccatttttccccgcctaattcctcgctttagcgtgccaatgagaaagtggaggtcattcgggagtacgaaaacggcaaagccgtgcccaaccaatcggtaattcaatttaaaatttccccttttaatcggatttgtccagcaaaaatatatcgcacctcgcttttcagatccttacgaagatggagcgttgccttggcgttaaactgcgcgggaaggaacttggccagccgcttgcgcccgcctcaacggccaaaccgacgacgacggcgaagaaatgagcagccgcaagaggcgaaagtgaacagaaacgccaaaacgactcaatgcctgtgtaaaaattcaacttgtcaacaaatgttcctcttccgatacaatttgtttccatttttcgtttgcaaaagtcacaattatttggtattttgttgttgggatataaaaaaggtttcacacgggctgtatcagatataggcctacccccttttcaatgggatgaaatttcctataccattaggactcaaatggcgggactttttaagtcgactggagatttccgtgatttaaattcccatcccgtcatttccaaattacgtgccagtccgattgaatagactctcttcacaaagtcggtgcaaaatgggcaaaattagtatatttaaaaat

SEQ ID NO: 25632 - DNA, 1429 bp, Heterodera glycines
cacaaatccagcattttccaaataaatcgggattgtggacaccgcccgcccccccccacccaaatccacgttcctacacttctacctaaagcaaatcgatcaaaatattgcttgctttagcctcccgcctctgccaccgccgccacacatccaaacacctctcaaaaccctacgacaaatcacccaaaaatatgacaaatttattattgcactaatgtgttctgtctgattggatggttggtaatgtgttgtgtttgtacatgttaaagaaagcaagtggattaagctctaagattttttgttgttgtaaattttgtccgtaattagttgggtgatttaatgaaatccatgagaaaataattttttttaaaattatttttaatgataaatatatggaaaaattttattattttaaatcagagttcatatcggagttgagatcaatttcaaagtacatttgtgaaatctttgtaaattcaaagaacacaccaaaaattgatcagatgcattaaaaaggggtaaatttaattaaaatatttattttaaatttttgcacaaatttgttaataacacgttttatcctaaaaaagattctaattgacagaataaatgccaaaatttttattcattttttaatattcctttaaaaaattacgcttctaattttaaaagcacaaaaaggtactgtacttttcaaaaaagcatacgatatgaaatctgttttcaattataacaaatgttcagtgattttcatattgaactgttcgcctcgttcagttctttgaataatcgttttactattttttttaaatattaaagaaaacatcaaatataattcatattcattcattcattcacaaaacaaaatttggtttatgtgtaggtctaaattgttctctcaaattttcacaaatttatgagggttttaactaaaataataatttaaaaatagatacttttgtatttttaatatacaatatttaattttttttgaactttatttaactaaaacaataatttcaaaaagtattttttttttagaagaaaactgggttattttttttcctttgttctttttttaaggttttttttaattttaagttttattttcttatttttttttctgttttttttaacttttcttgaatcaaaaggatttttaagttaaatttttgagctttatttaacttaaaaaataattttaaaaaattaaaatctttggttttagttttaacaatcaaacatatataaattatcgcttttttttaaattgaaccaatcaaataagatttatgggttttcaacggcgaaaatttgaaccctctcaaaagatgttgaaaaaccgctccgccccccccccctcccccgggcgcagctggagctgagcatttgtccggacgtacggatcacataaatccatttccctcca

SEQ ID NO: 25633 - DNA, 1805 bp, Heterodera glycines
cgccattccgaaggtaaattaacgcgaaaaagggaaaaggaaagtaattaggctaattgctttttggtatttagcagcttaacatttccttgcaccgcacttcggtcactctcttttctatgaaggttaaatgctgtccttttgctttttaatttgccgttttatcaaagggcccaaatgatgccaattcgtccatgcaatttgaactgaggctggtcagtggccgaacaggtcggccaatcttctcacccgacctgcccaattagcagatcgggcacatcccttccttcgatatttagtcgggcattccccttcccgcgatcaatgcccgatcagctcgggcatccccccccccgatcagatatgaacaatgatctcccgggtccttttgcctcacaattcaatcgctttcttttctcaataaatttttaagaattcccttccgttttcctcgccactcgcgccaattttctacttcaaaaaggtgcgcataatagcattgtgatcgcgcatcaaattttaaggcgaaaatcgcaactcggccattatttcgctgagggaccctttggatgggccgcaggaagtgcacctggaactgttggcatttttggattttcattcctttggcatttttggattttcattcctttggcattttttggattttcattcctttggcatttcccgtccttttgccgttttcgtccttccgtccgtcgttcagttctctttccctcgttcagtgtgcttcgtctgagtgtccgcggaatatttgccggaaaatacatggccaatttgacggttttcgtctcccaacaaaaagcgcaaccgcaccatccgccgcaattgcagcagaaaaacagcgcaaaaagacatcggaggaggagacggacacaccgtaacagagaagaaagaggcgcaagcggacaccgtaacggaatacgtaccgtaaccgaaaaaatcggcggatggtagtcaagtcacaaatcaaatcactcactgtcagcaactgcttttaaccggccatttcggtgtttgttctgccgaatacctcaatcattggaggatgctttttctctttttgttcatttgttttgtgccgtgaattgcaaatttcattttggcatttcattttcattttggcattcgcttttattctgattagataaatcgctagagaatgaatgaattgtctaattgttctattaatctttgtttttcaagtcaaattgacgatggcttttcctgcctgaaggaatgccatggcaccgacgcgcgttgcctttccaattttacgcgtgaaattctgttccaatttcgctccgtcccatccatccgaattatcaaaaaagcgattgaagtgccacttaatttaacatgtaatcaatcagttttagcttttagatttcgcgaattacaactgatttgaatcggacactttccgtcgaatattccctaaatggcaaaaacgcgcattatttctccgtggaacagcagcaaaatgccggtgaatatatgccacttttcaatcatttttcaatgctttttctcccttttatgcatcgtccgactgatcgaaccaatcaaaggacctcaaattgtgctcgttcggctgcacattaccataaagtcagcccgaaatgtcgcactttcgcacaatttggcattgatcgaagtgcacgtcgcagcaaatcacttttgaaaagcattaaatcaaaagttactaattgtttttatgtacatttttaatttttctcattaaattagcgcatttttgttccttcaatccaaaattatgaacattt

SEQ ID NO: 25634 - DNA, 901 bp, Heterodera glycines
tttgtgccgtgacagtccgatcaattcgtgtctgatcagaaatcatgggctgatcggtcccaaataatgacctgatcaggaaaaggtgggtgggggagggactgatcagtcctgcataatgatttttacgatcagttaaccaattcatttctcattcattgcttctccctctccctgtctccctcctctctttaaacacttttttattactttctctctcgctctctcctctctctttctcctttctctctccgctctctcttttctctcccctttaattgtccttcttatgactttctctctctcctctctgcactctttctcgtgattctttatttctttctctatggactttcttttctttctttctctctgttaatagtgcggccggggcggtgctaggtcgtttcttaaaaactgccaagtggtcgtttcttaaaaactgccaagtggtcgtttcttaaaaactgccaagtgggcgtttcttaaaaactgccaagtgggcgtttcttaaaaactgccaagtgggcgtttcttaaaaactgccaagtgggcgtttcttaaaaactgccaagtgggcgtttcttaaaaactgccaagtgggcgtttcttaaaaactgccaagtgggcgtttcttaaaaactgccaagtaggcgtttcttaaaaactgcaaaacaaatatatttatttattaaaaaatgtttatgtcagttgtttgccaacgttataaataataaaaatatatatacatataatttttacatcatttgtttgtcaacactatcttcaacaccaagctcattgtcagtaaaattaaaatattaataaatttattgcttctgatgattgtagttaataaaatttacaaatgagctcaacgatatatttaatattttttctt

SEQ ID NO: 25635 - DNA, 1137 bp, Heterodera glycines
  misc_feature (1046)..(1046): n is a, c, g, or t
ttttactacaccatttttgctaggcttagatcacatgcgatttcggcactctgataatttagcgctcataatgggatgtataaagccgatggtagaaggaatggaagcgctaaaattgtttgagaagctttttgagcgtaattacgatttttacttagaccatttttttctaggcttagatcacatgcgattttcggtactctgataattttagcgctcataatgggatgtataaaggcgattgtagaaggaattggaagcgttaaattgtttgagaagctttttgatcgtaattacgatttttacttacaccattttttgctaggcttagatcacatgcgattttcggcactctgataatttagcgttcataatgggatgtataaaggcgattgtagaaggaattggaagcgctaaaattgtttgagaagctttttgagcgtaattacgatttttacttagaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgatcgtaattacgatttttacttacaccattttttgctaggcttagatcacatgcgattttcggcactctgataattttagcgttcataatgggatgtataaaggcgattgtagaaggaattggaagcgctaaaattgtttgagaagctntttgagcgtaattacgatttttacttagaccatttttttctaggcttagatcacatgcgattttcggcactctgatattttagcgctcata

SEQ ID NO: 25636 - DNA, 1508 bp, Heterodera glycines
  misc_feature (1439)..(1439): n is a, c, g, or t
  misc_feature (1485)..(1485): n is a, c, g, or t
aaaaaaaatgcaattaataaatacattttattatgataagtatgtacatcatggatgtgtaacactctcatgaagatttttgggggttcgggaagcgaattatttttatttactttaatgagtaaagtaatttatttattattgtcatctatgaaatttagtgataaaagaaccgttttcactgggaatgacttaaaactaatgattttattctaattaatgcaatgcgagaaatattgcatatcaataacaaagaaaggtaaaaaaaactaaaaagatcactacagtatgaaaatctactgtggattgacgtgaaaattaagcgaaaaatgatttattttccgaatccgaatccgccacagccaccgccgcatccgccggcacagttcacaatgattgggccgccaccacagccgccaccgccgcaacctcctgaatgttaaaatttgaatggctatatgttacccaaatttttaaatccatttttcagtgtaaatttttaaaacgatttcgcccaacttaccgcaacagcatggccgggggcacggtggtgggcacgggggagggcacggaggagggcacgggggagggcacggaggagggcacgggggagggcacggaggtgggcaagggcacgggggcggacatggcggggcacagcagcagggctggacggggcacggaggagggcagggcggaggggagcaacagcagcaacagttgttgccaccaccgccgaagagaatggcatcggaaagtggcaccagcgcaacagcaacgatcagcagaatggcagatgatcggacgaacattttttaatcggatttgattaagattaagcggctaaagggaaagaaaaataattaggtgacaagcggctcgatcttagaggaaaattgttggcaatgtcgggagacggcatgccataacccagcgaagtaccaataaagtggggcttagggaagtcactggggacgtctactcgaattttggggtcgggttactgattgtcctcgatttgttaatgagacccgttaattggggattagtcaaaacaataagaatttgtggttggaagggtgtgggatcgacatgccatttattaagtgccaaaaaaagttgagactagtgattgaggttctgtaaatgaatttgtggttgtgttgtgtgccttcgttgatccaattagccttaaatactctgtccaatcgctttgcttttgcccaatgtctcaccgttctgtgctttgtgctgctttctgtgctaatccggttctgtttcgctgctgttgcgcccgatttgctgttgatccatccgtccagacattgtgttgcgatcactttttgctgatcattttcccaaatttttccttcccctctcttttcgctgatttgtccccccttgttttgggatggcccaatgacattttccatgattanattcggtgccttttttggctttcgttattttatgcaattacatatntatgtgctccccatttgtctctt

SEQ ID NO: 25637 - DNA, 1749 bp, Heterodera glycines
cgctcggtcgtcgcgagttggatgaccgtgatcacattggcaacaaacgcttggatttggctggtccattaatggcaacgcttttccgtgctcttttccgcaacttgttaaaagaagtgttattcacatttgcttaacaattgcaaaatttgttcaaaaggtccgtctgactgctcaaaaatacatcaacaaaaatggcaattttaatttggatgtttgcgttcggcctacgcttatcactcgtggattgtcctattctttggcaaccggaaattggggagagcagaaaagagcgcatcaaactcgagcaggcgttagccaagtaaaaacaccttcgaagatccaaagttttccaactaaattcaggtgcttaatcgactcacttacactgccacactttcgcatttgcgacgatgcaattcgcctattggacgtgaagggaaattggcaaagcctcgccaattgcacaacactcagtggggaatgatttgcccagcggagacacctgaaggccaagctgtgggcctggtcaaaaacctcgctttaatggcttacatatcagtcggttcactgcctgaaccgatcctcgaattcttagaagaatggtccatggaaaacttggagggtttgtcttttgtctcttctactattttagctatttctttttgaaatttagaagtggcgccaatgtccattgcggacagcacgaaaatattcgtcaatggcgcttgggtgggcattcatcgcaatcccgaccaactgatgacaacattgctgaaattgcgtcgccaaatggacatcatcgtttccgaagtgtccatggtccgtgacattagagatcgtgaaattcgcataagtactgacgcggggcgcgtgtgtcgaccgttgttaattgtgaacgatcgcaagttggtgttgaagaagcaccacatagaacagctcaaggagagggacgtcatggacgaacagcaacagttcacttggtccgatttggtggccggcggagtggtggagcttatcgacgccatggaagagggtaaagagcaatttcaaaaaatgcaattatttacgcgaatactgaaaagtgattaagaaactattatggttgcaatgacacccgaagacctcaaaactggtgggtactgtgaaagctacacgcattgtgagattcatccggcgatgattctcggcgtctgcgcgtctatcattccttttccggaccacaaccaaagtccccgaaacacttaccaaagtgccatgggaaaacaggcgatgggtgtttacacaaccaactttcacgttcggatggacacattggcacatgtgctgtactacccgcaaaagcccctggtgaccacgcgttccatggaatatttacggtgaaacttgttttgcttttttgtgttaattatagacgttttccagtttcaatgaactccctgccggcataaatgccatcgtcgccattctttcgtatggtggctataaccaggaggactccgtgattatgaatcaggctgggattgatcgtggtctgttccgttcggtcggttttttgtttttatatgcccaatttcatgggcgtatcatttctaggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcgg

SEQ ID NO: 25638 - DNA, 768 bp, Heterodera glycines
ttagaaaaatctgaaaaatttttctagcgtgttttttctaatttatgatgaattactaattttttcataaaatcgctagaaaaatttctcaaaaggttttcatgaaaatatttgtttgatttttttcgaattttcgggaagagggggagggaacaacaaaaattcttttgagtgcaaattaactgaaaagtatttaggccgaacgtaacatcatcatgcaagtgacatgcaatgcaactcagtccaccgacagaaatgtccgcgtggttgccctccagtgtttggtccgaatcatgtcactgtactaccgtcacatggagccttacatgggccgagcgctgttccaggtttgcaaaaacaaaaatatatgtcaaatgtatttaccaaaagtgtttttgacagattacgcttcaggcaatgaaggatgcaggtaaaagggctaaactaagcaggaatttgaaaaaactgtccatttttaagaggatgatgttgcactccaaggaattgagttttggtcaaatgtttgtgacgaagagttgaacttggcagcggaggttgaagaggttatgtatctggtgctggggcactacttcccccccccccccctcacggatcatttgcatgccccccccccataaaaaaattttttttttttaaatttctcttaaattttttttggagggggtgggggtggcgatacaggaggaactgatcaacaatattgtcaaaaattctttttcctcaacatatttcttgcttttttggtct

SEQ ID NO: 25639 - DNA, 1212 bp, Heterodera glycines
tttttatctgtggaaatcccaaagataattccataactttttatggtgtattggctcgaggtgtgtgatgccataaggaagacgagtgtgggagaaggtggaataacgaacacgggcaacctctaaaaggagcgcccatagctcactcggatagagcatttcatggtgaggaaaaagggcgtgggttcgagtcccaccgggcgagttcatgttttatgcaatgtttttgaggaaatatagtctgaccataacttattcattcttgggaattaataattggattaaatttattttgtttatgaaaggctcacatattgggacattaattacacaaaaaaaatatgaccaaaaatgggctgattaagttagaaaaacgacaatagcggaccaatggtaatggctagggcgtccaaaaatatggatataaaatcgcgaaatatggatataaaatcgcgaaatatggatataaaattgccaaaatatggacataaaattgcaaaatatggatataaatttttccaaatttaggctataatttctcaaaatttcttcaaattcgctaaatgcaaagtaaaactttcaagaatggctagatatgtattaaaaatcatttttgaagaaaaaaacacgatacattaatcaaaattttcgacaaaattttgataaaaaatgcctttttcgcaaaaattttccgatttggggtcaaaatcccaatttagctgatgggggccgttctaatagaggttttttggaaaaatcccagaatatggacataaaatatggataaaaaagccaaaatatggaaatatggacataaatccagggctcggatctgtccttatttataagatttgtccttatttggagggtccaaatcttacaaaataaaaatgtccttatttgtaagatttgtccttatttcgggctattgttcttattttgttctgctttactcaagtcacttaaaacgaaaggcccaaaaattcttataaatatattcaatgtttattgtcgatccattttggaatttggttctccggtttttaatccatatatgaaaaaagacattcatgctcttgagaatgttcacaaaacttttttacgtattgtttttagacgtaataataacaaggatgatatacccggttataatgaacttctccagctttttaaacaagaatcccttttaaaacgcagaataaaaataggctc

SEQ ID NO: 25640 - DNA, 1033 bp, Heterodera glycines
caaatatcgtaagattgtttgatagggccagacaagagaaggcaactgttggtacccaagtttgcggtaaaaaaatgataaaaaagagagccattttttggtcaagaattttttttgtttgcgtttcaaatatcgtaagattgtttgatagggccagacaagagaaggcaacagttggtaccaattttgcggtaaaaaatgagaaaaaagagatagccattttttggtcaagaattttttttgtttgcgtttcaaatatcgtaagattgtttgatagggccagacaagagaaggcaacagttggtaccaattttgcggtaaaaaaatgagaaaaaagagatagccattttttggtcaagaattttttttgtttgcgtttcaaatatcgtaagattgtttgatagggccagacaagagaaggcaacagttggtaccaattttgcggtaaaaaaatgagaaaaaagagatagccattttttggtcaagaattttttttgtttgcgtttcaaatatcgtaagattgtttgatagggccagacaagagaaggcaactgttggtaccaattttgcggtaaaaaatgagaaaaaagagataaccatttttggtcaagaattttttttgtttgcgtttcaaatatcgtaagattgtttgatagggccagacaagagaaggcaacagttggtaccaattttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaagagatagccattttttggtcaagaattttttttgtttgcgtttcaaatatcgtaagattgtttgatagggccagacaagagaaggcaactgttggtaccaagtttgcgcctcggcccccctggctacgcccttggttccatgttttcaaattattatgtttaaaaaatttaaaagctatgttcatggtatgt

SEQ ID NO: 25641 - DNA, 1762 bp, Heterodera glycines
ctcccttccttttccccctttgggcctcttttgtttgctcttcgtctgtagtaaagttgagccctgaacatcgcaggacagcggggggaaggacttgtccagtcatcagaagcacttccccggccctttacagcagcagacactgttcgttcgtctgtcctccgccggtcagcgactgttcctcccgtaatggaaatggatatttttattcactcaatgaattcatttgtgagaaactcggccaggaatagcctcgggaatggaaaagaaacgactgacaaatgtggggaaaagaaaatccaaaatttaaaataaagcaaaaacaaaaaaggaaacaaacgatggggaaagacaaatgtttacttgttaaagatggaggacatcaaattaaactctttattaatcttaactgaacaaaatatttatgtaacaaatgtcaaaattgagaagcaataattggcgcggcataataaaaatttggatgttcaagtgacatttccctttcatttctttattagtgaacgcagccaaagagcaaagaaagcgaccaatcgaagcactgaagggaaagagaaacttcggcggaataaattcggtgaaactggccaattatcatcgccgccattattccgtaatctctccacaaattgttctcactgaagctcatcccttcgagcacatcggtgccattacgacaacaattcaacgggtcacaaacgatcactccgccgcttttcatgtgcggctgcggaaagggcgactgacagcctaaaaatggcaaaaatatataaaacggtataaaatgaaaatatgcggaaaaaggcacctgaaatttgatggacccgcgtccattgattgatcgccgcagtttcataagcgtaaccaaaataagagaggtatttgagcggataaaagtaagagggcagagaatcctgaaaaggaaaaatggaaggaaaagaaaggaaaagggacggacggacctgactgatgtaaaagccaccaaatgcgagcaaagggatcacaaaaattggcataacggcagtctaaacgagaaatgaattgaaaatggtgagtggaaaatggcaaacaccgaaacatcgttggctccaaaaatacaagcggaagcataagctgaaaatgaacagaaaaagagagagaatttaatgaaatgggaaatattaatggacaaacccaacccacctaaagaaacggcaacatttgttatcgaaacacagctcaaagtgaataacagcgaagaatcgaaagaggcgacaaaacgaagtgccatccaatagacaatggaggagaaaatgacagggtaaacgacgtattggaccaactgaaacaaagtgagggggggggggcaccgtttgaatgggagacaaatacggtagaaaatgaaaacctctgccaaatttttagccaaaaaatacgtgtcgacgcggtataaattggacgaatgttcgcgcataaaaatgggcaattcgtcacaaaaaacctaaaaagaaaagatgctaataacagagaaaataagtgtacatggacagctgcgaattggaacatgaaattcatattggcaaccgcttgaaacatcagtccgttgatgttcataacggtggactgagtgacagcagtgttccaataaatggagcccaaaagaagaccgacgagctaaaaagggagaagagtaagtggacggacgaatggacaaatggaaaaccaaagtttggaagagccgaactcggagtaacatcggctcacg

SEQ ID NO: 25642 - DNA, 1244 bp, Heterodera glycines
gggttgtcagtttgccattaggggtcagcatttcaaaaaatggtaaaatattgggggtccggcggtgccgatagacgttcgccggaaaaatttaatccactttattagaaaaaattgtttagggaaaatttttcattcccgggaggggggggggagattccctctctggctccatgcctgtcaaaatttgccacaatcgacaagcaatataaaaaaaaatcacaagccggttcagagaaaatcaaatattcgctgaccagttttacctgggtacaccccaaaatctcgccgccggaatctcgccggcacaaaatctcgtcgcaaatttcaaaaaaaatttttctaacaaattttccaaagaaaaaattggaaaatctttaataaaaaatttataaaaaaatttttgaaaattttttatctgaactcagattaataaaatttcaaacccctaaccccgaactgaaggcgacggcaaaaaatgttttttttgaaaaaaattcaaaaatgttcgaattcgtggttaggagttcaaaattttattaatctgagttcaggttcgtgcttagcgaccccgaaaacccctggaagcatgtttataatgccttatattaaaattttttttttatgtggtttagaccacataagtaccgaaagttataatggaaaaacatgccgaacagtgggggccgaactgaggtaaaccgagcggtaggggtcaactgcgtctgaagacaattaagaagccatagatttaatacttgaaaactgcaaaaaaacttgaatttttttgtattttgtttttaattgttttagtggctctgttccagtttacgcgtccaattagttaccatcctcactttctttggtcataactttcttaattggtcaatccaaacattttggtatgaatcaaaagcttaaagaaaaatgactaagtttgcaaattagagccaattttttaagaaaaattaaggattctaggttccggtggtgccggtaggcgccaccgggggaaaattgaaaatttgaccatattttgtagattttcatgaaaaaattcacaattttttgtattttcataaaaaattgataattttttggatattataaaaaatttagcaaaaattttttggaaaatttgggtgaggtagaggtcttggagcgggtaccaacaagaaaaagtcgaacatttttagcaaaagcatttccttaaaaattccccgtgcggaggggccttggggggg

SEQ ID NO: 25643 - DNA, 1581 bp, Heterodera glycines
ataaatccaaattcttaataaaaaagaagcaaattattaagcaaacaaaaaataccataccaaaaataaatgcaaaaggctgaaattcaattgaattcatagttaatttcatttaaaataaagatgtgatgaaattgttttatgtaaaaaaatacaaaatgaaaaatatttttgtgtattatttatgctaattgagcacatttaaaatttcggtctaattttgcgtccaaatgaattgttccaatgtcaaacgttttgcgtggaattggatccaagctgacaaatgtgctggggaccttaacacttaacttaatcggcaaaatttaattatttaaaaatatatttaaattattttttcacgactccttcttacaaaatcaaatcgctttaaaaagcatttcctcatttttcgtgtctcactaattagccctttattaccttaatgaccatttgcacaatgcacgggacattgcactccttaattaattaaagatggattaacagcttgtttatggtaattgcgtttccaaatttacgtggaaaatgatcagtcgcgggtccatttccgccatcgcttcagcctcctcttcgtggccgatcagctcaaaattgcccgactgatcagttgtgccctctgtcatcatgtcatcatgttcaagcgctagaatttaaaaaaaatttaaaaatataaaatttacataaaaaatttttaaattttcgaaattcgcacattccctgtcgtacagtctgacggtgagcccttcgtacggatttccattgcaaaacattgatccccgaaccgcaacggaccgagcagaattttcgaggccaaaaacgagaaattgtgaagcgaaatgtattgttaataaaatggagcacaaaagcatttgtttggtgggcatcgtttaaaaatcgaaaaaatttgaaatggaatggaaggacaaattaggaggaaggaaatcagtgtccatttcgggcaaatttaattggatcatttgaccttctaatttaattatgccattcttccccccgccccattgacgtcaatgtcttaatgaatttgcgttaattaaataaacataaaaataaaataattaagtaaatccattgaataaatgaatgaaaaaattatttttttcaacttctgagaaaataagaaatttaaaaatgggttgcgcagacatcaataaatcacaattaaattgaattggaactgttgagtgaaaatgggtgcaccgcaaaattgggccaatcgatcgcccgagggctaagaaaggaaataataaataaaaattaattacaattagcaaaatattaaaaaagataaaaatcaaaaatgccaaaaaactttttaatatacatatgctctgtaataaaattaaggcaatgggaacataaaaatcttgatcaatctcgatcatcatgaagaagtggtctgatcacttcggtcgctccctctcttcctctctcgcgttctctttaccgtagattcattttaccgtatccctagatgcccaccctaaatagaagaaataaaactaaggatttttcatttttaagaaatattttaacaaattacgc

SEQ ID NO: 25644 - DNA, 1663 bp, Heterodera glycines
  misc_feature (1485)..(1485): n is a, c, g, or t
  misc_feature (1538)..(1539): n is a, c, g, or t
caaatcctgcaagttttgcagaccacccatgcatttggtaatctgacgcatccgatcagcacgataattgaaaaagaccaatgtgtcattgtctgaaattgcaaattctgcttgaaaatgaatgactaacaataagcatctttagagccggtacagcaaaaaggccgagaacaaaaaatttttttttcgacgttttgcttttttgggtggagggagcaatatttatttcctaaaaattggtatatccttttggttttattcatttattttctatttctgaaaatagtactattacatagtttcatggtggttgatcatgaatgtgtttgttttttcaaaccaaagattcttcctttgttttttccttgaaaaatttacccccccccctaaaattcctggataaaaacagcaattttttcatacctttcacacgcgcttcgtccgaaaacacgatgggcatcagaaattcgtcagtctgttggattgcgtagcgcccgttcaccaattgtacagcattcgccggttcgcactgttcgcccactccgccaaccaatgcctcgtaggcaacctttaggaaaaatgaaaatccaaaaaatgatattttttcgaaaatgagtgccttaattcgatcccatcgtttgtcacggtccatggcataataacgaccaacaatggttgccaattcgccatagtcttcggcaattaagaagtcaagcagttgttgcaagaagacggctaaaaatggcgggagcatatataatcgcagatttgttaaattgaattttttattttacctccactcgttggcgatgcgtcacggccgtcggcaaaaaagtggacaaaaacttttggcacttttaattgtttgaaggaatccaacagaccaaacaaatggcctatgtgcgagtgagcaccgccgtcactgatctgaacatttttgtatttgattggagaaaatggaataaaaaacgattttttataaaactcaccaaacccaacaaatggagtcgtccgtttccgttgattgcttgttctgcggcgtcgatcacttcgctgttctcaatcagtttcttcttgcgcacttccatattgatgcgaacaaagtcctaaacgaaattatgaatgaggacgtggaattccatttaaaatgtgagcgttagttgaaaagtagcactttttgaaaatttttaaaagccaagtggggacccaattggacagcaatttattttaatatgatgcctagcgtaaaaacatttttatatttctgaacagggattcggaaatgactctgaaaacctcgggaaaagttttacgatttttagcactattgcagtttacacgacctaaaaaaatttacaaccaagaagtccccacatttcaacaagcgctaaaaattttgatgactaaaaaaataacctggtaaatcacgcgacccgctccgatgttcagatggccacattcggaattgcccataaccccctcttncagtccaacatgttcaccatgcgcttccaactgttgccaattgccggaacaanngtggtccatcacccggtgtgtccgcatttgcaatggcattgcctttcttctgatcagagagtccccatccgtcaataacatcagcacacatttggtttccattaagcgattattaatgattttt

SEQ ID NO: 25645 - DNA, 795 bp, Heterodera glycines
tgctatagttaagcaggaccgggattctgtcaaaaagctgggaccacaattttcatccaaaatcgaaatactcgaaaaaaaaaattctcatttttaattgaattaaatcaatgaattcttggtaatggaagggtgttactcgaaattagtacgcctccagctaaaatcgaacgtttgcgcccgtttttacaaaaatttttaaatttacaatttggaaaacttctaccgttttctttttcaaacttttatgatgaactactaagttatgtcaaaaagtttttaaaaacgctaaaaagttttttttaaatttaaaatttcttctagaaaatttgttacgttttttcttgaaaaatctcaaaataatgagcccgtcatccccccgccctcaacagatgaacgagcacttggtccgatgtgaggccgaacgtccgtatgtgtgcgatgcgctggtcggcacgcagaagtgcggacggcgttttacctccgccaagggcatgggcgttcaccagggcatgtaccacacggggaaggagaaggggtcgcgcttcaactgcaagcactgctcgcacggcaccaacaatgagcgatcattttacgaccaccaagagcggtgtggtcgcggcgctattgtgcgacggtcgcgttcccgctcgcgtgggcccagtgtgtcgcgggggcccagcatggtgcgtgagctgagcggtgagccgcgtgatcggagcgtgccgcgtgagcgaagcgatgcactgcgtgatcggagcgtgccgcgtgaacggagcgtgccgcgcgagcgag

SEQ ID NO: 25646 - DNA, 995 bp, Heterodera glycines
agaaacaatttccagaacaattagtatcggcgtaattattctgagaatgcggttgaattcctattactgtgagcagaaaaagagatagccaattttccaaattttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaatgagatagccaattttccaaatttttcccaaacaaacgcgc

SEQ ID NO: 25647 - DNA, 1026 bp, Heterodera glycines
  misc_feature (974)..(974): n is a, c, g, or t
cgcaaagaaaagcagaattcttcttggcacggttttttattacgggtcccttattattcaattaacaataaaaactaagtaattatcctataaaagtttcctttatccattgaatcactttttgccacatttcacgagcagttgaaggggtggaaatgtgaatgaactgaccaacatgcatatgctataggtgacgaactgaaaaaacaaatcaaattaaaatgaacatttaaactgtgaaaaagaaatgcatttttaattatctttaaaattaatttattaattttattttattttaatttaaattatataaatgtttctagttcttatggataatttaattattaattaaaaatgattgaaataatgtatttatagtattaattaattatttgccccacttgtgcttcaagtgacaatgcaaaagcaccatttacatcgacaataagcagtgtgacgactgattggagcagaagcgcaacaaaactgttaatgccaaacacgaggccataggcgccatttggtgacaaatgagtggcaatcaaattgctgagcaaattaatgaggcaattaaacatttttaattgtttaaaactcaatctcccggcttaattcttttagaatttggtaataatccacctaagatttttttaattttgttcaaaataacctaaaatatagtcaataaaagatgcgggttttttatttataggattgcccggcatttttgggggtagaatttccgaaattttttgaatcatcgaatttcaaattgccgaaaatttttggcgccatagtgacctggaaatggcattgagcgtattgtaaaacatataaagcacaatgtaaagaatgtaatcggcaaagagcgagtcaaagtgcaccattgcatacagtaaccaggccatggacattgtggaaacgcacacaccacgacactacggtactcggcccatttgagcggaacgaactgngccaaaatacaacaagcgtgtcttaaaaacgagttaatcatattgataacat

SEQ ID NO: 25648 - DNA, 1091 bp, Heterodera glycines
  misc_feature (109)..(109): n is a, c, g, or t
  misc_feature (123)..(123): n is a, c, g, or t
aaaagatgaaattcttcgctctggggttgtcttatagcaaattcttgatttaacagaacatcgcgagaagttcatttcatttctagaaaatttttcattatatttcctntaaaagttgaattntaaaaatgttcttaatttcttaaatatttttaagtcttcaatatttttcttgaaaatttctgcctgagcaattgcttttatagggagcttaagctggccagcagcttggtggtctcatatttttgtcctcttaccttacctctttattctgtcgatttctctttttatttattcagctcttttcacgttttcgcacattatttctcattgaatctgcttcgcaccattctcttttcccctattaatttaaaattctgaaatattaatcttaaaattatcaattaatcagctcaagtaatgataattgttgcttattagttttccagaaaatcagctttacctaccattattggaatgcttattgggctgtgagtgatgcttcaaaatattagtttcattaaatacttttatagtttggtcttgttttcaattttaccaaaatttaatatattgtatggcattttagtgcataattttatgtttgccaattttcaggtcaatggtaaaactgggctgctgaaaacacattgacatattttgatcatcaaaattacttgtttaataaacaagaaaaaaatacaaatgaattttacacccaaaatatttctatattacttaatattaatcaattatattaacatatttaaccaaaagatttacaaaaaaaaaattaattatataaattatataattcattaatttgatcaaaattattaaaaaagccgattaatacaaataaattatagaacattaaatttttatttatattaattttaagaaagattttttatggataaatttttataatatatatttatcttttaggcttaattatacacgtgctgaatgtccttgaagttttcaaggaaattttttatttcataggggtatttttttttcattgctgggcgacgatgttttagtcaaattaaaaaaataatgtcaataagcacaaaaaagcataagat

SEQ ID NO: 25649 - DNA, 1164 bp, Heterodera glycines
ctgcggtctcagccgccgctcccccaacaacgccaccgtcaaaatttgttgttaatttcgaagtgcccttcttgagggtatgagctattccgcttttccctgagtttagtgcagcccttaatgcagttctttctgcatgaaccacagaataatggcggccaccgtttcgtaggagatgacgaaaaagcgtgaggattgaccgtaaaatatgcgtctctccatgggtagaaataagagcggaaaagagaatcaaaaggataagggaacaatgcattttgactagttgctaggagacaaattgctacttataagcaaccagaaaagctcagacagctgacgtaggaagtgttttcgacagcctatgtcaaggtcccgcctaggggagaagcaaagtccaattctcactgctgacagctgttcattccttttatttctgacgttgaagatgcttgtgacagctgatggcaactctctgggcgagggctaggccaattctcattgccgacagccgttaaaaaatcttattttttgtcaacaagccatgataaaatgatgcgaattggaattcatgcaactgtcttttttttctgcctaatttcaaaaagctttgttgaagccccagccgaccgaacaacaaagggcaagtatttaatcctgtttaatgggtatgagtggcggaaaaaaaaatgtgatagcggcaggagaagttcaggtcgtttgatgtagtaagacttgtccaatcttggtataggtctgggtttgtccaagaaaaacttgtccaggccgcgctcattctgccgttggatcgatcgagcttcgcgttgttacagcacataaccatttaatcgattcaacgcaacataccgtaattaaaatgataagggtgaattatttggaatgattaggtgcgtgatcgcaaggaacaaatcaagcagagagccgcaaatcatgcagatgctcccagaaatattattggggcggcacgggctaatttggatgatgaatcgcttttaaatatgccgtcaacttcaactgctaaccgtttaatttccaggcaaagacatattccaggacgagaaaacgttgatcaaaatgacgtcaacgccattgtccttgaagtaataaagatatatagatattttaatttcttgttaaagggcgaat

SEQ ID NO: 25650 - DNA, 2111 bp, Heterodera glycines
  misc_feature (2059)..(2059): n is a, c, g, or t
  misc_feature (2069)..(2069): n is a, c, g, or t
  misc_feature (2104)..(2104): n is a, c, g, or t
attttatcaccttcaaacaaacattgattatttagattattcatttcgttttgtgatgagcaaaccaccagttccgacgcggattggcccatttcttaaaatgtggcacgatttttggggatctttttcgcgcgtcaaaaaaaggaaattcgttggtgaagacagcgcaggcaatcgcttttacgaaattttggagggaaaccgaaaaggaaatgtgaacaggtaggaaatgttttttttgctttcatatttttattttaccataaatctgacggaattgtccagggaatgacggcatttggttatttttgtcaaactatcgcctatttttcaatcatttaatttttatgggaatggtccgcagtaccagagaaatatgtgattttgtttacagaacaataggactaaagcatcacacacactgagaaccccgcttttcgtttaggggttttgagccgcccccggacgtcgaagttccgtcagaaccaccggtggaatggcgcgcgtggctcaacaaaagcaggcgtttccctccgtcggaagaagaaattcagctgaacctactcaaacaacaagtaaaaaagcacagaataaacaatgtaacctctgcgccattctaaaattgcgacaattgcaattcaaaatttaaaaaaatcgttgaaattatctttttttaattgctcttttcccaatagcaatgtttatttgttactttttaggctcaactggtacaaaacacagaaacggaaaagaaagcgccaatgattgtgtcgacgggccctggggcagcggaaactgacaaaaggcgaaatatggcagggaaagaataccctaagtacaccgaagaagagtacgagggaattgcgggggcaaagacgagagagcaattggagagggagcagaaggagggcaagtggaagtacaaaaaattctttttcgagaaataattggctgacaaaaccatcatgtttattgttttagctgttgtttttaataggaatattgataaaaacaatgaaagaatattgatgattatcaaacattaaaattgttttaaacaattgacgattattaaacattgaaattatttggattgtgcaattaaggaacaatgaaagaaagaagtcataaaaggcagtgaaaatgaaagacattctctcgaaagactaaaggaaagtcgaaggttcaaaaagtaggttaattgctatccgaaacggctttttcaaccttagtggttggtcatcacttttatttcttatgcaaaacgaataaaccctgctttattcggtgctttcgcttttgttgaaggagttcgcgttgctgtccacgatcatgtccctgacggaagtgcccactgaccaaacgaattccgggtcgtcggcacattttaacgcggtgacgcgactgtcctcgtaataggcaccctcacagagatcgtcggagaaagcgacgttcaacacgcgagtcgcggccaacagcggcgacctgcgaaatttaagaggaaaagcaaaataaagaaattggcaaaaaaaagaccaaagcaccaacctcaaaaatggtctcaaaaatccgttgatgaataatcggaagggccaaaaaacatttcggtacaatttgccaggcacaacgccgggatggacactgacaacggcgattttactctgtcgaattctaaaatacggcataaaatagaaaaccaatctataatactttaaaacatggttcaaatgtttgacgtaaatgccgagcaacaattttgagtcggcgtacgatttatagtcgttgatgcgacggcaccaaaacttttctaaaaaatctcagtgaaattaaattaaaataatttaagcgggtaaatttcattttttaaatatttaattcgttaaataatgatggcatttgcccttcattcgccgtgccttcgttctccaaaagtagtgacagttcgccggcatgcgcagtgcacgaggaaaggaaaacggcgcggggcgaacggaagcgactgcactccaaccgaccggcaaaggaggcgaaaagctgcgcatttgccagcacattcacncgcgagatgnggctcaatgatggaacagccgaagcgaccgatgcngaaggga

SEQ ID NO: 25651 - DNA, 1849 bp, Heterodera glycines
tccaaaagagtaaaaacccacgaaatgtccaaaatttttcaaaatttataaaaacaaaatgagtctaatttaggatttttagggttttcggggtcgctgaatacgaatataccatttatattaccccttgcctaaccttaggcccatctgaataataaaaaactcaaattcgagacttggacatttcgtggcctggacattttgtgggtcagcgaataagtagcaaaattaaggcattccatttccatgaaaatcactcaaaaggccaatcttttgtcttacaaatcgatttataacgcaaaaactgtttttggatgcggtgaaaaagagggcacaaaatactgcacaaatgtaaaaaaatatgcaaacaaacggaaacggcgggacctaagcaagacattttttcattcgttaaaatttaataaatttttggtgaataaatattttttaatttgcatttttatacatgtttaagaaaaaataagaataatttaacgaaaataaaggaataatttcaaaattacatatgacaattctcccattactcttcctctttcttcgcctcttttttgtcttccgtttgtccctctttgtcactgatctgatcggaaatccaccgcaagtacggctctgacccgtactcaattggaaatgccacaaattcggggacctcgtaactgtgaaagatgcaaagaaatgggtgctttattttaatgcttgatcattagggtttaagttgtatgcactaaaaaatgccaaatatgcgcataaaatatgcactaaaaatcccccaaatatgccctaaaacccgaaaaatgcccaaatatgcactaaaatatgctttaaaaaactgccaaaaatggcttttagccctcaaaaaatgccaaaaattgtgtataaattaagaattacttttaaaaaaccaaaacaagggctaaggagcattttcggtccttaggggtgtattttcgcatttttcgtatgaaaattcgccaaaaatgcccgaaatatgttctcaaaacgcaaaaatggccaaatatgcagttattctcgaaaacccccaaaatatgcttttatatgcactaaaaaccttcaccaaatcaaaaaattttaacgtagaaatgctatttttgagcccctttcttcatagcatatgcgcagaaatatccaaaatcatacaacttataaccctattgatcattaattacgggtgcagtttgatcactgcctctctgagctgttccagccgttctctgcccgttttgatgatcagcaatgactcgctgtcctcctccacctttcccttccattcgtagactgaagtaatctgtggcacaatgttcacacaagcggccaaccgactgcggaccaattcatgagcaattcgtttgccaatttcagcggagggaacggacacataaacaacctttgaagaaaagaaagagaaactgatttggggaaaattgtaccaaacaaagaacagaagagaaaaccgtttaaattaggaggggggggggagattagctaataattgtccacctaaagcatcgtttaaatgaaataagccttaaataaaaataagttgagtttgaaattatatattgtggcacatggttggatcattctaaaacttattcatggccaatcatacaaaatgctttttgcttttcccaaataatttgccttttgctaaataatcagaaaaaggggccactgacagagaaacgcgaaagactcgccactgcacgacccgccatcagttgctgctgctgttctgttgtgggatttgtttgagtcgacaatcgccgatagaaatgagaataaaaaacggaagcgacaattaaaaatg

SEQ ID NO: 25652 - DNA, 1144 bp, Heterodera glycines
  misc_feature (109)..(109): n is a, c, g, or t
ggaaaaagaatgaaatttgtaaaaatgatgccaaagaaagcacacccttttctgacacaaccgaacccatcgaatccccattaagcggcgcatacccattaataatacncgatgaatgaacgaaccaatgctaatgtgtcccgcatcgcacgcgatcatcagcggagtcatgccaacttccaggcccaagtcgacgttggcaccgtgcgcaagcagcacacggcacactcccaaaaagccgtacgaagcggcgacccaaaggggagtcccatctaataaaaattcgttttgaaaaggcccaaagccatttttggctcacaatatttgtaatcgccgttgattttccgaaggctcatttggtgcgggtcggctcccttctccaactgagaaaaatagtcaaatgagtgccaatcattggaatttgtcccgggcccaacggtggaaaagtctcggcttttagggtaacagaatttcttctataatgcaattagtcactgatcaggcctaatgtcccttttctgtctgttccatggcatgatcagctgtttttttcgattggtgatcaaaatgctgcttatcgcccgatttgacagaaactcggacataaaccatgtctttgacttagtgtgccaaaacattttttgtctttttgagatttaagagccaatgttcgaatttgctgttgacatgccaaaactgccgcaacttccggcttgtttcccactgtggcgatcagcagcggagtcagccgcttttcggtgccctttggggcgtactgtatgtacagtaagtgactgagttcgtcgcccgggagcgaattgagcagggcacgcaactcttccgctttatttttgtagacaaaatcaaaaaattgcttcataataacccaccattcagctccagcatatcccaccccccccccacccccctcaccccctttcttggcccacccattgaattttccccccgtttttttttcttgcggtcatcgctttttcgagactctcgactcttgagctcgagaatttttttgggtttcaattttgttgaataatcctcgagtcattttgacaaaatgtcgttcgttggtaaaatttcgtcgacggatttataaaaaaatattttggccttaaaattacaaatt

SEQ ID NO: 25653 - DNA, 1724 bp, Heterodera glycines
  misc_feature (37)..(37): n is a, c, g, or t
  misc_feature (55)..(55): n is a, c, g, or t
  misc_feature (200)..(200): n is a, c, g, or t
atttatatttcgagttaagtctataaaagggaatgtnaaagcgtcagaaagttgnaatattcaaaggatttaagatctgttcggccataaattattttatgagccatgaacagatcagaaaagctttcgcctgctttcaagtgttggcagttgaaggtattctaatctttgttggtatggaatgggtggaaggctgcatntaaaaagaactaaaaaacggccgcataataattgaggggagagaatacgcacaaatggcgacggatgggcaccagagaaagaggggaacacaaaaatattgggggacaccacacacaacaaacacaaatgactgtgcagcgtgcccagcagacacttacagaccatttgcgctccgacctttgagcctttgatcaaaaaagggaattcaaaaattcattttcttcctctacagtcggaaatcatggactataatttgggaaatcccaggaacagaatacctaatggtgctttttcataaacaaaaaggacaaggcacggatcatgctataattacctagaaagtgtctttaattgtcgggatcatgctggatccccctatttgctgcttttggagctttcttttccatacaatggaacgaataaaaaaggtcatttacaaattgctgagaaaatccagtgtttacaactaatataagtgataaataaacaaaaagtgaattgcaaaaaggcatttcaactgtcgtcgtttattcacttttttcgtgcggttgtggacgaagacagcgacgaagccgattggagcgtgtcgaagaagtcgacaaatcccgacaaattgtcacgtgactgctccaagaagcctcgatttgaaggaggaccacccacgtcaccagcagttgattgagtagtggaagactttcccaatttttcaccggagactgcagcgggtgtccgtagtggcgctttctgcaaaaatttcaaattgtgcgaaaacagtttttggggaaattacatccccggcattcttcaaaaaggtactccaggaaaaccacgtcagggtttgtaacataatccacggtgcaactttttgaatgggttgttcagcggtgacgcatccaacaacatcgaatcggacaacggcaccaacattgtggagctgttcatggttgtgttgctgcagccgatcagatgactgctgctgttgatgctggcatcttgcgattgcgcagtggtagaggtgttattgtcaatgacaacaattgcattctcatcattttcatggtcccaaagcgcggaagaaagagtgacagatgaggaggacaaagatgatggcaccgacggcggagggagacacactttggcattttgtttatgctttttggcactaaatatgtatagggctaattgtgagattaattgctcttcatcattcacccgtcttctgcccgtaaagaatccaacaatgcgtcagcagtgacttttcgcttcggtaccaacattttgttcacatttggggccaccgtatcagcgacggtcctttcagtcccatccttagctaaatgtaaaattttaaaatttgatcagcattttgttccacctccattttgcactctccgatggtataacatggaattgccataatttaaatttgcgctctgctgttgctgccttttgcgctgctgttccgcctcaaccgcttgtaaatgttcgcgtccaattgaagcgatctgatcacagtcaacgaa

SEQ ID NO: 25654 - DNA, 800 bp, Heterodera glycines
attttgaccatatttttagcagattttcattaaaaaattctttaaaaccacaaaatgaggctaaagcctcagatctacgaaccctgattttaaataatatattattacttaatctttattttagggaatccatccctcaattgaaactttgaatttgttagacaattttgtgggttctgctggtcaacagaatgtagaagaggtgaattttgactttcgaattaaaaaaaatttacatcattttttattggaggtcagtggtgatcagaaagtggagaaaacaaaagaatgatcagaaaaacaaacgattataagcagtttgacaatgcaaagacacattgattttaaatcataatagtaataagcattacttacataaaaaaaatattttaaataaaaataatgcattcaaatttgagtttttcctccgacgctcgttgaaataaaagtcgtggaagaaattccccaacaaatttgtctgggatggcaggggaaatttgaaaaatgtccgaagcaacaaactcatcggggagaaaatattttgataaaagtcaaaaaaagataacagaattttcaaatcaaaaaaggcttggaaaaattggtgctaggtcgtcgtttttttaaatccaccattttagctagtttttcgacaaaatatggtataacttcgctgaaaagcaataaaattttacatttttggtaccattcaatagccaagctttttttctattagcctgcaaaatttaaaataaaattatcaaatttaacataagttatgacagaaaaccagttgggctatt

SEQ ID NO: 25655 - DNA, 827 bp, Heterodera glycines
ttatggcaaattttgctaatctaaagaattttcaatgttgagtcgaccgacttaaacttggtatatctctggaagccatcagccattttcagcaatcaaccccacgttttgaagcttagatgtagagctttcaaaaatggggtcgggaacaccatttcgatttaaggaacaggatttagaggcaaagcaagaaattttagggggtaaagaatcatgcaaaaatttcaaagaaactggtatatttttcttctgtgctgtcgtcgatttttaggatcttttcgaaagttgtaggataatgttccagctttccaatgacaccttgactgtgacctgaaacaagttctatgccgagctacaagcctcagaagctcgactagtcggtgatacttagaaaaaacacaccaactcacgagcccgggtattcccaattgatatggaaccgaaataaaggcgccaatcaattcgtcatagtcgaaaacctagggtatatggtttccgaacaaatctgagacactcgccaaaaactgttccatcgttcttaaggcaaaagtcgatttttataaaaattggcatttaaaatttttacatttttttcaaaaattgttcaaatcttcacattttgctcggaaccgctccgagacccccttcttctcccttctgagcaccggctcccggtaccataaataatatgtttagaactttgcgtcaagaattcaagatttatatgaaaaagctgactgacaaaatcttatgtaaggtcaatgcaacaactacaacgacgactacaacaccaactcatgccctacccaagagtacagtatcaatca

SEQ ID NO: 25656 - DNA, 679 bp, Heterodera glycines
cacccgcaactgtccaattttcgtgtcaactttatcgtgcaaaagtcgtttcgtgtcaacattatgtacgcccatcttcggcgctcatgagcctctaattcgtaataaaactaacagtatgcgcaaaacttactgacaacttcccaagatattcgagaattctgtaagagcggaaataaatcttcaacaacacatcttccaccctcagtaaacaaataaaagaaaatattcaatgttgatatgttaagtataaaccatttgaattcgccttcaatttgtccaagaagagtaatcaaaattattatagctagtaaaaatagattgatgagagcaagaacatatctaataggtttaaacataaatgctatatatttcccaaatttgtccatatctggggtcaaacttatactcttgttcgagcacacataagtaaccttatatgtgtcgtttataatactgacagcagtgtgatttaacgtaatgtaatcaccgaatgtagcgtttttatgaagaatatccgatgagttaaagaaggtaacaacatatatagagctatctttatgggaagtttcgtgttgggcgctgaacttttaagggtactttgggtactttgactccgcgagagaggatcaatttttggggtaatgttggatatttggctaagtaaaaaattatgtga

SEQ ID NO: 25657 - DNA, 1674 bp, Heterodera glycines
  misc_feature (27)..(27): n is a, c, g, or t
  misc_feature (1645)..(1645): n is a, c, g, or t
tttttctcaacacaattttttatttancagtatgatcacaatgattaattgaaaaattgttatctgatcgcctttgaatacacctagagtattttgaactcgtcggttttgttttcgtccttctttgtgtgttttagctccgtatcgggctttgactcagcctttcgtttcactgaattttttgtttatttatttgtttgtttgtgattttggtcttgattagaactaaacgtctaaatcagacttttgattgatgaagaacaggcacaacaattttctctttaaacagatgaccggctttttacagttctcagatcagtgatcagcttttgttgttgttgttgttgttgttgttgttgttgttgttgttggtctttgtcgtttgcacttcccgggtcgtggcaccaaaattgatgggatgcactggttgatccaatcaattaatttaatattttatttgggatggggcgacaaaggacacaaagtggaaaatttggtagatttctgatcacaattgatcaatatccgcgatgcttcgaatgcccgagttgtgatgtattcagagcgagttgttgtccggcttgatgagtgaagagaaccgatgggctagcagagtgaattggttgaagcatgcttaaactgaaaacccttcccctttttataccaaaattttttggttatttaatagcattcaaaatttccacattatctttttatggttttttcatttctaaattattttttatcgttttagttttttcttcccttttatttaagaaaggaaaacttttcataaacaattttaattgcttttacgttcaaccgttttattgtggaataaatttatttattatttggggcgttttattagattatttttagtttttattgcgagaagcatttgcttcgtttttatgaattcattttgttttatttatttattttattttacttttattttatattcctttatttatttaatttaattttaaaaataaaaattttatgaaatgtttattttattttggatttatttttattaatattttgtattttcatgtaaaattcttattattttaatttagttttgtttttattaatagttttatattttttcggatttaatccgacacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaatgttttctagtctaatctactcaaaacggttcagaattgaataaaaataacattcacggtgcgaaaaatggggtttgacaagtttattgtggaaaaaaagactttacaaaataatacccctgcgagaagggagtgggaaacatgatttcnaaatttttcatgttttctagtctatctac

SEQ ID NO: 25658 - DNA, 1674 bp, Heterodera glycines
tttttacgccatctttccgatatgaaaatataacactcctccaccccctaatatcttttattggttgaaacttttggctcttatccctgttcctaatgcgtgaaagaccttccgtgtccatccgtcgcttctttgccattacgacacaattttcctccaataatttatccttttctcgcagcaacgattgaatgaattcggcggtggctgctaaaattgcagcctttgacattttgtcgccgtctttccgtggcaacaattgacggagcgcttggaatccagcattgatggactgaaaatggaaattcaaaatggacatctaacaaaaaaacgaaaaaaaacccaactttattatgacataccattctctaaaaacaaaacaatttgtttttaaataatgactgttctttgggtataatattcgattaattaatgaagactgataaaacataaagttagaaaatgcacaaatcacttttatttttgtccaacctgcatgcgccttcgctcgttgcaattggcaatttgacggcgcaatcggcgatcgtccaagtcgttgttgattgagtcggtgaacatttgccggtcatttgtcctttcgtccatggaaaatcggcagtttcgatgactcccattgcttacgccgctttgatcgccgccgctttcgtcagattggtcaaaatccgccgatgaacattttgtgtcaggcgattggctgaaagaaaaaagaaatttctcgcaaatggaaaggcgaaacctttccggcagccaaacgtcgcgacgtgccacggcatcgtcgaccgcctctataagaagctcccccctcttcccaccacatccattcttcaccttctcagcaaccattttctccattaaaactgcggttgttgctgttgtcaaggtggcggtggcacagctgccgtcctccaacatcaaaatgaagtcatccgtcttcaccattcctttttgcaggtttgctgatgcaaatgaaagatcaaaaaagatgggacagcaatggaaagaggggagggagatcaacctaaagaacggaattggagggatggcggaaagtcttttgaataaatgggtttgaagtaagaagaaaggtaaatgatcacacacaatcgacaattaattaaatgggaacgcagtgcacaaaaaatgttgggggagagcaggggaagaagatgagatggcaaaaaagacgaacgatcatttctgactggaccgaccctatcggggacgggctgcagtgcagggaaaggcgaaagggaggggggggggggggctgctgcattgcattttccggatgttagatggagccataccatcgccagcccagcagcagagcacagagaatgagtgaactgagacgagagagaacggagagtggcgaggtgggctagagaagggaaaaagagacggagggacggccaaccgatggtcggccagcgggcgccccccccccccccccggcaatgcctttctctccgtttcactatttgcttttctgcactatttcgctgtttctgctcaaggtccaactatttggtacaacacacagctggtaataggtacactctttaatcgttcattattataatttttgtcggtgcccgcgtgcaccttcctcacaaatgttctttgccctgagtgaccaatgtatgccgcgac

SEQ ID NO: 25659 - DNA, 990 bp, Heterodera glycines
aatgcccccgtccgctgatggcacagggtcgttcgagatgacttgtggacgctgcccaccattacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcaagcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaa

SEQ ID NO: 25660 - DNA, 1701 bp, Heterodera glycines
aatgatcagctaaaatcatcccgattgaaaggaacgtcttctgtcgggggatctctcgggcccaattgcccggtcaacttggtggttaagtgccaagctttgggtgagatcaaggcaagaataatctttgatttaatttttctgggggtactcacctggcagatttgagttgccggccggacgataaaaggcaactgtaaaataagtaaatttactaattacatgtctatttttggccatgaaaacaagtgcaacaagtgaaaaaaaattcaaatttgaaatgcctaccgattgccagacagtttttggcggtgttccaatgccgtgccacacccatttccattgccgaccgccacaccatttgcgtgaagttcttcgtttctatgataattcaaaaaattgttgaataatcgatagtgctcgagactttcgaaatctgtgtcaaaatttgacgcgggaatttaattttcgttaaaaatttttggaaataaataatgattggaaatttcatttacgaaagtgacggcgcctcgtttcgagagtatggttttttggcgccgaattagaaaactatgccggatacaaagagctggacaattcagtacccataaaaaagtttgtcccgaccgtcattgttccatcataaaatttcccagagtgatcttaatgaataatcaacaggtgtcggaaataaccgaaaaccacaacaatctgccttttgagtggcggattggtgttgtacatgaaatgccgtgctaactcagtcccgcccaaaacttattgtattttctgctgtcctcctaccattgttccaccgtggccgcgcaaagtccatcttttgtgcttcggctgcccagtgtgccaccagctcaatgccggtggtcaaatggtcgccgattggcggacaatttgtcgccatgccagcggacggggacgaaatggcgtcagcggctgtgccgttgcatttgctggtcaacaaaaaaatgttctcgccaatgccgggcagctccggataaagcacactgccccggtcggccagcttcagtgcccacgttttggccaatgcggccaattcttgggaccacagcaggggcggtgatgagtaaaccttaaacactttttgatgggatgtcaagaatctcgaaccattttgcgccggtaaactaaatagaaaactggaaccggcggaatttccctctcaaaataaatatttataagtttaatataccagataatgttaaggcccgtagccagaaaaaaattcgggggggggggggtaacctttttttttttcttcattaattttcaaaattttctgcgccggggagaaaaaagtacgaatttttagccgttttcgcaaaaaaatgacaagttttgtcatttaggtcaaattttcaaaaaaatgtgctctttattgaaaattttttatttttcatttcggagagagggatttccttggcaatggcctgatagtttggaatttttcattttaattcgcttttatttataatatggattcatctcctgcttaatctccataagtttaaactcatcctaataaattcacaatatttaatcgttggttaatcttctcacaattcctcatatccccgcttaatccaactgtttaatccttaaaccatgcctaaatctttgactaatccgttcataactcctaagctcggtttttcctctcataat

SEQ ID NO: 25661 - DNA, 1893 bp, Heterodera glycines
cggtgaacgggacttctaccgggagcgggatttttacgggatccacgttcgggactcccgtcccggaaaattttgaactcccgatcccgctcccggaaatttttacccaaaaacgggagtaaaaatgcactggtaagaattgattttttttggtaaaaataatgatttttcattgaaaatctgttaaatatatagccaaaatttcaaaaaactttcccggcggcgcctaccggcaccgccggcctccctcctcctccttggtcaccaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaaataagattttttatttcaaatttctcctttataaatttttctatatatttttaatttaataaattgattgtcctttaaatttgtgcattaaaaatatttttgtgagtttttaattaaattttcaaattactcccgctcccgcccgggactcccgttaaaaatggacgggattttaactggagcgggatttttacgggaatcccgttcgggactcccgtcccggaaaattttgaactcccgatcccgctcccggaaattttttttaccaggactctagtttattttaaattagctaaagcataattccacacaattgccctaatatagcccagtctctattaatcccgcagtctccaattatcccccagtctacgaggtgttttgaaaaataatccctctatcataatcccccagtctctaattatccccccttttctgaggaggttgaaaaataatccggcgctagttaaaaagggctcccggccaatccgacagtggacaatccgacagtggacaatccgacagttggacaatccgacagtgaggacaatccgacagaagtggacaatccgacagtaaatttctatttaaaaaaatattttcaagtcattagaacggattatttcctaaaaatatctcaatcaaatcaatttggttccggcattcgataagcgattgcacgtagataggccaaaaaaggtctgttatgacgatccaagaaaatggcgcgaattgcttggtcctgctgtacgtaaatgtttttccttgccattcccctgccacgcattcgattttgtgggttattgttgtaatcttgcacaatcaaattccagtgtctgtcttcttctttcatttttttgacaaaataacttaatggcggatgaaggaagcggaattggctattgaaagagcgatgccacccctcgatgctgttatttgtcctcattaaattttgctcaactctaaatttttgtttcttaaaattctatttccactttcacctttcactcatattccacatttcctgtgggaaacttgcagacctcccctgtaatccattgttttgaattcgatttcgaatccatgcgtccactcgtccataagcacccaattccggatcatcttcaagcggaattggttgcagttgccaaacacggtcacacccaatccaatatgtcacaaaatattggacaagagctacaaaacaatgctgaggaatatttttaattgcagaaaccttcaacgtcagggtggtgctcaaattggtgaataacggcacaaaaatagttgtataaaggctcccctggtggtgtaaatgccaagcttatgaggcttttcacgagaattttggtgtcatgaccctcttggttagccgccaaaaatagtgtgtttaaatgggccaatgtttggacttttttgtaaatagcctgggcaaaatgaaaaaggcagccactgtgtgccgcctgagggaattcc

SEQ ID NO: 25662 - DNA, 1166 bp, Heterodera glycines
tgaccaacaaatcttcggagaatggttggcccgcattggctccaccccggcgcctacactctctcaaagcagccaaatgagcagcctttaattgacccctcacgcttcagctcatggaagcgtctaatgcgaacgacaatgttcgtattacgattcctcgccttaatgttcaaaaggggcgaagaaacaattgctcactcgagaagcacagaaaggaaattcgccaaatttccaagtctgctgaattcaaggcggaagacttcgcactcgcggagcgagtgctcatccgcctggaccagatggatgatgctgaagaattccaacactttaaaacagtgtttgaagacgacggaattctccgtctgaaaaccagactggagatgagtgagaagccatacagcttctctcatcccattctttttgccaagcattcagctttggcaaagctgatcattttggatcggcaccaaaaaaggcatcaccttggagtggacaccactctgacagaattcctgagcgaattctggatgccaagcgcgcgtttaaatgttaaacgggctcttcgggactgtcttctctgtcgccgaatgaatgcacaacaatttgcattaccaaccatgccacccttgccgggtgagcgagtacgccgacacgcgccatttcagtcaattggaattgactttctcgggccaacgacaatttctttggccggagaaaaaataaaggcatggatcctcatcataacatgcctcgcaacgcgcgctgtctaccttgaggcaacattggacctcacatcggaatcattcatcaatgttctccgtcgattcataagtcgacggggaaaacccgacatcatttggagcgacaacgctacgaccttcaaactcgctcagaaaaccctggagcttctcagtgctccggggccggatcaggaagtacaaaacttcctgacccataaccgaatccagtggcgattcattgcccaagtaagtccttgggcaggaggcttttacgagcgcctcgtgaagctagtcaaggactgcttcaagcgaactttgggtcgaaggattctttccttcgaccaactcaacacagtcgtggccgaagtggaggccaccctcaattacagaccgattaccgcggtctcacacgcagtggatgaccag

SEQ ID NO: 25663 - DNA, 1681 bp, Heterodera glycines
taataattcaatgcgcctaggaatgagcgaagtgtgctcaagtcatgtggtggcggcatttggcgaattgcttctgatcgtccggggtaggggcgaattcctttcgcagagatgacgtggccgagaaatagcaattcgggctggaggaatttgcacttttccaattggattttaaggccaaattcctggattcgtttgaagagtttgtaaagggaacaaatgtgctcttcaagcgttttggaggcgattatgccgtcgtcgaggtaggcaaacgcgcctgggatgcctgtgacgatttggtccatcaaatattggaaaatagacggcgcaggtttgacgccaaatagttggcgctggcattggaagaggccagggtgtttattcacaaaggtgtttggattcctcatccaattccatctgcaaatacgcgtctcggaggtcgagattggagaaatagacggagccgctgatggccgtgtaaatgtcatcaggccggggcaaagggtgtgtattcaacttgagcgaattgttgaggccggtggaaaagtcgatgcaaactcgggtctttccattctttttcattacgaccaaaatcggtgctgcccaatggctgaactcaatcggtttgatggctccaatctgcaaaagccggtccaattcttcgttgacggcattgagggcgccgtgtgggacggtgcgtgctttgcagaatgttgggtgagcatcggacttgagtatcaaatgggcctttgctttggtgcaatggcctaatccggggccaaaaacttcagaaaaatcagtttggagggcctttgtgagcgattccaaatccgaaattttgtgcgttggctgaggaatggccatggcgttgatttctgccggggctggttgagcttttggtcggatgtcggggtacatgatttcatgtgggatgacgtccaaagcctcaatccaaggcagtccgaaaagatcgtaattgatttcggaactgacgtatgccacaagctttttgggtgcttgattgggttggcaaacggtgcagacaaattttccttcgacgttgaatgcaacttcattacagttccgcgtttcaatgtcgggtttgtcgagttttggagaacccagctttttccacgttttgagtgtgagaatggtggcctgagcaccagtgtcgatgttcatcaaaatcttaattccattgatgatgaacgtgagtcgccaccagcggcctgctgcggttccaattcccatgcagtgggatttgacaacgacggtgtggacggatcgctctctgcgatttttcgcttggttggagctgcgtcggcacgcctttgcaatgtgcccttgtccttggcatttgtggcatgtggcgtctttaaatcggcaatccgtgcgccaatgatccgactccacatgagccgcacggatgcgttggtgatccgcggcttgccttgccataattggtgtttggtggacgcgcgggttgttcctttgcattgttggccctcttgggttgttgcgatgttttgcctttcgggtccctccactgttgtggccgggtgtgaatggcatgggttgcaacaggaggatttgccaaagtgagtgcgctgtccttcaccagctgaatggtccttaattcctcttcaatttgcttgagcgtgacttgcgtgccgtttttctg

SEQ ID NO: 25664 - DNA, 1839 bp, Heterodera glycines
  misc_feature (94)..(94): n is a, c, g, or t
  misc_feature (257)..(257): n is a, c, g, or t
cccacgtgcttttttgagaaggggcagagcgttccgatttgtcgctatcgagttgctaaatcggagaagagtgttaccacaaaaattttattgntatttatttatattacatccaaaagactcctcatcagggattttcgaccggaaattgctcctcttccgcgatttgaagcaacgggttttcggaaatgcccgagaaagcattttgatgatgcggcggttctttaaagaaaataagattgcctatttcgataatntaagaagcaatagaacgaatttgtctaaaaaacagggtaataaatgatgttgttgttgttgttgttgtggtggtggttgtctttgtctttgttgttgtggtggtgttgccgcgttcccagtgtcaacaatctcgaaaccttggcgcgcattgttcaacacgattgtactaaatataaattttattcttacggaacttataaaaaaatagtaattaattacatttgccgagctcgagcaatgtccaacatgttatgaaccagcgcccgagcataaattgttgccaggaggtctcccaacaaaaagcccgactaaattaagattaaaaatcaattgtttcttgctcattatttacatgttcccaaacgtcttcatcaaggaggtagacgtttgccccacgcgttgtgatcacatttcttccaacttggttgaaggtaattatataccatttgcgctcttccctacagacggcacattctttgatgtcgtacaaagaagcagacaacacttcgaaatttttttcggccgaatctgccttatcgaattctgtctgctcctcgtgctcatggcagcactaaatataaaataataagaatacaaaaccgcggataagcggtgtgataactccgcctttcggcaatgtaaagcggagaacgcttatcagtggtgaaggaggtgaccgcctgatcggcggtgtggaggggggaccgcttatcagcggtgaaggaggtgaccgtctaatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggaccgcttatcagcggtgaaggaggtgaccgcctgatcggcggtgtggagggggggggggtggccttttatgataatcatgacttacgctccgagagtagtgtgctgttttgcccgtccttgcgcccccgaaaagcttcagacaaagatgaagcgtcgactccttctggatgttgtagtcggccatggtgcgtgcgtcctcgagctgttttcctaaaaacaaggattacgtgaaacatttaatatcttggcatatcaagcagatgtacccgcgaaaatgaggcgctgttggtccggcggaattccctccttgccctggatcttcgctttcacattctcgatggggtcgctcgcctcgacttcaagggtgatggtcttcccggtgagagttttgacgaaaatttggaacattatattttgtttcaaaatgatccggtgtgcaaaacggaataaaattgtaaaaaatagggggaaaaaaaggcaaaaaatttccattgtaagaaaaaatctgaatttttattgaaaaagaccgaaattttaacataggtgaaataaataatattattttattaaaatgatatttttttctggtaaaatgaaaaaaacaaaaaagaa

SEQ ID NO: 25665 - DNA, 1165 bp, Heterodera glycines
  misc_feature (1150)..(1150): n is a, c, g, or t
aagtagacgaaatgtcagtaggcgaaatgtccgattttgggtttgtaggcgaaatgaatgtttttggcttagtaggcgaaatgaatatttttggcttagtaggcgaaatgacaagtgggcgaaatgtcagtagtagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttgtcctttttagtccatatttcgggcttttttagtccatatttaatgtccatatttcgcgttttttagtccatataatttacaaccctagtcagtaggcgagatgtaggtacaccaacttagattttaaaaaaatataaatttatatattttttgaatttaaagtctggaaaaatgagcatcagtaccaaaaaagatttgttaagagtgggtaggtaatttgattttgtaagatataaagggaaaatgggcgcaggttcgactccgttccacgaaagcactatttaatttatttttttgttcataaaaataaaatgactattttgaaaaatttttgaaaatttgcgcaataaaattatacaatgttggtcactcaaaagctcttgatgagtagaaccttttctccgccggtgtcgcattttccagtgtcgtatatagcgcggtgtcgcattttccangtgtcgcatttcagg

SEQ ID NO: 25666 - DNA, 1907 bp, Heterodera glycines
  misc_feature (1760)..(1760): n is a, c, g, or t
  misc_feature (1844)..(1844): n is a, c, g, or t
gaaaaaatcgattttttttgttttcgaggcagtccccccgaaccgatgcgcccagatttatggggagaccgaatccttcgggaatagcttccctatagcctgtactttaattctgcgttggatttttgctccccataattgtttgagtaccccaaacggacactgaaaaaaatcgatttttttgtattcgggcagtccccccgaaccgatgcgcccagatttatggggagaccgaatccttcgggaatagcttccctatagcctgtactttaattctgcgttggcattttgctccccataattgtttgagtaccccaaccggacacttaaaaaaatcgatttttttgttttcggagtaatgtttttactagagttgagcggtaatcggtaattgcaaaaaaccggtaccggtactgaccggtactgcaaaaaccggtaccggtaccaattttttcaaccggtaccggtaccggtaaaaaccggtaattttagaacataaaaatttttggacaaaattttccaaatacaaaatttttattcagttttcgcgcgagtgcctgttttttagcattagaattgttcagaagtatatgtatattcaggttgaccaagccgactagagaggggatattgtactttttggctaattaaataatttatttatttttgtcacataaaattaaatccaccggcgtaaagcacagccatggcattttctccgttcagttcgctcaaatcatctgtataaatgaagctcaacatcattttaaaggctgctgcttcaacgtcggggacctccacgggacaatcagcagaggctaattgaaaattattagtgtaattagcggcggctaattgaaaatttattagagcaattagcggaggactattgaaaattaattagggtaatttgcagagactaaattgtaaatgtcattcagtaatgtttttaccgaattccgctttttcctttttggcatcaaaacggaacatcgcctcaaaaacgtcggaagcgtgtttcaaaatgattctatgggctggcacaagcttaagcggattaaattttaaaaaatacaacaaaaattactattcactaaatttccaatttttaattaataaattaaatttttaatttgaagactcgcctcttttgcgtctccgtcccccaccaaaaaataaacatccgcgtcctctcccgcgctcaacaaatgcttcattcgttcagccaacggtttggacatgctaagcaattccaaaattcgtttaattatctatttaaatgcgagaaaattattggcaatttcaaaattggcaagaaataaaaaccacggcacaaaatcagcaaaactttatgttcagttgggctttgtgattattttgaggaaatttgtagcaaaaaaaaacatgcaaatgtttcgttgtgctccttcccccccccccctgtttttatgcattttttcatcgctttgccatcggtaaaaaaaattgatccgactaaaatgcaaacgtaaacaaaaagaattttggattaccaagtaataaaaaagttatgatttaaaaaagtgaggatggtcactcattggacgcgtaaatattgattggacgcgtaaactggaacagagccgaaaattgaatatattcaaataccattgggtaatgtgaaactataaaaattttgcgccaaaaatagacacttttatcaattttttgactaaaaactgccattttttgttatttattatcaaaatcagacaaattanaaaaaagatgaagatgaaaggcggaattaaggacaaatgctactccagtcagtttgtatcccattttttagtcaacattttttncactctttttgggattaaaaagttatgaaaacaaatatttcgggggtttttgaggtcgctgac

SEQ ID NO: 25667 - DNA, 1127 bp, Heterodera glycines
  misc_feature (1102)..(1102): n is a, c, g, or t
cgcgcctttcagtcagacggcgtccgtttggcccacccccccccctccgggcaaaaatgccaaagggaagtgacaaaatgccataaaatgggggacggacagagaacagcaagaaaacagtgacaaaaaggagggagaaaaagagagcaaaccattggggaaaagagtgaaaagtgccggaaacggaaattgccccggaagacggcaaagagaaaagagagagataaggagggaaagggggggggggggggaaaccgccaacagtcgggcaaatttgggcggtccatccatcaaacgacgaaccgaaaagagagagcatttgggacagagaagtgcagttacccgcactttgtgttttattttccaattttcatgattttaaattttttcttttttgccaagaaattgggtcaaattttggcattttaaaatgtatcttaaatactagttttttttgaaatatacggcatgtcaattggcacctcggactgaccgggattctggttaatgtcgtttttttgaattgatattttttctagctcgggttatctggtgatcagtttccctcaattcctccgatcacatttttatttgtcccgagtgccatcccccggcgtccatccgtcgcccatttcggatgcccgcccctgggcaatgcctttgtcgccgtcttccgtttgctcttctgctgcttctcctttcgctgtttcctccgcctctcattccgcacgtgccaatttcttctacaatgctgtttaggctatcagggaaaaaattaggcacgaatcgacgcattttggtttcgggaaaacgacgggcagcacatgttcagatagcacgacaaatgccgataatagaaactaaaaacaaacaaagggggacagtgattggcctgaaaacggaacccgtcagttgggccccacggcccaactgatatagaccgttagtccaaccattcggatccaaattaggagtgccaaaataaaaaaatggaccgcttagttctcgatagtcagttctcacttcgttaagataatttttcttacaaccctttctatgcccgttgatgagcttttcatcgacttgacgacctttaacccanaaactgtggcaaatttcattataat

SEQ ID NO: 25668 - DNA, 1208 bp, Heterodera glycines
gaaagattaaggtgattaaatcctaattttttggggtcctcaactcccttgtttttgccatagttggtgtgccacaaaaaaaaaaatgcgggattagaggaagaagaaccaaacaaagatgaacgatgaaaaacagtttcaggaggcgcccggtggttggttattggagcacagaaaaaattgtagattcagaattttaatggtaataatagaagaggcacataaatttagaaataagcatattgcagtgattgggaagaaagatttaagtgattaaatactgaatttttggggtcatcaactcctttgtttttgccatagtttgtgtgccacaaataaaaaatgcgggaatagaggaagaagaaccaaacaaagatgaacgatgaaaaacactttcaggaggcgctaggtgattattggagcccagaaaaattgtagattcagaattttaatggtaataatagaagaggcacataaatttagaaataagcatattgcagtgattgggaagaaagatttaagtgattaaatactgaatttttggggtcatcaactcctttgtttttgccatagtttgtgtgccacaaataaaaaatgcgggaatagaggaagaagaaccaaacaaagatgaacgatgaaaaacactttcaggaggcgcccggtggttggttattggagcctagaaaaattgtagattcagaattttaatggtaataatagaagaggcacataaatttagaaataagcatattgcagtgattgggaagaaagatttaagtgattaaatactgaatttttggggtcatcaactcctttgtttttgccatagtttgtgtgccacaaataaaaaatgcgggaatagagaaagaagaaccaaacaaagatgaacgatgaaaaacactttcaggaggcgcccggtggttggttattggagcctagaaaaattgtagattcagaattttaatggtaataatagaagaggcacataaatttagaaataagcatattgcagtgattgggaagaaagatttaagtgattaaatactgaatttttggggtcatcaactcctttgtttttgccatagtttgtgtgccacaaataacaaatgcgggaatagaggaagaaaaccaaacaaagatgaacgatgaaaaacagtttcaggaggcgcccggaggtaggtcattggagcctaaaaacaattgtagat

SEQ ID NO: 25669 - DNA, 1828 bp, Heterodera glycines
ccaactcttccgcttcttcgatttccgtgcccgatctttctagggttgaaggtgctttctcctcactttgtgccattctcttactgagtttgtcccttttgggcttagaaattcccgaggaatgtgccataaaacgcgtcccctcggctctatgttcatttgtcgacccattctgtgaccctaagaaacccgtcaaaacaacattttcggacatttccactgctggtatgtgcaaaagccgtggccaattattcgccaattccccccccccccctcccccccccctctctctccaatcgaattgtaagacttggagtttcgagaagttcggaaaactaaaaatggaaggagtacgagcgaatgaatggccggccatctttgggctatttattccatgcatatttcccattgtcagcatttaatatccgtgacggaatccttcggacgcccacaattgttcgtactttgttcttgtccattctcaaaagtccttaagaagtcagacgctctgtcgtcaatgtttggcgtcgatttgttcttcaaacaggtgggcaaagaaggaaaggcaaatgcgaacattcgtccgaatttgaggagtatttgcaagtgaccggcagcttcaaagagcgaggggcgcgctttgcccttctgcgacttacggaagagcaacggtaaaagtggcagcggaagcaaacaatgccaacggccttttgaatgttggcacaattcgcaaaaaattattccccgcttaaggcgaatcggagtgatcgctgcgtcggctggcaatcacgcactttccctggtagtccgacttggattatgggtttagccactcagtgattttcattcttttacctccgttaggcttaccatggcagcaaattgggcatcccggtgacgtaagcatttgtgttttttgattttgcatttcccttcatttggccttccgttcgttttctcagtgtggtgatgccgaagttcgcccctctaatgaagatttcctgctgtgaatcttacaaggccaaaggtgaatcagcagaaggccactgattcctcctccgattgccccttttagtcattctccatgggcttaacattcaggaggtgtttgtttattcactcaaatgacttcccaatggccaaacaaatattaagtcaaagatattcgcttatgagttggccaaagagaaaaacctcaaatacgtcaacggattcgacaaccccgacgtaattgcaggccaaggaacaattggactggaaatactggaccaagtcggtcgactacgtcctttttgtgtagtttttaattggttggattaaggtgggcgatgtggacgcaattgttgtccccgtggggggcggtggattaatcgccggagtcgcattggccgtcaaaacgttgaaaccggaagtgctaatcattgtaaatgtgtatttattgtgaacaaatgcatttcaatcgtaacttttaggggatgtaagtcgcattagcaaatgttgccaaaagcaaatggaagtttcagtgaatccgaaatgtgtccgtccttcaaaaatgccatggaacactcggatgagccgctttatccggaagcgagcttagccgatggtcggacaaaaacgacattcattttcaaccatttgataaagcaaacattcacaccaattgcttttcaagggctcgcagtcccttcggttgggcacaatgccgtgtttatggccgatgggctaatcgacgaccttgtcactgtgtgcgaagaaagcatagcgttagccttacgcactcaaaaaaagtgcaaatagaattaagactggcaattctgcgcttatt

SEQ ID NO: 25670 - DNA, 753 bp, Heterodera glycines
gttaattaggtcatttggccattggcattggccatgcccttctctcctttccgcccccccccccttcgtcctcacctgtgatgcagatttgttgtgagaattgccaattgctggtccatccgatctctgctgttcggaaattgcaattaccaccatttcattgccccaattggaccataagcagaaaattgggccgatatttctgttccctccgttcaattatctgccatttaggcaatattattatcattttgtcaaaatttaactccatcggttttttcgttcgcttttttaaattttatttttcttatttccattgtttctcttctctttctctttctcttttccattttcttttctctgttcatccgatgagaaaagcttaattaaaattaaaagcccaatttttagcaatttataggcccgggcgcgaagagaaaattggggggggggggaaagggaatttgaagataagaaggagaaaggggggaaatggcaacaaattttcatgaagcagaagagaagcaatttgggggaaataagtaggaagagccgaccatcagaaaaggagggaagagaaagaatggatgggaagtggtaaaaaggagatgaatttaagggggcaaaaaggggagaggggaagggggggggcagttccaagaggggaaacggggggaagggaaggccaaggaataagttgccaagcgcatggagaaatacaggcaagagcaagcggaaagtgtcaattgcaag

SEQ ID NO: 25671 - DNA, 1715 bp, Heterodera glycines
  misc_feature (56)..(56): n is a, c, g, or t
  misc_feature (59)..(59): n is a, c, g, or t
  misc_feature (159)..(159): n is a, c, g, or t
  misc_feature (185)..(185): n is a, c, g, or t
  misc_feature (204)..(204): n is a, c, g, or t
ttgaggacgcagaagaaataagcgacgaaagcataaaatgtataccaaaaaatttntancgatattttttattctttaagtcgacattgggaagccacccaaatcgcctgaaagtgtgtcattacgtcggcaaatttcagggacttctcagtctacgcnaacgtcgcgtattagctttcaattgnccacttacaaagtcttagnccgcactcaaattgattgtgatatttttaattggtggaacgatgttggcgtgcaatttcctgatttatttctcctggcacgaattgcccactcaattccggccacatcagtgtcatccgaacgattattttcaaaagcagggatgatatatggcaacaagttgcgaaatcggtagttgaaaaagtatcaaaaaatttttgttttttgttctttttagtctgagtggtgatatggcagaacaaattttgcttataaaaggaaatttgggtcatttgaatttggcaccatcgacagaacctgatgaagatgatgaagaattgctgaactttgatgagttggaaataattgaggattaaatctgatccaaatatattcttacaaactatttgcttgctttaaaatttaaaacttttatttttggtttgcctttttgaaataacaaaagcaattttatcaatttaaatttgtattaaaaatttgaattttttaaatttttaaaaaattcccggttggtcccgattcccggtttttcttgcggtcccggtcccggtcccgaaaaaaaatcgaggtcccggtcccggcttctcaggtcccggcaagtcccggtcccggttttgcccaaaattcccggtcccgtggcactctaagataaatgtatgaccattattgtatttatccgcttttaatttttaatatatttgggattaaaaaaaaattaaagtaaattgcaataaatgaatttatacatatgtatatttttatgtatgtacatgaagaattcagtaagcatattttaatcaggcaaaatggtcaaatcaacgatcactgatcaatgatggtgtttgataaaaatgtttggtgctctgatcagtttacaacgagcacaggagggattatgattatctgtgattattagagttcgacctggacctggatccaggtctggatttttcctggatccaggtcagggctgggcgaagctcggcttagcactcgaagccgaaggcgaagcccaatttttattcgaagccgaagtccgaagctcgaagcccaaaaaacccgaagttttcgaagccgaagttttttcaaatttttttttaattccaaattttttttcatcacataatttcggttaaatatcaaatttaatcaattgacgcagtttctagtagagaccggaaatttcaaatttgcggatcccgctgcgggactggaactcaaaattttttacgggacggaatcccgcggaattaatcccgcaaatcccgcatttaaaatttgcgggattgcgggattttggaaaattcgaaaaaatttcaattaaattcaaaaaatttccaaaaatcaaaaaatgctgaaaataaatttttaggggctggcgggatgcattaaaaggggctgatgggtcgactaaaatttttcgattggatccgacggtaaaaagttgatcggaaatcaaattattaacggttcagaagtttgactatttttttcttttcaaaaccactttt

SEQ ID NO: 25672 - DNA, 1472 bp, Heterodera glycines
ccggccgaaggccgggaacgccctgaaagtagtggaaggttcttccacctttttgagagcatcggggaaaactatagagaaaaatcagcgcggacgactgagtccggggaccgatttctcacttttctgcagttttagggcctgtaacttttttctaaaccccgaatcaaaaagtgcccgctgtgagggcactcccccaacactgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaatttttggcatgagcgggacatttgagtcccgggtccataactcgttaggggttggttttatcgaaaaaactccttagggcaaaattgtagagttttttaagctctatcgaatggtgtgccatattgccggaaattttcaaaaattttcgagctaggccccctagaaattttcgaaaattttttttgggttgaaaatgggggtcaaaaatatttttctggggtattttgatgtgctgagcacgaatctgatgttaattttcagtttaggaaattttagaattttttaaaaattcaaaaatatttggcaattttttgaccctcaggattttgggctaaaatttgaaaattcataactcaatggaggaacggtcaatttaagtgatttaaagctttaaaaatagcaaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaattcgcaatttttttctctataatataaattttattttacatttttatctcttttttgcgaattgttataaaaataaaagtgatttttggtttcgggaccatagggaggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattcggaggcatcattttgaggggggggggaagttcgaatccgggcggtgtacattatttttctttgtatttttg

SEQ ID NO: 25673 - DNA, 1133 bp, Heterodera glycines
  misc_feature (1030)..(1030): n is a, c, g, or t
  misc_feature (1114)..(1114): n is a, c, g, or t
  misc_feature (1126)..(1126): n is a, c, g, or t
tttatatgtaatattcgaaagtgccaagctaattagcgattcaggcgcacattggggcctgaattaagccattttccctttgatcggtacaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattntctgaggcccgaaggaaaatttgagagggctatttatatgtaatattcgaaagtgccagctaattagcgattcagcgcacatgnggcctgaattangcatttt

SEQ ID NO: 25674 - DNA, 143 bp, Heterodera glycines
tgtcctttaaatttgttaggcggccaaaatcagcattgaagtgcccgctcaaggactcaccattcaacaggcgaccaaagcaggcctgttggacatgatgaaaatgtatggggcgagggtcaaagaaaaaaatgtatgtttat

SEQ ID NO: 25675 - DNA, 1036 bp, Heterodera glycines
acccagcagcatttcaatcactggggactcaacccaccagcatttcaatcactggcactcaacccaccagcattctaatcactggcactcaacccaccagcattccaatcactgggactcaacccaccagcatttcaatcactgggactcaacccaccagcatttcaatcactgggactcaacccaccagcatttcaatcactgggactcaacccaccagcatttcaatcactgggactcaacccaccaacattccaatcaacaggactcaaccctccagcatttcaatcactgggactcaacccaccagcatttcaatcactgggactcaacccaccagcattctaatcactggcactcaacccaccagcatttcaatcactgggactcaacccaccagcatttcaatcactgggactcaacccaccagcatttcaatcactgggactcaacccaccagcatttcaatcactgggactcaacccaccagcatttcaatcactgactcaacccaccaacattccaatcaacgggactcaaccctccagcatttcaatcactgactcaacccaccaacattccaatcaacgggactcaaccctccagcatttcaatcattgggactcaattctcccgaattcaaatcagtgggactcaacccaccaacattccaatcaacaggactcaaccctccagcattcaatcactgggactcaacccaccagcatttcaatcactgggactcaacccaccagcatttcaatcactgggactcaacccaccagcatttcaatcactgactcaacccaccaacattccaatcaacgggactcaaccctccagcatttcaatcattgggactcaattctcccgaattcaaatcagtgggactcaacccaccaacattccaatcaacaggactcaaccctccagcattcaatcactgggacgcaacccaccaacatcccaatcgccgggactcaacctcagcaaatttctttagcatttttaactttttgtgtgcctgggatgttga

SEQ ID NO: 25676 - DNA, 1200 bp, Heterodera glycines
  misc_feature (8)..(8): n is a, c, g, or t
  misc_feature (565)..(565): n is a, c, g, or t
  misc_feature (1175)..(1175): n is a, c, g, or t
cccccccnccccccccgcccttcagagcacgacaaatatttcaacaaaaatttttaaaaattgactagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaggggattcggtctccncataaatctgggcgcatcggttcggggggaatgccccgaaacaaaaaaatcgattttttcaagtgtccgtttgggcgtactcaaacatttatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaatcccacgcagaatanagtacaggctatagtgagctattcc

SEQ ID NO: 25677 - DNA, 338 bp, Heterodera glycines
cgacgccaggggagggaggacgaaagaggcccggaccgaaagcccaacccgacaagagcgcacggcagaatgacgacaggcacccgaggcggaaggaacacccgacgcagccgagaaacagcggacaccgaagagggagaaagcacgaacaacccgcgcggagggcagagagaaaagccagccccgacacccgccaacacccgcagacgcgcccagacgggcgagacggcacccggcaaccgcacacagacaagcagagaccgaccccgggagcggcacgcggcagaggacagcaccggcaacaccgaaacgcgcgagacgaaagggccccgggacac

SEQ ID NO: 25678 - DNA, 1455 bp, Heterodera glycines
  misc_feature (1329)..(1329): n is a, c, g, or t
  misc_feature (1396)..(1396): n is a, c, g, or t
aaaattccgcggttcgttgaaggatactttttttagtgcccccctattttagtcagcgacacaaatttttggaaaaattttcaacgaattaccaataggagggggctgaactcaaaattttatgcacatatctagaagattcatcccaatcctaaccccgactcttcccatttttattgtcagagatatttatttttatgtggctgaaaactttgacccgccgccgcggcaaatgaatgggtttcttttttgccgatgcgtcccgtccggcgccgcccacgccaagtcgcgcgtgtgcaaaaatattttccttgcggcaccctttgaaccgactccgtctccatcgcttttccgcaaatgccccctaaacggtgccaccgctgccggaggggcgggggaaggccaccggcgccgcccaatcaccacaaccttcgcattttcgcctcattatctgtgcgggtgctgccgccactgttcgcttaattacccgcgcaataatataataataccttcgtattttgccttcggcagagcatcggaaaacggaaatcgttttcagaagattatcccagcttaaaaatgtggttttgtagcctgccaattttaggtaatataaatagtcaaaattccgtaagaaactcaattataaagtgggaatttttcaaaaaaaaatgagaaattttttgaaatacattcgaaaattaaatatttattttttatctccacttcagaatattttttcacttaaaacttattaattgtcctaaaaacccataaatattactagaatgacagatctgttaaaaaagttaagaatctcagccaaaaacccaataaggaataaaatctccacaaaattaaccattttggtataaatctgctaaaaaattgagcaaattttccagttgcaactctgtcgcccgccttccccaacagaaaatattgtcaattgttaataaattttcgaaaaaataatatttttcgtatattattaatttcactttttcgtttttggttgtttacattttctttttcgatttacaacatctcttcatcatcaccatcaccagtttttctgatccaattttgtcctccttttccactgaattccccaaacggaaatggttggtgggcctttgcttacaaaaacattggccaactatcgattcgctaattagtttttattagcataaacattttactgatttttaagcttctataaatatatgacctctgtgacctatccattcccgtccgccccataattggtcattaagtttaattgtttactgtacatttttgccgttttttgcattattgcctgactanattccgttaattgcctccacaatttcctccttcatttggatttgttttgtctttatccccatatccngtgctttacttttctcttttaccgtacctgtgaacctcctacccgtagcatttgctatg

SEQ ID NO: 25679 - DNA, 1756 bp, Heterodera glycines
  misc_feature (34)..(34): n is a, c, g, or t
tgtcatggaatgactaaaaaaaagtgcgatcgcncgccaaaaatttttctttgcctttggcactcgcgtcaatgagcaattttattggctgctcttttcactgttaagaccgctgctcatccaagcatctcttctggcgattccgcgcaaattgtcgaggcgatggatgccatcgaatggatacagaaatgggcggaggtggcgcaattcgacgccgaagtaaaagtcgaggaagggcgaccatttgaccagaattattcgcttcgaatggctccgacgggcgaaaaatgtcctggccaatggcatttcgaagtgatcgaaccgagggaaatgatcggagttgaaaatgcgacttttgaagtcagggggggcaaaggggcaaagaaagcatcgccgccctcttccaagaacggcacgaatgttcggctgcgcttccgccctttggctctttccgcggccgctgtccgccacgcgcgccctttggtgcttaaaacggcgttcatttgcatgccgacgggccaaagtcaagtcatcaggcaaaagcaaaacagcacaatggcacaagggtaataaatttgcagacaaaaaattaatggaattggcacaacggcggaaagggaagaggaggaggggacggaaatgggagaaaacgaattggagatggagccgaacagactgttcgtggacatcgacgactcaccccaccaactcgccgtttttacagtaatttgctaagttttccgtccccccccccctcccctcgaagttggacatttccgtccctcctcgccgtgccgacctcctccaacgagtccatctcgagtcggcctccttctctccgtttgccctcctttggctgagtcgtccctctgccaacagttggcgcctttggctttctctccgagctgatcagttggagaaagagaccaattcggatggtgcccttttgatcagaggaggagaaaatgtaagcgaaaaatgaacggaccaaaaataacggataaaaatgaaaggataaaaaatgaaaggataaaaaatgaacggattgttatgagtaatttccgttcataccgtatccctttcagaggtactttccttttcctaccgtatcccctttcagttggcactttctattccctaccatatccaacggagttcttctgtccaatcggatgactttttgttcactttgactgtcaatgacccgtcctttgtgccgtcactgtccaattcttcgttgcggccaacggccgatgtggaactgttcagccagcgaaatggccaacacttcgtccgctccgttcctttcaacggtcttttcttttcccttttaaattcgaattccgaaagaaaaaggaaattcaaaggcaaaagtaggaaaatggaagtgattaaacagaaaaagaggccattttcgaactcttttcttgccattttctgctgttttccctttcgtttccttcccttaaaattgtataattttgcactttttctgatcgatttttctgcttccaattagtttttgaatttccattcgcttacttttgcccttttgtccggttgttcttttgtccaatggtcattccatcgaattcaccccataccttttgttttcgctttttttgacctttgaccttccccccccccatttagtgcccgtccaattcggtcccctccgttcggatatttttcagcttcgaattcgatcacgcgatttacgtcccttttcttcgctcgtcaaggcaattccaaaatg

SEQ ID NO: 25680 - DNA, 1371 bp, Heterodera glycines
aaaacaaatttttttctaaaaaaatttggctcaaagtctctaaaattggttatttttggtgaaatcagttaataaattgcattctaattctctaattttcaaaaatttttcgcggccgcgtttatagacactgccggacccttgttcccgaaaagttttttgtttttaaaatcatttttttgcggcgcgtttctaaagacttttaggagaaaggggtccggcggtgccgataggcgccgccgggaaaaattaatttggatggatctgtaacagattttgtccaaaaaattataaatttttttgattttgagcaaaatttgcaggtttttggggggtcggcgatgccgataggcaacgccgggcgaattttaaattttaagctctttttcaaacagttttcaccaaaaaattatgaatttctctttatattttgtaaaatataaacttttcatgatttagtcaaggaaaattaaattttttttattcaacgaaaggaaaattgggtttaatttgtcaataaattatgccaatgatgaccaatttttatgggtattttttttaaaaaaaaccctattaattacaaaaaaataattaaaaaagaagcagtcaaccaggatcgaactcacgacaaaagttgtgttagtgttaacacactacactaaccactacgccactactgcatatgaattggtaaaagcaaattactttattttataaaaatttggcaaaatggttaaaaaattcaaaatttgtatatattttttgctttttctcccacaaaaatgccattcctaggggtgtatatttaaccccgaccccgagtcggggttaagggtcggggtcggggttcgtcggggttgggagcgtcggggtcggggtcggggttaaccccgaaaaatgggcaaaaaagtcggggttcggggtcggggtcggggttaaccccgaaaaatgggcaaaaaagtcggggttcggggtcggggcggggtcggggacgcaaccctagtcgagacaccaacttttgtgacaattagtcgcacattcagtataaatacacaagagatgattcacttttctgacattcacttgttaaatggaaatattataattacgttgatagaatatatgaatggtgtttttaaaacaaattttgtatgcttcgcattttaagttatttggacccgaaaataaatttgtaagtttgcgattcattctaaatattttaattcttagttaatttttctcgcttatgtaaaatctgcatataagtctgatatcaaatcatatgcaaaattataattgtttttatttatacttcggctaatattggtgctattcaaattaaaataaataaatgcattaatttttggaata

SEQ ID NO: 25681 - DNA, 1275 bp, Heterodera glycines
aagtaattaatttttaaattaataatttcaaattattccttcttcacctctctttttgctcttttgcagctctttttgctgcttctccaaggcaatgattttcatttccagcacagtgaccaaatccgaatgtttgtccactttattttccaacttaatattttaaatttttttctaattttcaatagcgaaaatttcacaaatttgttgaaatgattgactaccactgcaaatttcgcagtagcatcaaattcaatgttttttctaccgtttctgagaccgtcatcaattgcttatgttccatttgacaaacctttcgttgttctgaaaaataattagaattgattaattttataattaatatttttcaaaatctatgaaaatttcgcgtcaaaacaattaaatggataaattctgaaacccattaaatcagaatcaggcaaatcatttcatgatttttttaaatattttttttgctcttcaatttcccttaatgattacaatttgcaattacccttaatttccttctccaattctccgattcttcgcagcattgctttttggttgttttgcatctccttgaaaaggatgtcctaaacattttttcaataatgacaaaatgccaaaaaagttaatttttaaatttgtttacggtctcctgctgttgcttcttcgggcactgtgcaattgcttcacatagtttcatttcaatttcggcgatcttctcacgaaagtgctaaaattggacactcagaaaaataaaatttaaacgaacaaaattactaaaatataaaatcaaatcaaaggctctgttccggtttacgcgtccaataagtgagtatcatcagtttctaggccataactttttttaagtgttcaatccatgcattcttggtatcaatcgttagcttaaagtttacagaagttttcgtatagcaaagttctgggataaaggcaaaagacaaaaaaattttcatgcatatacgcgaaaatgatgaactttgtattttctcattttaatttttcttaatgcaattttttttttaatttttttttcttagtttttttttagaataattggtaatttttttaaatttttttaaactgccattttctcttttcttgtatttgtaaattccccaaactttaagctttcgtgaccaagaatgcatgaattaaccgagtaagaaagaagttatgacctaggaaactgaagatggtcactgattggacgcgtaaactggaacagagcctatatttgcatatgtccacgac

SEQ ID NO: 25682 - DNA, 1230 bp, Heterodera glycines
cccccccccccccccgccgcccaaccgcacatttcgcctccgaatttgcgcataagcagtttaaaaacagtgtaaagttcaagtctcccaacagttctagggcgagcttaaaatgttttgttattaattctataatggacttcaaaaatgtgcaccaattcaattcgcatttaagcacaattttaaggcccattctgcggatttgctcaaacacatcgaacttaatgtgctgaaaaagtttgtcgctaatctgtgccatccatcgaatgttttgttagacgaattgtctcctccaaatgtccaattttcttgcgaaatccccgatgctccgtacggtcccatttttggtgtgttgcgcaatttctttatgacggatgaagacgctaaacgtgcggaggaagagaaggaatggccgaagccgacgcggtgtttctgattctcagatggctttaactgactttcccctttagaaagcaaatgattctgcgcagttttctgccccatcccgggagcgggtcgagagcaatgccccagcgaatgtttgactattttaattaacatttgaaattcctttttctttcaggtacgtgtcttatcgcgagggcgaattcgtcttttgcgggtccttcacatcagacattgcatttatttgatgtatgctgtacatttccatattttattaaaaagtatataaaattatactaataaacgattagggaaccaaaagaatttttaatcaaacatcaattaatggtaaataagctcttgtcccggctatgttcgtctcggattattgtctttgtgtttttactactgaatgtatattaattttgcaacagtaaatgaatgcattatttcttagggattaattccggtggattagtgccgtttttctctcccttctctcaatcgatccctttcctttccttcgttctatgatgacgaatggttcgcctaagcacttggcccaatctttggaaaaggcgggccaaacattaaacccattgggagggcgtggagcgatcgatccctcccctttccaatcgtttgttccaatcgctttctcctctcactcatttgtcaatatccgctgagccgtcctcattccctcccccgattttcatcgtgcggtcatttggtggccattcaccaaattcccaacggccaatgatttagaattgtcaacacttcaacgatcactttaatccggaatggcagcctttcaatccg

SEQ ID NO: 25683 - DNA, 1165 bp, Heterodera glycines
tttgtttgggaaaatttgaaaaattggctatctcttttctgctcaacagtaataggaatccaaccgcattctcagaatattacgccgatactattgtttctggaatttgtttctcggcgcgtttgttttggaaaaattggaaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttggaaaaatttggaaaatggctatctctttttctgctc

SEQ ID NO: 25684 - DNA, 1046 bp, Heterodera glycines
tgtaattgtctattgccatcaccctgagacccaaaattctccccctgtacctatccacataaaaagacccaaaagcgctatttttcggatttgattaattaagcacattgttgatttttttgccaaaaaatgcaacgaacatttttgtactcagacacatccgacattttacgacttcgccacttttacgcctccatcggcaacaacagcagaaacggttgacattcattctgaaattgtccaccaccgaaccaaaccaaaatgagttcactcctcagaatcctttttccttaaatcgaccattgaccatctgttgtccgagttggagcggacgcgcaaacacagctacgaattggccgggcggaacagaaaactcgagcgcgaaaacgagtgagtacagggcacaccacacagacccggcccaatgacatttttggtctaaagtggccaatttttggggttttggctttctaatttcaagaattctcgggaagttcgcgtccaccggtgtgcggttaacagaaaaatgcaaattttaagcagtccggtaaagaaaaggtgtaacttttaaataaacctgtttatggacctggtccgaccacccatcacatggtaattgtgagcatttaaaataaacaaaaactagcgttttgatgaccgaaaacaaggagctgaagaccaaactgagccaacagcacagccaatcgcagcaattctatccgcgaactccgaagaagcgcaagtcgcagtttccgtacgcggacgacaacgatgaggacgcgtactgctcgcggacgggcggcgatgcgtcggcggttcgccgctccgtgtccatgccaccgccggagacaccgctgggcatcatcggcacaaccgctgcgggacagagcgttgttcgtgccggcgttaccaccgccggcgccgcacgccaggcactgaccgtcaacgccagcgggggcattaaacgccgacgggcgttggtgccggcgttggtcaaaaacagtcggatcagccaatcgcatggcgacttgaccgggtggggacca

SEQ ID NO: 25685 - DNA, 1627 bp, Heterodera glycines
  misc_feature (1615)..(1616): n is a, c, g, or t
acattgattattccgtctgatcatttgttgacaatccccaaaaacatcgaattgtcagcctacccctccccccccccctcccaaaacaccgggtggtgaagttgttcttcgctcggtttcgtctgttccggcacaaatgcgtaattgatcgggtcgcataaaaagcggacaaatccctcgaaggacatgatttgtttggcccggtaagttgggtccggctcgtgctcttggattagtttctgcgcgtactgctcgtcaatgtattccatcttaagtttgactttctctttctcgcaaaagtgtccttttacctgctgtgtgcagatgaactgcttaagtgctgctgaggtcaaaaactaacaaaagaaaacgtaaaaaacaaaaacaaatttggccgatttttcactgaattgcgcgaagtgtccatcggagcggaagagcaaacgctggccaatgccaacgcgttgtaaatcttctgctgcttgtcgttcagttggcacatgtgaagggcgctgtttctggtcaaaacgtcgtccgggacgaactcagcgcatgacgggtaactgctcatctgctgatcattcaatttgttaaaactcaacccttttgtcagttcggcaccctttcgcgtcacttacggattcgagacgcgactgaactcgcgggctgcacgacgacttgcagtcggcacttgtggcacgcttcggtggcacgtgcgagttggcactcgaatgggctgcgattacaaagtcctggaacagatccttcaagtctttgcgcattcgggtggagaaaaggcggaacaactccacgaattccttgaaagggattctccaaaattgcgacacgccttctctgataccgtaaaagtgatcggcttttcctggtattctttgccggaagaggtcagaagagcgccggacacaggcccaccaccgctggacgaaattgaacctgagttgggcgtttcgccaccgcgcgaccgccacgactagagcaaatgctaaccccgtgatcaaaccatcctctctccttccctctcctactttgatagatcgtcctccgactgatcggcccccgtatgagctggtggtgggcgtccgggagcggggcgtgtacagtgagtccaagtcgccagcatcggacaaagcggtgcccgtcgcggattcaaatccgctccgaggcttcagcagataaggaagcggactgtgggggccggggggacctaaagcattgcgaaataaagcgaaggcaaacggaggatagagagagagagaaaccgctttgactgctcagctgacttctgatcgacggaggacggacctttgaaaagaaaggagcattttgttcaaaatagccttggtaaaactgagaagcgtgccaattcgcttaccatcggcgactgtggcgctgggcttgtgcttcgggagcagtcgcgactgttgctgcttctcttcactcgccgcgtcactgcgatggtcatttgccgaagtcggctcttcgaccgtccgccgccctccgtcgacggcgacgaatcgattggccgaccattcggagaatacggagccccaacagcacttggattgacgccctaaagttttccgagacctgcagnngccatgcaagc

SEQ ID NO: 25686 - DNA, 1784 bp, Heterodera glycines
caatcggcatgccaacatatccctaaatgcacactataacccaatttcctacaaaatttaaatccaattttaaatatttaattttaaatttaatttggaatgttccctgtgccattctttctaatttttcttatattttgcccatgccgcggcacttttttgttccgttggttgccttcaaattcgttgtcggacccacaaaattggcgtccgcccggttcagtaccatgtgttgacgacaatgttcggcttgattctgacaatgatgcagcggtggaccagaatattgtggtggcatatttggacggatctttgcgggtagcaaaaatgcgggaaatcaaattaaaaatcaaatctaaataagttttttcattcatttaaattagggttaagccccgacccgatgcggggattatgaatgtgtttaagtgagttttgaagaattttttattttagaaaaatttctttttttttttttgattttttatgaaaatttactcaccgccgagggggttgctctccgacatttttaaatttctccaataatccccgataaattttttcaggatttcctccccggttcctgattttctctctctgagtgagggttggcacagctggggtacaaaagagtcttctgaattcttggttttaaatggatgactccctaatatcgctttcttgtttctttatgccaacattgtgacccttccgtcaaatggcattttgtactttggcactgggaacaccgaatttggcacagcgttgcgtgcaccaaattggcaatgtgcgaaacgggatcaaccagagggtaattaactaattatggataattaagataaatgatcaaaatttgacaaaatgtccaaacaaatccacgacaaatgggtcgatgttttttcagatgccaacttcaatgcacattacaatgagccaaatttttttgactttaataattggcaaattttatctgaaacttcggcacaaatgccgtcattgttacgcctggacgcggaacgcgtgccatccgaagaagttttgatggcattttatcaaaatgttttattttttaaaggatcgagtgcttttcccggatgatgccacatctaaagtgttcattgatgtgccggcacgggtcaaatcatttaacatctctgatcaggtgtaaatatgggcatgatggacatgaaaattggtgttggtttttgatcagaagatttttggtaaaaaaactgatcagccacctaccgtaacaacatttgattacttgtaagcttaatccacccctaaaaaagaccgaagaatcagaattatttttgggaggaattttgactattgaaaatgcgtgtgttattttctgatcatgattcgataaacaactctgatcatccacctaccgtaacatgttttggttactgtatccccctttggtattttcattttgcgctaattcaaattgccaattcttccaagtcgctcacttcgctcgatttatggcatctgctccgaacagttgaaggccaatttcgttttcgtatgggcgaacgaattagtatggcagtgaacagtgttggccaattgaaataccgttggcccatcgatacggtatttaccgtaactgacgacgatgaagagcaaattgaacaaccaccgcgaaaacagagagcagaattttttggtcgaccaaatttaaactttgctgagccggtaaaattttaatttatttaattatttttttttttataatttttaaatattttcttattgtatcatttttatataat

SEQ ID NO: 25687 - DNA, 793 bp, Heterodera glycines
attagaactggttaccgtaattatttttcaacctcctcagaaagggggaggggataattagacacggggggataaatggaaaaggggggattatttttcgacagattcatatatcatcattttgaataaaaatgcgtatcattataaaaaaatgagtattaaaacgaaggcgccaaattcaaaaatcttttattcccaactatttttaaaaatattgaaaatccaaacccaaacatattttttccgatattttttgcaaaatttctcaacaaaattcaagaaaatcaaaaaatacacccctaagaatcgacctaaaaatcttcaaaaaaacactcctaagactgacctaaaattaaaaaaaacttaaaaaattggggcaatggtaaagttttgtggtttcttcggaaaattatttaaaaatttaagaaacacattttctaggctggaaaaatgtgctgatcacgaatctgaacttggattttgcaaaataattattttatctatgattttttatcaagtactagatttttccaaaattttaagaaattagccgggcgtaaaaaaacacacaggatgttgtatagctcaaaaagagctttcgaatgagctattgaatgtatggagaagttatgtttttagttatttacgattttttgaaatttaattactattttttttttcatttttggcatttttagtgtattttttaaggttatttaatcaaatattgaatatataaacctttctaagtagggttgagggtttaaaacttatattttggcagtttttattc

SEQ ID NO: 25688 - DNA, 1636 bp, Heterodera glycines
aaaaattccggatccatttatcagatttctggtgttaacttagtcaaaactctgaaattaccttaaattctccgatgtctctgcacaaaaatgtgtcggcgtttccattgaaattggccatcaattaaaaataaacaacttaaaaataataattcgcttcggattgccatggcaacgacggaattttagttgaaaatgtggacaattactataaacaattgatcagagaattgaattgtcttttgcttttttaagttgttaaaatggcatttgtgccgatcaaagacggcgaattcacaagcacaatttacgccatggtcagtgaatgcctttcaaatccaaatcgaaaaattattccgcgctaagatcaaagaaaacaaattcacagaatgcattcgcattttgcagtacgaattgcagcggaacccggaggtcaatttcaaaaaaaagaaaaattaaaataaaatggaaaataaaaataaacaattgaaaataaaaatgaaaaaaatattttagtcacgcgccgcactttcacttttgggctattgttaccatcatatgcaaggtcaaaatgatagggaatgatgtagcgttttttacatagtttaattttttggtcaatgaaaatgctgcgcaacagtataactttttctttttgaatttcgtttacagtattctttttgaaatggcgaatacagtacccttttaaatttttgtttacagtattcctttttcttttaaaagattccattttcactaccgttttcccttttcttacggtatccgctgtctttctgtcccttttttgccccccccccctctgaaacacttttcagattttattatggccgccgagtgttacgagaagctcagcgagttgttcccgcagcacaccgactaccgtctttgccatgcccagtccctttacaatgtttcgttcccttggccatttttcattattcgcttcgcttatttccgctgttttttcccctaatttaggcttatatgtttcccgaggccgtttcttcgcttgcattggtaaacgttgagaaattccattctaaaagcaaatgtttcatttgtaacttttcactttggcacatttatttttcattcgcttcccacagataaatgagcctaaaatggaatgcaaagtggtcaagttggacgcggccatcaaatatcgggaggaggacgtgcaaaatgcgcgcattttggtggaacagttcgacagcgacgacccggacatggaagtgcgtccctccatactgttcacattcccttttcacattttgacattttcatgctgatcactcggttataaacccatcacattttggtcatttccccgtctgatcaattctttttctgattattttttgccaattttctcctcgcttctttggcttaaggtgaatttggcatgtctcgactacaaagagggcaattttgaaggtgcgttgcgccgtttcaccgccgcaatggcacaacaaaaagtggacgaatcgccggcctcgcagaaccaactgacttatgccatcgcactttgccactaccaaatgcacaacttcccacaagcattacaaatggtggggagaaagaaaacggaaagaatcggaaatgcattttaataata

SEQ ID NO: 25689 - DNA, 1277 bp, Heterodera glycines
cagctttggcgaagtttcatttttagggaaatttggacttttcccgccgcatttcattgtttttttaggtttggacggggctaatgcaaagtgttggtgcgtctcggaaagtgttcgaatacatcgacagaaagccggacatcgatacgaatggcacttacgcaccggacaaattggagggacgaatcgaattccaaaatgtgcattttgcgtatccgacacggccggacaatccgatccttcgggtgggaggggcaaacgatggactgggaaataacgcacaataaaagggcctctcattcaccgtggaaccgggcgaagtggtggcattggtcggacccagcggaaggtaattaaaaattggcatgggcgctaatgagaagagatcaatgccaaaccaagtgggaagagttcgtgcattgcccttttggagcacttttacgcgcctgagggaggcaaagttttggtggacggagtgccaatcggcgaattcgaccaccattacatccacaacaaagtgaatggcctgccaattgacaaatgaataattattgtgagtgatcggtgcttctttcccctcccctcagctcgctttggtcggccaagaaccgattctttttgcccgatcggtggcggaaaacatcgcttacggattggagaggtgcacaattgtggacgtggtcgaagcggccaaaatggccaacgcacacacatttattcaacagactcgggaccaatacgagacaaatgtgggcgagaagggcagtcaaatgagcggtcagtgggaggacggatggcagggaaataggggcagacaaacacaagtgatcagacaaatgcaagtgatcagacaaatgcaagtgatcagacaaattgagtgaacaggatttgagcaagtgattagaatcagagtgatcagaaatgatcagacaaaagaaattatagaaatgatttttaggcggccaaaaacagagaattgcgattgctcgtgccttggtgcgtcggcctgcaattttgctgttagatgaagcgacttctgctctcgacacgggtcccttttcgtcttgataaattcttttgcaaaattggatcagaatttatcttaatttttagtgataataattctcggcttttcctcatcccattttcacattgaattactctttttgttaagaatctgaacatcttgttcaagaagccatctataagaatctgaaggggcgttctgtcattttaagagctcatcgtttgtcgacggtggaaaaggtcccttgggg

SEQ ID NO: 25690 - DNA, 2251 bp, Heterodera glycines
gtaaaagaaacaaaaaataataccataattataagttctttgataatttcagtcgtttcaccttgtggttgaacgctgagagtcggttggcgactggtgaattgtgccgttctgaacgtcacttgtcccggagcagtttgactttgacgagaaggaatcgcttgtggagttgccgaaatttgttggatgggagcagccgactgttggtttattacgctgtgagatgttatggcatgttgttgtggttggatttgttcggcatttgaagaagagcgtctgctgttcttcgcatttgacaccgttggcttaataaatttgatttatcacatggaaagccaagaccacttggccaccccatgcgattgtggcacggtcggacccatcgattgattaaacggcgattcggccgtcgcatttggtccactccctcccaacgattggccttgcgcgtcgtgcttttttgcctctttcatcagcaaatacgtgccgaaaatttcgtcgaacctttctctttccaacgactcgtgtatttgctggagagtgtagccaaatgcttgcaacttcaaaatgcgcctttcatcccgaacgtcttttgtcggttcggtgtaaggctttaattcgtcttcctcatagcccatattcatccatttatcccgcattatcatctccaaagttcctctccttatcgggtttaaaacgagaaacttcttcaggagattctcgcagtctaaaattagatataatattcttcaatgaattgcacagtttcggacctgttgacatgtaaaaagggactctgtacttccctctgagaacccgctcacgaagttcctaacaaaaagttcaatttgaatttaattgtgtgtttaagtgtaccttaaggttttggccatcaaacggaagactgccggaaacaagcgtgtaaaggataacaccaagactccaaacatccacttcaggaccgtcatattttttgccttgaaataattcgggcgctgcatagggcggactgccacagaatgtgtcgagtttgttgcccggtgaaaatgtgttgctgaacccaaagtcggcaattttgatgttcatgtcggcatcgagcaacaaattctctgccttaaccacaaaatttgttccaataagaattagtttagaaaccttcaaatctctatgaataacattcttcgagtgaaggtattggacggcagaaacaatttgacggaactttgcccgggcctccttttccttcatccgtccatgggcaaccagataatcaaacaactcaccaccactcgcatattccataaccaggaacagagtcgtctcactctcaattacttggtacagcttgacaatgttggggtgatccaattgtttcatgatccggacttcacgaaaaagctaggaaaaaacttctcattacttcagttattcaccattaaacagacagacaaccttctgcaagctgctctgattcagtgccgttttgtcgatgattttgattgctacttccactccggtcggcacgtgctttgccaatttgacctatcaatcattaattttttagaaacttataaccgcaataacatacctttgcgaagttgccttttccaattgttttcagcagtttgtacttgccaatgtgcaggtcatctccggtacgtgtcctattcggagcacgcgaagaagaagcagtcattccagacgaacggtgatggcctgaagatgtgtggcgatgatgacctccttgatgggtcgcggaggacgattgtggaggttgttgcgagggagggcttaaattgaccttaaatagtgccgttttgtaaattggtgaaaggcaataaaatttttgtgaactgtctgtttgtatcaagttatgctgcattaaattgataaaacgaaagttttgagaatccatggttatgtaaaatgaacagagcctttttggggaggagggaggttgattcggtgttcggaataaaattttggaaaaaaataatgaatgaaaatctgaaaaacaagcttttatatagccagttcacatatacccaacggtgttgtgtcgttacataggtatttaaaaaccatcaaaatacatatctaacaaaatttgcttataaataacttttctccaaagcaaccaaatcattggtgctataagtctttcaacatgcagaattggttagataagtccaagtaaatggaatgccagagaattaagttacggcgattgtaataccagagaattgggtct

SEQ ID NO: 25691 - DNA, 1298 bp, Heterodera glycines
  misc_feature (567)..(567): n is a, c, g, or t
agaagagcctcgcgcttaattgccttaattaatttttcgtgtgagtccttaatcgcttctgtctgcctgtctgtaacaacccattacaaatccgcataattagcattttcgggcttccattttgtggctttacgcattgtttcgggggcacattagcatttcggataaagggggggggggatgagagatgggtgggtgggtgactgacggattggattagtggatcagcagatcagtccggacattggaaagaagaagcacattgccggagggcacgcacccgccaccaccgcaaaatgcttctgctttctctcatcctagactctaattagagattttttaagcatatttatcccctctctccatgcttttttctctctcgctctctctctttctttgtctcccacttttcttctctctctaaccgcccatctcgatctctatctctctcttctctccgtttttctctcaaatactctctctctcgctctctctcttgccctctctctctttcactctccctctcttggtttgtactcttctctgttttctttttcctcttttctntcgctgcaatctctttccccttccctctccctcctctctctccttccttccctttctctgtccacatatacacacacacacacacactttatcacttattgtttcaattactggtcagtgatcataaaagtgccgtcggcaatttttccaccctccgccgcgcgacaattggcgttgtgtttgcacgtcgtttgttgtttcttttcaaattcattcccattcatcaacaaatctgctgatgctgctgctgctgctgcttgctgatgcgatatgctgacgttatgatgaattggaggattttgttgatcggcgggaagccgtctgttggttcgataattgcctccccaggggtccctccaaatccaccaaatccgccccccccccaaaacaaatcacaaatatgatctttgaaaattgtatagtttaagcaaattaagttggaccagcaggaaatgaccagcgttgagacacgaaaaaaccgtggtcgggcgtgattcattgaaattaagaaaatcttgggattcctagatctggatgggggccgaaaatttggacaccggaaaattggaaactggaaatttggacaccatattttattattttatatatgttaatttttctggttcctatgtccaattttcagggattgccaatcgggatcactgatcccgcccaaaccaacccttgttattataaccgtagaatttgtttttccatattaattatgcgta

SEQ ID NO: 25692 - DNA, 1374 bp, Heterodera glycines
ccccctagaaattttgaaaattttttttgggtgaaaaggggggtgaaaaatttttttctgtggtattttgaaatggtgattacgaatatgacctttgtttttcgtttcataatttttagaattttttaaaaattcgaaatttttttcaatttttttgaccctcgggattttggggtaaattttgaaaattcataactcaatggaggaccggtcaatttaagtgaattaaagctttaaaaatagcaaaaaatcgggagaattttatgggatttatttgggatttctatcttctaaagaaaaaaagttattccagaaattctggaaattttagatttttcagaaaaaaattcagaactcccttctgaaaagtcattctgtaaaagtaaaatactacaaaaatccgcaattttttcctctataatataaattttattttacatttttatcaaatttttaaaataagatataaaaataaaagtgattttgggattcgggaccaaaggggggtgaccaggatttttgagtggaaaaatttttctcacaaaaatcttccaaaaatatgtctttaggggttatttgggccgctgatcacgaatacgtgatcagattttacttttgacatcgttcagacctcagaatccctgtgtgattggggattctgaggcatcattttgagggggggggaagttcgaatccgggcggtgtacattatttttctttgtatttttgggttatttttaatgttttaattaatttcaagatttttataaatatttaatttatttatttaatttcattatttattttttgaatttataaaaaatgaatttcatttcaaaataaatattcaattattaattttcaaaattatatttaatgaataaaagagtattttattataaaaaaattttaaattaaaatgcaatcgatttttataaaaacttttcattatttatttaattttaaaccatgttgtacctcttctaatcacttttgtacctcttctaatcacttttgtatcttttatcacttttgtacctctttaaatcacatttgtatctcttctaatcactgttcttcctcttttaatcactgttgtgcctcttctcatcacttttgtacctcttcaatcactgttcttcctcttttaatcactattgtacctcttttaatcacagttgtacctcttctaatcactgttcttgctcttttaatcactattgtacctcttttaatcacagttgtacctcttttaatcactgttgtacctcttctcacactgttgtacctcttctcatcactgttcttcctcttttaatcactgtttacctctactggacactgttgtacctcttctcatcactgtgtacctct

SEQ ID NO: 25693 - DNA, 282 bp, Heterodera glycines
cggtgtcatctatgttactagatcggggatcgatcccctttaagggcgctcgagcaggacctgcagaagctagcttgatggggatcagattgtcgtttcccgccttcagtttaaactatcaagagagggaggagagggttggagaaggaaaggaaaaaaaaaaatgaaggaggagaaaagggtggggggagtatgagtatgatggtcaatatggagaaaaagaaagagtaattaccaattttttttcaattcaaaaatgtagatgtccgcagcgttattata

SEQ ID NO: 25694 - DNA, 1212 bp, Heterodera glycines
ttagtgctgtcgaattctatcaagaattaataatttggcgattttgagctaagttataaataatttttaatcaaatcataatgatggttttttaataacgactccgccccaatttattgaatcacatgaatgaaagaatttgtccaaaaataaccaagtattgtggttattcatacagcaacgtattaaattactaaaatagaaaattaatatccgttcatttgcgtaaaacgcaatttttaaaatggatcctcctacccattaatattttccgacattagttccataaatgtcattttgatgacattagaaagttctcgtattcttcaaatttacataaaaaattaaactacgaaggatggatgtgagaatgactggtggcattgagagggatgtatcggaagcagggatgggctttcgtgtttcgctttcgcatcgctttttcgatactttcctttcgcgattttctcatttttcgttctaattagggctttttgagtcctaagtcccattttcaggccataaaataattgaaattttttttagaaaatttcgaattttacgttccggttattttattggccaaatgtttatcataatgatcaggatagttcttccattacaacacaaaaaaggtttaagcataattctctttttctgtgttccatctctgtccaatcacttcactcaaaaattggtcggcggtggtgcccctcctcctcctcctccgttggcatttccgccgtgcccattgccaaaagtgccaacacttgcggatgggccgaacccggcttgccgtttgccgtaccatccgccgtagggataggcatatgcgtagccaccccacttaacgaaatacaaatttaaaatttaaattattttaaaatttctcacataagcttgggactgttcaatggccaagccaatgcaaaggacaagcagaaaaagggaaaagcttaaaaattaaatttaaaattggaaaatgagtgacaaattacattttgatggttgaagaagaagccatttccaatgataagcagcgaatgattgactttttgcagaatgaatattttatgaatgtgcgaaaacgttttggagccctttaaatactttcactttgtggccatccaaatatttgctttttatgtgccataacgagtggcaaaatcagtcccaaattacgtcctattttcgagatttcttcgacaataa

SEQ ID NO: 25695 - DNA, 1640 bp, Heterodera glycines
agatttttgccgaaaattgtatccatttttcgcaaaaccagactattttagccatctgggggtccatttttcaaaagtatggtaaaatggcttctggtggtgccgtaaggcgccgctggaaaaattattggaaattttacactaatacaaattgttaaatcttcgcattgttttcagttgaaacacataatgcccggcgttgtttcgatggcaaattgcggtccaaacacaaacaattcgcaattctttatttgcactgaaaaggctgaatggctcgacggaaagcatggcaagtgaaacaaatgagtagggatgagaattaaagatacgaaaaatcccaaaaaaaatcggcaaaaatgcgttgctgaaatttcagttgtttttggtcatgtggttgagggaatgaacattgtacgacaagtcgaacagcaggggacaccgtcagggaaaccgaccatgcaggtgagtggcggacttggggattgccaatttaggcaatgtttttcaggtttacatctccgaatgtggccaaataacgagctgaagaatctcatccaacatttattttttctttatttatttttgaataaaatttgttgctgctctattgagcttgtcaagttcatttatgtcctctgtcgatggattgtgggcaattgtgtagattgtggtcccgaagaaaaattaacttataatttttttttttaatttttcctgtggtgaaaaaatgcgctgattacgaaattgattttgtctataacgttccatcaagtatttaagaatattagttgtataaaaaattataagcaaagtgttgtagaactgaaaaagggctctcgaataagctactgaatgcccggagaatctctacacaattgtcagattgtgtgattcgccctgaatttccactcgtacagcaaaaattgggaaaggatggattcttttctggtgccattggttcgattgaattgcttaactccattccataagcgaccagcataaatggagtttcggccaaaaaaatggtaaaattaatcgatgggatggggttgcgcccatacgataaccaaaagggtgcaccccaaaattttgccgcaaaatttaaaaaaaaatttggaaaatttaaagagaaaaaatcgaaatataactatggtttccaattaacacatcattttatttgtgaaatcatctccgcctctttgtccatcgattcgttccttttcatttatgccgcctcttccgtcgcgacttccaccaccggcgccccccaaaaaggccctttcgtgcaatagtcgcgcagcatttccatctgtccgtcgttcagcgcggacggcgcgtcctcaaccaagcgacaaatgagcgcgtatttgagctgcatcgcgtcggcgtcgaaattgacggaacggtcgaccagcaaattgacgaaactgaaaagaaatggagggaaaaggggtttgaaattggcaacagaaacattttgaaaagcgatagttaaaaaatttataattgcgaatagatcaaagccctaactttgtcttaaaaatggccaaaatttggcgaaaatggctaataatttcccgttttgccatcgacaccaaaaatttaggaaattacacaaaacaaaaaatctttttctggtt

SEQ ID NO: 25696 - DNA, 1325 bp, Heterodera glycines
tattagggccgcgacttttagtgacgaaaaatcccgaaatagttaactaaaatagtgtcgaaaaagtgccaaaaaagtgacaaaatagtgaacaaagtccgaaatagtgacgaatagtgacataatttttagccaaaaattgagcaaaaaataatttttattcactgattgcagttgcaaatgagctacatttcctttaaaaaatgctcttagcaaatattgacatttttaaatcaaaaattttgtcaagaaaaaaaatttgggggaagaatttttgaaaaaattttccaattcttagtggtgtattttaaaaaaaatttttggtcgattcttagaggtgtatttttttgaaatttttttagatgaattcttaggggtgtattttttgattttattgcatttttgttaaggaattttccaaaaaatgttgaaatagtgaaaaaatagtgacaaaacgccaaaaaagtgaattttcactattttaagtgacaaaacagcaaaatagtgatttctagtgacgaaaaatgacgtccaaatgaaagaaatgcgtttttgagctcctttcttcaatacaattgagcaaaaaaaaaaaagttttttcactagaaatcggggcacaaattattatatgtctttgaagtaaaattgggtcaaagtgccgttatgtttatgtagtgacgcgattttgatgatgtaaaatacggatttagaacaagctaatttttttagcttaatataattttttcagatgaatttaaaaaaatcgagactctcttcattttaaatttttcctcgtacattttttttttgtaaaaatccgtatgtttataacatttatgttacaagatggaattagctagtgttcttaaaatttttgtgcttctaaattttcgtcaatttttttcgggtccttaggcttggaaaaatgagtttttttttgaggatccatttgtatatttaaattctaattttataatttattttttattttttaaagatttgaattggaccggtgggagacgattcgccaatacaacagctgcggaccaatcaacattgaatatccggaatatttgacaaaaatcccagcatttgcgccaggctaccttgaaggcaatgttgtgcgctttgattgtgcccaatcgcattggatcaaaggcgattcggaatataaatgtgggttttattttgccgaatttatttactagcatattttggttgtgccaggatgaccaagagtaccgtatttatagagaccgaacaaggggttcggtccgcttttcgataagatcgaaaaaatgtcagcaaaaaaaaatttcagaata

SEQ ID NO: 25697 - DNA, 1348 bp, Heterodera glycines
  misc_feature (92)..(92): n is a, c, g, or t
tgccgcgaactgctccaaaacagcgaggcacgcttgaagcggtgcccgtacccgtaccggtgaagctttttcgccggtttcggcacgttgtntaatgctttgatcagttcttcagattgtttctctgtaagcagcacatcgtgttggaaggtgccgtcgtttacgggttgaacctgaggcaaagaaatcgactttcatttggcattttgttcaattcgttttccaatttggcgttttgtctcctttctctctgttctcttcttcttcccttacgtgttcgtcaaggcctgccacttcgagcatcttttgcttcagtttctgcaccatttccactctcttttgtaccatttcgcctgattggtacggtcgcacttttctcatgaagtccatttcgtgctgcgaatggcaattgaccaatgtttgtttattttgaaacctgtaaaaccatcgtccgcttttgaatcattccgaagggctgcgctttgcagtcgactgcaccgctgaggcaatttttctgaaaacaattaccaattaattaatttccctcccccgccccgaattagttttttttaatcccccccccccaatatcactaattactgacgagcatcgcttcccgcgcttcctcggacaaaaaaccgaaagaaaccgatgggtcctccggtttgacatctgaacagcacggtctttgtaaaagtgagcagcactcgcctttgtccatctgtgcggcatgcatgtccacgtttgctgttggcgttgggcggcgttcgtcggttgcatttggggaaatagcgaaagagggccgaaagttatgaaatgacgggggccgtcggttgtagtccccggcggaagagctccacgcgctaaaatcgccgttgggcgatgcggtcgaatgccacggcgtttgttgagtagtgtcagtcctgaaaaagtgccgtgccattggccactgttccgtccccggccccttccgcctgtctcacccctcttccgttccgccattgcattttgaatgctccggatgacgagcacaaaagcgttccatcagtccgcctccttctgcaaaagaactttcgcttcgcttttggcaccgtcttacctccgttttcacttccggggactttctcagtccctccgctgttcccccggcatttcgcactgtccgggtgccgggcacagaacctttgaaggagtcctaaaaagcgttgcgtcacttcctctctctctccgttctgcgcaccttcgcgtctcttctgaccaccgcctccctccgcgctgtccttgaaagtgttttcagttacacaaccagcacttgcccaacttccgttgtccccgtgtcctcctcatt

SEQ ID NO: 25698 - DNA, 1243 bp, Heterodera glycines
agttggacgtgttggcggaatttctgcctcgattttcttctgactagtgtttggcttttttgtcggatttattcttggtgtgtttgttctttttaaaccaatagtttttccatcttctctttttcctctctggctggtatttgaattttcgactttaccaatttcgtaaataaatacattattgtccatttttaatgcctctctaggcactccaaacaccttattttttctttcctggtccctactgattgcgaacgtgtactgtaattcgtgaacggcaatagcttgcccgggccatgtctccgttatgaccggtccgatagaaaaatgagtatcccaaaattcccccgaaggtatacgccacattaaaagttcgactgccccgggaaggcgaacccaattctcttttcccgtaattaattgttcgatttttagggaatctccccacgaagtgaccattttttctccatccaagattcctcccgttccttcttcgataatcgtttgaatgttgttaaagcaatttaccccgtaccatccatattctttccttattggcatgagactttcccatcttgtttcactaattcggttcattggtcgaagattcagagattcttggcagtcttttagcgatgcttctgactcaaacttctttgggggatgatcgagagtaacgacgcgcaagaacgactcagtacacgtgaccgttgttatattccagcatttgaacaccggaaaagaccgtggaattcgaattgggatataaagaattgctttggttttaattggttgttggcctgcgcctgccggaagagaacaattttgttcttctgggaatccaattgttactgatatctccgctgttggttttgttggacaaatttggtattgccccgctgttggaacgatcattaatgaacaaatgattgttactatgcagatatatggaaaattgacttcgtttactcgccagccggtccgatttcctcccgaattatcattcactcttccgcggatttgtccgtttcctcctctgcctcggtttgtattccaactttgattttggaattgttggtaattataattatttgaggggtaaaatcggttgcccaatggggttgaatttgaatttcgattattcataccgcctcgaaagccctgaaatctctggaatcgtcctctgaatcctctcggattaaaaccgcctctcgccatgaaagggtttcctggtggctgattt

SEQ ID NO: 25699 - DNA, 913 bp, Heterodera glycines
  misc_feature (31)..(31): n is a, c, g, or t
cagagcgtgccgtgccagctgatcccattcnacgctctattattctcactcttttgcgcaaattctctacatccatccgccgtaattcccgcttctgattgatctgccaaagccttctctccctgtcagatgttgggggattttcttcctcttcagtttcagacgacgaaattttgaattagagttaaatttaggaaataaaatttatttatttttgtttaaagttggatttgaagaaaaaaaaaattgggtttagagaatatttgccgaataataggttgatgaaataagtagcttcgcagaaatatttgatgattttgttggagagaattaatgtgatgaatgttggtgttgatgagaacatttaatcagcgggcatcggccaatatcttctgatcagtttagccgtcacgagtgttcgtttctttggcctggtttttgattggctgtcggctcttttggcaactgtcactttttccaccgtttttattttgattgtctttcctttttcccctctcacaattctcggacttcgatcccttatttttctccgaactgttacttaatgggcgtccccaatgagtgtcccttttgttttatttagtgtttatcttaagacttatcccaattcctatccccgtgattaattaagttaatgagcgctctaatgatcaccacttctcgggaatggggcccggcccgagggtggggtggggtggtgtcttgggatttgggacaaatgaacaattgttggagttcgggaaatgaaaggaaaatagttgcgtaattgtgcgggggtgtgactggaaaaactgtgaacaaatgctttgaaaagtggaggagggaaaagaagggtgtgagagagaaaggaaagagggagagtgcgagagaaagagaatttaatatttaatta

SEQ ID NO: 25700 - DNA, 1153 bp, Heterodera glycines
  misc_feature (15)..(15): n is a, c, g, or t
  misc_feature (71)..(71): n is a, c, g, or t
  misc_feature (134)..(135): n is a, c, g, or t
  misc_feature (177)..(177): n is a, c, g, or t
  misc_feature (235)..(235): n is a, c, g, or t
ctttttgtatgatanctggtagatattgggagtaaaaaaaagtttttttgtgactatttacaataaaaatntatgcagcatttctaaaaaggatctaaaaataatttctgcgtaaatattttttacatatgtgnntgaagaatttgaggctgcttctgatgcgatgaaaaattttcnagcttttctgaaaaagttttttcccagaatttatacagcttccccgacaaattgttangataattattctagacgatttttttatatctcagtgcttaactattgcctttttgtatgataactggtagatattgggagtgaaaaaaagtttgtttgtgactatttacaataaaaatttatgcagcatttctaaaaagaatgtaaaaataatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcacttacattttgggtttactttattatgctggcccataaaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttcccagaa

SEQ ID NO: 25701 - DNA, 1915 bp, Heterodera glycines
  misc_feature (1873)..(1873): n is a, c, g, or t
aagaacagctcgagctttacaagaagatatggaaagcattatcgacatttctgggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctttacaagaagatatggaaagaaaaaatcgacatttctgggactttttcagaaatcatgtttaattccccaatggggccccattttggttcctcagccacagccccatgcttctcccaattttaagtcttggatttgtcaaataaattaacgatttcgaattaataataaaaaattctattataaattttttttgtagaggggaaaattctgaaccaaactactatttgaaaacccaatcaaaactgggaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagacccatgcttctcccaattgtggcgaaaacaatatttcacatttcacttcataactttttgagttcggcagggatcgagacagggataagaccattggaaagaacagctcgagctttacaagaagctatggaaagaaaaaatcgacatttcagggactttttcagaaatcatgtttaattccccaatggggccccattttgggtcctcatccacagccccatgcttctcccaattttaagtcttggatttgtcaaataaattaacgatttcgaattaataataaaaaattctattataaattttttttgtagaggggaaaattctgaaaccagactactatttgaaaacccaatcaaaactgggaaaaatttgaagtcaaaaattattcgaatttctcaattntgtttccataatttcccgaatgttatgcggtatcataatgcc

SEQ ID NO: 25702 - DNA, 1032 bp, Heterodera glycines
gacaagggtggaggtgaggacattgggcggagtcggggagggcacggacagaacggggaaaaggggaggggaaggggcgggaccagcagcagaagcaacccttagctgttgttgaggcaatgggagggcggcgacggaagcgggggacggcgaggggaaaaaagtgggctaaaggggggggggggattagggaataatcggacggaatggccaaggcaagccctgacaggggacaaacatggccaaaaacagggaagaaaccccaaggagtggcagaatattttgtgggcttttgatactgagtttcccttgcctcgtgccatgacattggccaaggagtgcccgcccctccgatcacttggcccttttgcagtttgatcagcgactgtctgccgcgcttccgctgccttcctctcgtcgtctgcagctgttgcagatcgtcctctctctcgtcctcccctctttctctgtcttcgttgtgccccttttttgttgttgttgcctttgccttctgctgcagtttgcgcttcggtgctttcagtgccggcagataaacaatttcaaaccgatcgtcctccgcttcttctctctccgtgtcttcctccgtccgccgtctcttcgtctctcttcccttttcccttttatctgtttctctctcctcctccgtcccttcgctgtacactttttctcccttttcttcttccctttcttcttccgtctcttcctcctcttctgtttccccttcggcacttctccccttttgcggtgcctttgtcttcgtcgtcctttttctgctgattatgtttggcatcttttggcctgccattgttcgaagttcggaggaatgcaaatgttttcgcctgagcaaattgatcagttaataatgcaccattttccccattaattccgacaatggcaccatcgtcgcgtcccttcccgccgtgccgttaggggtgttctccacgccaaaaagtttggcataatcgcggcggggggttcgtgcgttaatcgccggcggagagccgtacagaa

SEQ ID NO: 25703 - DNA, 1198 bp, Heterodera glycines
  misc_feature (1087)..(1087): n is a, c, g, or t
gactccaaacgcgcgggtccttcagaacaaacaaaaaactcattaaaacatttgaaatataaaaataaaccgccctgccaccctaatattttttttcttggtattggcctaggtcgtaagcggatagcaaaaaaaaaaaatcggaaaggaattccgactctttaaaaatgccaagaattccggcattccggatgggttagaccccagttaattgcccttgtgtttccagcaatgtcttaaaattgcgcccgacaacctcatcgtccgggtccggtgacatgtccggccaccgaacgcacgcgtacaaaatgcggaaacgcagtgcaagggcatgaatctataaaaacagtctgaaacaaaaaatgccaaattgaattgcaccgattttgccccgctcgtcaaatagcgccaacagtagaagaacagcggacgaacacatgggtagggccaaactgtcgggttggacttggccgtctggtggaagaagtgcagggaacattttgggttggtgccgccctggcgagccaaacgcttcagaaacctttaaaaccaaaacacaaaattaaatgatcgtagtagatagaatttaaaaatgatatttttttattaaatttccaaaaaaccgctgggaaaattttttaattttttgagaaaattggtccggttaaattttacaaaattatccaaatttatcaaacaaaaaaaacatttaaatttatgaatttttcctaaaaacttattttcattcatttaccatttgggcagtttcaaaatgctccgtttgcctgccccacttttgaagtcattcggttgggggaagggaaacggctttttctcgccgaacacttcgttcgtcctcagtggttcacttttgacgtacagtggcggctttgccttcacaacaccgcgggttcgatgggcatctgccggatagggttttagaaaaacaaattttttaggcaaatgtaagtttttgccgaaattttttccatgttttcatccaccatttatatttaaattcattattagattggcaaaatatacaaaaatcggcattttttgaatggaaggtcccaaaaattcttanaaccctcacatttcatccaatttcggcgatgcgcttggcagctgggactgtagcagggccatggcaccggcgcggagaaggaggagccaaacgacggcacagcagcggtag

SEQ ID NO: 25704 - DNA, 1895 bp, Heterodera glycines
  misc_feature (92)..(92): n is a, c, g, or t
gtcacgcgagcgagaacgactgaaaaaagagagggctttgatttttaaaaaagtgaccaaaatttagcaccaccgtcgacccgaaaatcccncaaattttgcccaaaaattattggttttttttcacccaatccacccgaagcggattatcaacagcttctaaacatagagagagagctttccaatgatattaaacttataaaattttgtcaacaaagaaaaaagttttgatgttttaaacttggttcacaatcagacgcaattgcctcctaccgcaatcctgagagaaacttggaagccttttcgctttttttggcgctttcctcgtgccacacattttgctttggtattgaattgaacagttttgatcggcagatttgtgagactttgatcaattgattgattgatattgtgaatgatcagttggccaattgattgtttgatctgattgctttgccaccaattgagaagcccgacagcacacaacaataacattgtgagaaattgaggtttgacaatttgaaattttgtgagattctttctatgtattgattgctaagtgtgtttgattgtgagagcaaagttctcccttaaaatgtcaagaaaatcatttgggaaccaaaaatttaaaaaaaaatttgaatcgtaaaaatgaaaaaatttgacaaaccttcgagcgcggccgcgcttcggcgagatttcacggcgtggtgacgggctgaaaatttcaggtgtgaaaaattgtttgactatatccaccgagatggtggtggtacatccttttctgaggatatttttagtttacaattaaagggccgatcataaagcatagggagacccaattatttgctttttttatattgattaaaaacaatgatttgttcaaagcacatgtttctgatcagctacccacgaactattaaaaattgaaaaaaaaatcccacaattctaagacatccattctcggataatccaaatccggttttcaaagctaggtcagaaaaaagatcacccaaaattagacaaaaaaaaaaattaaacacaaattgttgggtaatttagggattttaatatttgtcccccctatttgtcgaaaaaaattcattaaaacaagctaaaaaagtattacccaatttatgagtaattttcagtaaacaatttttttgaacctgtaagtgtgggaccgagaccgcgctgggcttacacttcggttcttctccctctttgttctctttctgctaccgctggacgattcatcggccatcggactttgctcctaaaaaaggctaattttataagactgccccacaccttttttgaaaaaaaaaatttcaaaatatttatgacataaaaacatgttttaggggggtttcgggaccgctgatcacgaatcttacatccattttggtacttatacaggttgaggatcttaataaatgtgcgtgaaatgtacactggtttccttcctcctaatttgttcttccattccatttacaattttttcgagttttatacgatggccaccgaacaaatgcttttgtgcgccattttagaaacaatacattgcgcttcttcagcactcgattttgtactcgaaacttttggtctgtccgctgcggatcggggatgaatggtttgcactggaaattcccactaatggatcaccgtgagactgaactcacagggaatgtgggaaatgcgaaaatttaacaatattttatgtagagtttatatttctacatagttattaaatgcctagcgcttgaagatgatgacatgatgacagagggcacgagtttgacgttggcaatgtatatatggacgctagattagaccgaaattttaaatgtgctcacttagcataatattttaaaaattgaataagtctgaaaatg

SEQ ID NO: 25705 - DNA, 1508 bp, Heterodera glycines
  misc_feature (1484)..(1484): n is a, c, g, or t
aaaaaaaaactttcccggggggaaaaagggggttttgaaaatttttttggaaaaaaaatttttaacaattaatccccggggggagaggggaggggaaaacatgtttaaaaatttttaatttttttttttttaatttcccaaaaagcgtttaaaatttaaaaaaaaatccctttcggggggaaaaaagggggttaaaaaatttttttggaaaaaaaaatttttacaaaaaaatcccccggggaaggggggggggaaaacaatttttaaaattttcaattttttttttttttaattttcaaaacgggttcagaaatcaaaaaaaaaacaattccgcggggaaaaaaaggggtatgaaaaatttttttggaaaaaaaaactttacaaaaaaaaacccctgggggaagggagtgggaaacatgatttcaaaattttcaattttttttagtctaatctactcaaaccggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcaaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaatgttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggnggaaaaaaagactttacaaaataa

SEQ ID NO: 25706 - DNA, 1120 bp, Heterodera glycines
ttgctggggatttattttcccttttttccgatttgtccacacttgtcgagggatttacttttccctattttcaattcgaggccacgtccaattgtttttgtccactgctgattcaccggtgccaggagcgccaagtcgtaaaaaaacagatatgattgttgtcagggggcttttaataatgttgttgcactgcccacggcaaaagacaacagcccaaagcaaacacaaaacaatacagcccaatgccgaagatgattatcgtttaattccaaataaaattagggcgaggacaatcaataggaaaactgcgacagcataaactaacaaccaacacttcacaaaaatcacaacaaaaatgaaacaaattaaataacaaaacgccaaatatattttaaaatcacaatattagcacagtttttttgacaatatcattcataaatctgaaaattcattaaaattaacagacactgtccgcccgaacgtgcgacacttttgacgatgcctacggcggtggctcatcatcaattgacggacattcggtgggagggaaggggaaaatattgccgtaatggcacagggggacagagcggtggtccactaacaaataaggaggaacgcacacaaatttggccgtgttttgttgacttggttagaacaaatggaaaaattgaaagcgcaatttttggaaattggcacggattttattccattaaaaattcccaaattttcccccagcggcgcttctattagcatcaccggaatctgaatttggggtggtcaaaagctgcgaacttttagtgggaacactcactgtccattcaaagggttaaaatttgccattgtaaaaaataacgaacgaccaaaacggcacagatgaccacggtgcactcgtcgtcaaatcggcactttgtcaccgccagcgttccaccggtgtctatcgtggtcaatttgtcctcctgctgcaattgcatggccaacaattgctgtcgctgcaacaacagcaacgagttcaagcagttaccgccccctctggcggagggcggcggcggtgagcaattattggtcaaatgatgcgccggtgccgacagagcgaaacaatctcgtcaacattttgtccatt

SEQ ID NO: 25707 - DNA, 1361 bp, Heterodera glycines
cccgggggaagaacggaccccaacacgccaggagggagcgatggcgagcaaggcaatgaaatttgagcaagaaaccgcacaaaaatagcagtgcgtggaaagtgaagtcacctggtggtggcgggatgtgccgagttaaaaaagggccccgccgtggcgaattgcgcaccgtttgggagaaatgacgacaccggaggacgaggaggagggggagggggaggaggagggccgggggggagcgaagcaccgcgttgttgttgctgattgtggtgggaggcagcaaatgaagccatcaactgggagagagggtccatgggggcacagaggggggaagaggaggcggaagagcacggcacagccgcggggagggtgggcatcatctgatcaacataaagtaaatggaggaggaaaagcaagggaaatggaaatggaagaggaatgaatgatttggtaaaagaatggatgcaaaataccaaacatgggctgaccaatggtccctttttgctgtccaatgattaatcccaatttggatggtcatttggtgttaattaatccgactgcccatcttaacagttccctgccgtcctcaccttctcccgcgtcttcccctgctgttgctgttccgtgttcgtttcccgctccctttttatgtcggcattttccttttgctcttttggtctgccgatcaattgaattgcccttcgaaatgaatttttaaattgttgttggtgcttctgattttgatgctgatcattccccgcgattggagacgaagaaggcgaagaagaggggggagaagaagcgaagggcggaggaggaggggcgaaagggggcgacgcggaggcattggccaaatcggcggcggaaaaggcggaaaaagcgccactcatcggagaatgggaggaaaagcaatctgagaaaaggggggagggagcaatgattggcaaaggaattataagcaaaatgaaaatgaacaaaggaagggaagggaatgaaaatgtaaaagcaatggcacaaacggacggaagggcggagggacgagcgaagagacaagcgacgagcgacgagcgacgagcgatgtgtgtgttgggggtaccgtagggggggggggggacgggcggagccaattgctacacgggagaatttgtaggagagttgtcggacatgggcagcgggtggggggggggagggggagaccacgcccattcccattttcactcgcagcggcgcaccctccgcaccgctcgcttcccctgcccccctttgcccccttttctctgccatttccatcactccaaatacaccaaatgctctttcaaagaaaaggattggttgcatcggtttccatttcttctgaccaa

SEQ ID NO: 25708 - DNA, 1320 bp, Heterodera glycines
  misc_feature (56)..(56): n is a, c, g, or t
  misc_feature (63)..(63): n is a, c, g, or t
  misc_feature (73)..(74): n is a, c, g, or t
  misc_feature (81)..(81): n is a, c, g, or t
  misc_feature (85)..(85): n is a, c, g, or t
  misc_feature (89)..(89): n is a, c, g, or t
  misc_feature (93)..(93): n is a, c, g, or t
  misc_feature (99)..(99): n is a, c, g, or t
  misc_feature (102)..(102): n is a, c, g, or t
  misc_feature (105)..(105): n is a, c, g, or t
  misc_feature (109)..(109): n is a, c, g, or t
  misc_feature (112)..(112): n is a, c, g, or t
  misc_feature (119)..(120): n is a, c, g, or t
  misc_feature (132)..(132): n is a, c, g, or t
  misc_feature (138)..(138): n is a, c, g, or t
  misc_feature (141)..(141): n is a, c, g, or t
  misc_feature (149)..(149): n is a, c, g, or t
  misc_feature (153)..(155): n is a, c, g, or t
  misc_feature (160)..(161): n is a, c, g, or t
  misc_feature (170)..(171): n is a, c, g, or t
  misc_feature (179)..(180): n is a, c, g, or t
  misc_feature (192)..(192): n is a, c, g, or t
  misc_feature (195)..(195): n is a, c, g, or t
  misc_feature (201)..(202): n is a, c, g, or t
  misc_feature (205)..(209): n is a, c, g, or t
  misc_feature (212)..(214): n is a, c, g, or t
  misc_feature (221)..(221): n is a, c, g, or t
  misc_feature (232)..(232): n is a, c, g, or t
  misc_feature (251)..(253): n is a, c, g, or t
  misc_feature (265)..(268): n is a, c, g, or t
  misc_feature (270)..(270): n is a, c, g, or t
  misc_feature (272)..(272): n is a, c, g, or t
  misc_feature (282)..(282): n is a, c, g, or t
  misc_feature (291)..(291): n is a, c, g, or t
  misc_feature (295)..(295): n is a, c, g, or t
  misc_feature (297)..(297): n is a, c, g, or t
  misc_feature (314)..(315): n is a, c, g, or t
  misc_feature (326)..(326): n is a, c, g, or t
  misc_feature (337)..(337): n is a, c, g, or t
  misc_feature (342)..(343): n is a, c, g, or t
  misc_feature (348)..(348): n is a, c, g, or t
  misc_feature (359)..(359): n is a, c, g, or t
  misc_feature (361)..(361): n is a, c, g, or t
  misc_feature (368)..(370): n is a, c, g, or t
  misc_feature (372)..(372): n is a, c, g, or t
  misc_feature (376)..(376): n is a, c, g, or t
  misc_feature (394)..(394): n is a, c, g, or t
  misc_feature (401)..(401): n is a, c, g, or t
  misc_feature (410)..(410): n is a, c, g, or t
  misc_feature (419)..(419): n is a, c, g, or t
  misc_feature (424)..(424): n is a, c, g, or t
  misc_feature (427)..(427): n is a, c, g, or t
  misc_feature (432)..(434): n is a, c, g, or t
  misc_feature (442)..(442): n is a, c, g, or t
  misc_feature (444)..(445): n is a, c, g, or t
  misc_feature (462)..(463): n is a, c, g, or t
  misc_feature (471)..(473): n is a, c, g, or t
  misc_feature (475)..(475): n is a, c, g, or t
  misc_feature (481)..(482): n is a, c, g, or t
  misc_feature (485)..(485): n is a, c, g, or t
  misc_feature (487)..(489): n is a, c, g, or t
  misc_feature (493)..(495): n is a, c, g, or t
  misc_feature (497)..(498): n is a, c, g, or t
  misc_feature (500)..(500): n is a, c, g, or t
  misc_feature (505)..(505): n is a, c, g, or t
  misc_feature (508)..(508): n is a, c, g, or t
  misc_feature (511)..(512): n is a, c, g, or t
  misc_feature (517)..(517): n is a, c, g, or t
  misc_feature (521)..(521): n is a, c, g, or t
  misc_feature (528)..(531): n is a, c, g, or t
  misc_feature (538)..(539): n is a, c, g, or t
  misc_feature (542)..(543): n is a, c, g, or t
  misc_feature (548)..(550): n is a, c, g, or t
  misc_feature (552)..(552): n is a, c, g, or t
  misc_feature (555)..(555): n is a, c, g, or t
  misc_feature (559)..(559): n is a, c, g, or t
  misc_feature (563)..(563): n is a, c, g, or t
  misc_feature (566)..(567): n is a, c, g, or t
  misc_feature (574)..(574): n is a, c, g, or t
  misc_feature (577)..(578): n is a, c, g, or t
  misc_feature (584)..(586): n is a, c, g, or t
  misc_feature (593)..(595): n is a, c, g, or t
  misc_feature (598)..(599): n is a, c, g, or t
  misc_feature (604)..(605): n is a, c, g, or t
  misc_feature (607)..(608): n is a, c, g, or t
  misc_feature (610)..(610): n is a, c, g, or t
  misc_feature (616)..(617): n is a, c, g, or t
  misc_feature (620)..(622): n is a, c, g, or t
  misc_feature (625)..(626): n is a, c, g, or t
cctcatgcggcgcctgttcaatcaagattaaaattccataaaagcaaaaacagcanaaaaaanaaagaaaacnnaccccgnagancaanccancggccnganaanggcngancagcccnnggaccacaaagncgaccncgncgacaagnaagnnnaaccnngcacggagnngggcacgnncggccgggcgcngcngggaanncannnnnggnnngcagggnaaaggaagggngaaaaaaaagagggcgacnnncccaggggcccnnnngnangaggcgggancggggccancggngnagcgaagggccgacgcnncggggaccgangcgaacggggncaaanncaaanaacaaggggangngcggcannncngcancggcacaaaagagaaacnaaggcancaggccgcnaccggcgangcgcnggncacannnacgggggnanncaaacaccaaaggggannaaagaaannnanaaggannaanannnaaannnannangaaanganganncaaanacangaacaannnngcaaaanngannaaagnnngngancaanccanccnnccggcanggnngaacannngcccacnnncannagcanngnngnaggggnngcnnnggnnattcccagcatcaaagttcgtgcgattgtttccgaaattgccaaaagttgaaccattattattagtgaagctgcttctaaagcgattgttgttgttgtaatcgttgtttttatttgcacaattcatgtcgctcagcctcatattaagcgaaacacacccactgcacatgtgaaattgcacttttacccctcctaagggatcgaactcgaaagcataattaccgccgctgttgttgttttttgtcgaattgaacaatgtttgtgagcagcaatgacaaagattgaaagttagaatatacttttttcgtaaaagtttccataactgagcattagtattgttgacgctgttattgttgctggtgttgttgttgttgttgttagattcttccggcatgttttgctgaacattattaaaagtattcatttttattttgcaaaaaaaatcttgtgattaaaatgaagttttgcgtcatatttcgggcttttatatagcgaaaaggtacagtgctgcgcgctacgtgaaagacgaagttacggtgctcctacgcacatataaaagcgcttgaatgtgcacaaaatctcacttgcgcgcaatgcatttgcttatagcattctcgcgcattttgggctgttcccctgacgaagtgggcgcgcgaatttgtgctagtgttgcggatcgagaaaaatttgttgaa

SEQ ID NO: 25709 - DNA, 2360 bp, Heterodera glycines
ccgataaatttgtgtctcttccttaagtcgacagctgttcctccccctttaaagccgcactctttccccccccccccccccgccatttgtcccttatttattccctttttgtgactattccctttacacatttcttccgtcttctcagtgtttctttttgccgatcatttccctttcgcttctctcagttggccctctcttcttgcctttgtcctcctccgatgtccaattgtcctttgcctttttgcctcgcgctctcttcgccctcctctcttttccttttcatcgccacccttctcccaattgctcaattcgcccatcttttggtgggggccgccgcatcgcaattttcttccccccaaaaatccaacaacattttgccacgtgcccgtggtccggcagtagtgtcaattccggtcggttgcccgccttttcggtccctctgacgagtgcttttcgtcctcacaacagataaagcatggccgtgccggtccccatggactgcttcagacttcggacccgttgctgctgtggtgccatgcggtggacgtccgacttttgtccggcagagaatcgcgcagagagtcagcgttggacacagaagaaatttgtaattaaagccgtaaaaataaatgggcgccattcgattgcatagattttacacacgacggagaaaattacccagccaatctcagcaccgacggcactttcaacggaacattgagcttttaccaagtgaaacattcgctgcatttgctttttcgtgattggaagtgtctcttaaggtttacgcgtcttacgccggcaattggacgtgtcacattcgaaccaaacactttggcaatgtaagcggagagatcgccgttaaccgtaggttttagaataatttgatggccaaattaaatgaacgaataaaacaaacaaattatttgcctttcaaatttcgaaaacattatgtttacatctaacaaagctaattcttacaaaaatacatctattcacagtccgtcctgtcgtactcagcaatgcttcgctgcgcatcgatgagaaggacgcctttcattttgaagcggacggaatcaatgccaaacgcggggaggacacgcggttggagtgcccagtgtacggacatccgaagccggaagtgacgtggcgaaggggcgcccttgaggcacggatggacaaacgtgggggcggggcagggaaggtcccggtatttcggtcgtcttggtcggagactagccaccatctttaatagttttaacaaaaaaaaattttgaacctcgtttttgacaacttttttttcaatatgacagaaaacatgtttccggagattttcagtggctgaatattttttttttggtagagattttcatttgtttattttgggataaaaccgagattaaaaggcagggaaatcgattgccagggtgttttttagtgttttaacgccttttttttcttcagttgcgttccaatgatcgaattgaattgctaaatgatggagccctattaatacgcaacgtcacttttgaagatggggacatttactcatgcagaccaaagaactcagcgaacagaagggacaaaaagagcggcataataattgaaaggaaattgcgcgtgaaaagtgagacgcgaggatgggcggacgaaggaaacgattcgttttggccaattcatttttacctcgttaaattttttgggtcgaaaagaacgaaaaacgaagtcgaaacgatattttaacttagtaatgctttttatttcgattttagtgattttgaatagtttgagacacaaattagtaaaattcgaaattagtttaaaaaacccgaatatattttttcgaaacatcatatttaccaaaataactagaaaaattattctaaccaacttaaaagcagtcctgagtttaggctaaaaagtattggccaaaaatgactcatccttttgccgggtgggcggggagataaaagaacaatgttaataatgggatggttagcagaatgtaatgcgttaattttctgagcttttctaaaggcgaattggcttggctgcttccgctctgcattattttttcgataattgtgcttctcttcatcatcattttgctgtgcgaaatcataaaacgaaatgagaacaaaagactcactacagatgaagacgatgagtaaatgatgcgtcttttgttaatattttcaagacgtaaagaaacgatatttatcaggaaattgtcagaattcgttagaaccattggaaaatattattcgtaggtcccagactcaaaatcacataaacatacagacctcgaggagtcgattgatgtataatttatatacatttacaatccccgcagcttt

SEQ ID NO: 25710 - DNA, 1934 bp, Heterodera glycines
tgttacaaaggaccggaaaaaaattttttaaaatttcaattttttttttttttgccccattttcccctccccgaaaatcttttccgcgccgtgggtgtttttttttttcagatatatctgttgccgaccaaaatccgcgatccccacccatttcgctaaaattctggtattttaatctccccaccttccaacaaaaatcgcatttttcatttacaccatgtacccctgcttcttatgtttatgtacctacatgtttcccctatgcgcatctgtcggcccttcaaattcgatccattgttcgccccagccgggggccggcttttcctctcttctctcggcttttcctctcttctctcggctttcctctcctcccttcgatccccccttctcggcttttccctctattttctcggcttttcctcccctcatttgggtccctcttttcccggcttttcctcctttcccatggattccccccttctcggcttttcctttttttgaccacacctttgccttttatcccgggaccattttcggcttttgctacccccttccttttggcatcccttttcaaatttgtaaggtccatctctaggcatttctcatccttccatttggccatttcttggcttatcggcttctcctccccttggaccacctctcggattcccgccccccgcgcccccccccaccgattcttgcgcattgttcggcgcggaagttgttgacggagaatgaatgaattatgatgagtgctttactacgtatgcttcatcttcgttcttctcccggttctgtccccgcttattttcttgctttttctcctattattattattacaatgcttttcatcataaattttgccctttgtgccctgccagggggtgggcgggggagagatttcggtgccgtcaattcagttgccgcatattttattgaatcgcatgccatagtactggatctgacatatcttacatcctcgtaaaaatccaaattcagtgccatctcttgtgatctctctctcttccgcatcccatccctccactaattaagataatccatatcgcttggcattttttccgccatcatttgggtattcgagactctcggggtcgatttgcatgttcattttcaccgttttgcgaaagcatcacggatcgcgcacaaaaagcgcatggatttgatggaacccataaaataatatttggcgtatggcactgcgcgagtattcgatcgaccgttggaattgggcggggaagggcacacaatcacccaaacgccgcccccacccgcgccagcggggatttaacaaataatttgggacgcgcgggaggggccaatgcggcgcgggcgagaaaattggtcgcaaattgcgcgacagcagcccaaaattgggtgatgatgctgatgcagattgtttgagtgtatattttacgattgattttttaactctttgatcactttttttaaactttttatgggcattgattttgcgccttatttggcttaatgtgatcaccgctgatcagagcttatgcgagagtctctcggttctggacttggggctcagttttgagggatagcgcctctcgagtttaaaaaatcattggatttattgagaaaaattcttggttttaattgaaattttacaaaaaaaaaaaaagatacgaactgctatgcccactgttttctgcccatcccctgctttggctgctatgcttttccaaaaagcccataaaaatcgtcgagtatatgcatttttacctgtcattttccccgtccgttcaccgacggggtcattccgagccgagggatgagctttgggtaatgtacaagataaaacagaaacttttacaccatatgttgacccccccccccccccccccctcttttaacgacttttgtgccatcagccaaaagcgggacgacgacaa

SEQ ID NO: 25711 - DNA, 1533 bp, Heterodera glycines
ccaaaagttgggatccccaaatggtcgggatccccaacagttgggtccccaaatgtcgggatccccaaaagtcgggtccccaaatgtccggatccccaaaagtcgggtccccaaatgtccggatccccaaaagtcgagtccccaaatgtagggatccccaaaagtcgggtccccaaatgttgggatccccaaaagtcgggtccccaaatgtcgggatccccaaaagtcggatccccaaatgtcgggatccccaaaagtcgggtccccaaatgtctggatccccaaaagtcgggtcccaaaatgtcgggtccacaagttgcaaatccccaaaagtcgggtagccccgttctcttccgttgctaatgtttgtcctaatatatatttttatttatgcgaccgaatagtagaatgagcgaggaataaaaagtttttcattgaattaatttgaacattttttaaaatggtcatttcaatatacatttattttaatattgtttttattccattttttggtttttatttttaatttgttcgttaaattaaactctttccaaagtttctttaatttttcttttttcaaatctcatttttaattaaatactcgtaacatcaaaagaattattatatttttggcgatttttaagaatggagagtccataatcgaaatttaatttttcgctttaaaataggcttctgctgtggattttcaatggtcatgttcacgaatttgaatcttttttaataaaaaggcaaaaaaaaagtcaaaacaattatttttttttaaattattttctaaaaataccttaatatttattgaaaaaattaattaattatatttatcttttattaaaatttatttgttgtttctgtagtttgttataaataagaattaaagttctaacaatttaatatataaaattcattatataattatgctataagattcaatggatattcttaattttttttgaattaaaaattttatatttgatacaaataatgttctttttattttggttattagtgcattaagcctggatatacaaattaatttttatatttttacttgtatctctcgaggaggtgataaataagagcgttgattgcttctttgatgatttaataatttttgtatattctttgttaatatccctgaattttgggcttgttttatatactcataagattggttttatttttatttattaaattcacataatatttaagatttttgaataattttttacacttttttaatttatgttaattaagacactctcaatttctttccggttgtagagtacattgtaaatattcaaatttacgccattttcggattactgtaatttcactctatttcctttctctcgctttcataaatacccatctcttttcactcatcgacagacttcactttttcattattcaagtcccttctcatcgcttgtcttctactccgactttttatttatttacttctgacaaataaacttatttaattttaagttgtgtccacttttggacataacattt

SEQ ID NO: 25712 - DNA, 1774 bp, Heterodera glycines
tgaggcatccaataccggccaaggaactcagtcagagtccagtcaacccgggcgtgtctgaggtcggcgtggatctcttggacatttagccgagtcagagatgagtggcggtcgagaaggacgggagaggcgagagtgggcggaccgttcgcgtgcaggagccgggtttgaggcacaaaaggccatcctcattgaaaacagtggggtgtttgtcgtagccgtcgagcgagcttcgttggtcttgtcggatgaggaaagtcctggctgctctgaacgaatcgcccgtcggagggccactccgtgggattgatgaaatgccgcttctgagccattttggtcgacgacgcccgatgaattggaggacgagaatggtcgttccgagaagggtcagcatagtgctgaaacgagccggatcaatgaggggagggggcagcggactttgtttggccatgagggtcttggtctccgattcttcaaacgggagatcggcggaaggggagtcggctggcgttgcgaacgttaactcgtcgggccattccgtttccggactcgtgagccactcaggccctttccaccaaatgtggcgagttcggagctccgcaggtgtgcagcctctcgtggctacgtcggcgggattttggtaggttctgacgaaatggaagatggtgggcggcccttgtcggatctcgacgagccttcgttgttcgaactgggctttgggttcgtcggacttcacccatgagagggcaatttgggagtcggaccataagtgccgctcgtcgatcggacgtcggagctctttctcggcgaagcgcatggcgcgaattccgacgagaatggcgaggagttcgagtcgagggatggtgaagcgctggttcgcggttcgtggccggaggcggtttttggcgaagattaggttcgcttcagagccatcggcagtctcgcttcgaatgtagacggcggcggcgaatgtgtgttccgacgcgtcgcaaaacacgtggagttgcaggcggctttgcttgccgagaatggaatgccgcgggaccacaatcgtttggttttgccatagggacagggtttgattccaagtttccgcctcggtctcggggaggggtgtctcccaagcggttccctctccccacaggcgttggaagagccgtttggcgggcagaagacatggcccgactagtccaagagggtcgaacgtgctggcgatgatgcgcaagactgaacgccgtgtagcagtgatgtctgtgtcttttgggagactgaaggtgatgcagtcgctgggggtgtcccaggtcagtcccagaactttggccggcgttttgtcgagtcggtcgtcctcggggatttgtcccatgacgtttggggagtggctgaggaactcccggaggttcatgtcggcgtctttgaggatttgtttggcgatggacgacttgtcgatggcctcctcttccgtctcacactcgatgaggagattgtcgacgtacatattcgcggccaacgcttgggcgaatgggtgctcgtgcttgtcgaagtgttggaggagaacagcggcaaggataaagggggagcacgtcgcgccgaacactagccgtttgtagcgatagatcaagagattgtagcctgagacaggacgggcagggtttttcagccaaagcattttgcaaaagcgcctgtcctcgggttcgacttcgatggcatgaaaggcgccctgaacgtcggccaacacaggaattgtcgctgaacggaagcggaggagaatcccgca

SEQ ID NO: 25713 - DNA, 1346 bp, Heterodera glycines
  misc_feature (1234)..(1234): n is a, c, g, or t
  misc_feature (1253)..(1254): n is a, c, g, or t
tatgaccagggctaatatttatagttttttcactattttttcctgagctctccgtggcctaaaacgtacgaaaaacatggtttttcggttgttgttaagctacttttcgaattattagcaactttctagttttttatttttagtaactaaaaaactataaaatttttgaaaaaaactatttcaactaaaacatttctcaaaaattcatctccgaatttatttgatgagattttttgattttaaaaattgtttatctcaatactgatttggtttaatttcgttacttttttggataaaatttgtcattttacatccctaaatttgaaagtttttagcaactatttaccaatttttagcaactattttggaggttttttgaaactcgaaacttattattttggcagtttttagcaactaaaacataagccctaatttgaccactcccatgggcagaaccttcaaattttctgcatcaaagcgtcgcgcaaaaaaacaatctttgaacgccgaccgaacattgcctaaccgccggtgggcagcggaacgattagcgaaaagaacagagttaagacgaacatcggaacaacgcaatttgatacctgaaaaaggaagcaaatggtaaggaagcgcaaatgtttggaacgacgggcgatgaattcatcgtttaattaattaccctttgtgtacgcatcaatcgcccaccgataatttctcttctcaaagtgccgatttccctcctctttgtacgcattggcacattccgttgggttgtcctcgtcgtatttcattgcctgaaattgctttcctttttcactcaaataatatattttcttctcccccccccaattgttccctttttgttcacttgtattgcttgcatttccattgaatattgtccgtcttcggtcggtttcaaatcgcgtgcaaatgcaggatgtttatcaatttcttcgcaccatttttcaaagtcaaattttttttcactgttggaggaacgaacattctaaaggaaagaaaaaagggtggataaataacacaaattcttggccaaatccgtttttttttttttgcttcaaagacggattaaaagtgggcaatgatccaaaaaattaacaccacgcccacctttcccctctccgccaatgcctccataaatcggtcaatgtcctcctcccatttttgtgcttcagcagcaaatcccttttgcttttcatattttgttcgctccatactntaaaaattaaatgaatggnngaaagtaaatttaaattgaaaaacggaaagccaaaactatctaaataaataccttacaaaatgatcgaattaaaagcacagtaaatttcccc

SEQ ID NO: 25714 - DNA, 1937 bp, Heterodera glycines
  misc_feature (905)..(905): n is a, c, g, or t
  misc_feature (1840)..(1840): n is a, c, g, or t
  misc_feature (1855)..(1855): n is a, c, g, or t
  misc_feature (1889)..(1889): n is a, c, g, or t
tttctgattttcagaaagcgaaagcctgaaaaataaataaataaataatcaaaaaactattaacaccttggtgccaaagacaaagcgctccccggattgtttcgccacgttggaattgaacaggctcacagttttcttcatcatcgcttgcagcgacgtccaaatcattcctggttgaagtgtcttccatttgttgttctgcgtctgtcctctcagcattcagtacgctgtcttcatttgttggaattcggggtcttttaattggcttttgcagactctcaagtatttcgcgtacagttggcatttcttgctagaatctgaattacgctagaaacgaaattataaaaaagtgaaaggaattcttaagctttgattgatccaaaaatggttggaatgaacaaatatgaaaaaagttagtacataagaaatgatgatggtcactgattggacgtgtaaactggaatagggctgtatttgatattaacacagcatttttttactctttttactttttttctttaatttttttatgaatgtttttggttgagttggcgaaatgaatgtttttggctgagttggcgaaatgtcagttggcgagatgtcagttggcgagatgtcaagttggcgagatgtcagttggcgagatgtcaagttggcgaaatgtcggtacaccctttgaaccgactcaataaaagtttatttgtagaacaaataaattaagcaatttaaataaatatgcgaagtcggaagcggaataaataaattggaggagaacaaatatttaggcgaagtgaaataagtgcataaaaagcaactgaatgaatgaggggaaaggacatgcaatggacataataaatcaatagggtcgtacataaaaaaaggaagacacactaattagagagtgnggaaaatggagaggaaaagaaatagacacatgcaaagggagaatgaatgcatttgtgtacttttatctctcggggttgaccacccaaacacctccccttttaaatgatctcaacggggcgagtatcgcacaggtggttgctgtcggcgatcagggtagcggcgttgtggcgtcggctatcaagcttggggcgtcggcgattggacagcttgaatgacgtcctgctgctcttctctgatcggcggttcctccacttgatcttcagcattgatcgggtcaggcctattctctaggacctgcccattttgatgtccatttgccattggtgccatttgaattggcaaattgaattcctcattcaaaatgcttaatgggtcctcgacaatttgagtcgtctttcggagcctcagctgattcgcatgatagcgaccgctggatccatcctcaaatatcacattgtaaatgacacctgaacatccgcagatcgttccggccttccaaaaattaaaaaattaacataaataaatgcaaatattaataaagaaatgcattataaaattcaaatttaaatctgagtaactaaatataaaataaaataataccaaaatttcaatttttgtaaattcattaaaaccaatttaaattataatacttttatgaaaataataatagtaacaaaaaataatcttgaacaatttataaatttaattttttttttaacatataataaaataactcagtttttattagcatttattatggctaaatgccttattatgggagtcagaaaatgctacaccaaacttagaattttaataaattttttgttttttgttttattgtttttttttcttagtaataatttgaaaagcaagaatcggctgtgcatggataataaatttttttatttttttattaaaagatttaatacattanattcgctatatttanaatattttaggttgatactttaatatttgtttanattaattagtaaaattattctgtttcatacatatgtatcgtcattctt

SEQ ID NO: 25715 - DNA, 1072 bp, Heterodera glycines
ctaaaaataacatcccgaggtcattacaataaatttaacaagaaaattttttatattttaattatacaataaagaatttttttgtaattttcaactaattcattaattttgatatttatgtattttgtttttttaatattatttatttgcttattttataatatactttacgcaataatcaatctcattccattaaaatatttttgttaattttcaaagcgaattttgttcttctttttttgattgttataaatattaatttatttgatagacttgcatatgaatttaatattggctctgctttatctttcgttcgtggtcagtccaaacgttttacggatgaaatttgaagcgccttcttgtcaagatattttatgcgtaaattttttaaatacaaaattaactagcaatatttacttataatttgtatttttcacattaattttattctttttagctattttgatataatatatgatagattgcattttattttacataaaaaggtcgacttttattgaaaattaaatttatttctatttataattagttattcactatatgtattaaaattgaatttttaacaagtaattttctataaagaatcttgagatgatgcacagtgtcatatttgtaatgtaatgaaacaaatatttttttttaccaattaattataaaaaatgaatcaaaaacaaaaatagtataaagaggaatgaaaatataataatctactcaaatatttcaaataaacaattaatatttgtttagaaaatattattatataaaaagaataatattgaaccaaaaattgctaaattgtataaaattaaatgaaagagatacggtgattaaatattaatatgaaaatttccagaaagatatacaattcatgaataagtaatgccatctaaatctattccagtgaatgaacttgcgagcggaaactccgattaaatatttgaatgaataaaagatactctttgccattaagttggcgttttccaggaaagaaagaatatatatggcacctgatgaaaaaaaagcaaaaaattaaaaaaaagataattttaca

SEQ ID NO: 25716 - DNA, 1149 bp, Heterodera glycines
  misc_feature (136)..(136): n is a, c, g, or t
agggaaacgcatcgagcaaaagttcatcgcaaacacggctaaagcaataaaaaaactctgatcaattaagcatttaaccacggatcaaattaattagtaaggtcaaattaatcaagcatttattcattgtttagcnccactttacatttttttatgaaaattttgctgtacacgggggtgatcagacatttgtgatagaaatagcaaaaataaaaaaatttctgaataatttgaaaatatttattcgagatgtggaattaatttgccaaatcacttccaaatacatggaaaattgaatcctttttatatacaataatttttttatacgcatgattaaaccgtggaattgttgcacaaaatagcgatggaaatcacaattctagataaataaataaaaaatgcccataatttaccaaaaaaatatattaaaaaagacacctttaataattgcctttaactaaaaaaaatcggctaaaaacctaatttttaagatcaattaaaatcctaaacataaaaaactatcactcgaaaccaaaaaaatattcaaatcaaaacaaaaaaaccactgatcaaacttattgtttattaaattaattttgaaatatttgaaacaaattcattaatgttctaaattagagtttttttacagtttttcattttttgcgtgccccgaacggcttctgacaaaatcggacattttcggtctgatatttcggggccggaaattgcgactaaaatttgggtaaattttggtaccagaaaaagcggatacatattaaaacttaatcatttttgcattctgatttcaggtatttcgcatttctgagaatttttaagaaattttagaaatccctaaaaatacgaaatttcgcaattttttcgtacatattttcattttttgaatatattttaaggttttgagtatttatagaaacttcttatgaaaaattgaaaaagaatttttttttaccgaaattttgtacactttttgtaatatttcttacatattcgggattttttttaatgtaaatattgtgatttttcttgtaaatctaaaacaaagaattttttatcaatgagtttgtttaaggctcccagaaaaataaatggcttaggaagtaagcagcccaaattattggagtttgtcaa

SEQ ID NO: 25717 - DNA, 2042 bp, Heterodera glycines
aattaatttttaatttcataataatttaaaaaaaaatctttttacatgtcttatgtatgatgcgagaggggataggtaaactcttaactctccctctgagggcattcctaccaatattaaatatttaatttttttaccgaaaaaaacacataataattgtaaatgatcagtggtgttttctgcttgaacattgatggttctcattcggcgcttttcttttgctttggcggcgccaataagtctgtcgctcgggcgtttttcagtgtgcactctgcacacagttcaaagttgacggcgaagcgtccatcctcagtgcgcaccacttttgcgttgttgttgtaaagtctgttccaatcatctgaattttttaaaatttctaaaataaaaaataaaagttttataacctgagcagaggtagaagcccaacatgtactttcccttggcgagtttccatagttcgcggtcctcgacttttcgcactttcgtcggcggctgctccccattatttcccgcactgttcaattggtgcttacgattggggagttttagggaattcggtgtgaggacagcggctttaacattggtctcatttttggcgtcggagctctttgacggagaaaatttgatcggggaggacattttgttggaaattttttgatttttttttgcaaatgaatcgtgattttggacggatgaactttacgaactgaaaagtgggcggagcctaaccgattgaaaagtataaaattggcccgtttttgaaattccaccccatttggcgaatcattctaaatttttctcgacaaaaaaaatggccatcaacatgaacgacaagaagggattgctcaagcagatcctcggcgagtccgacatcaccgtaacaacgtctggcctgacgatcagcgggccgcgtctcaccaacccgcgttttctgccgtttgaggagagcggtcgctgccgttcatgcaaggctaccgaggtggaggttgatacgatggtcaccaaagagggcataaccctttggtgtacgcgaattgacaaagtgcagttcgtgccgtttgatgtggtctacgatttgccgggccactgctttttccgagtgaagaacaaggcgagagtcttcaacattccgtacggcgacctgctctcggacaacacctgtgatcaaattcaactcacgcttcacgctgatgaagaacggcgtctcaagcgaaaggcgaaagctgcgctcgacttggttgagcagggtcttatggaagatgcaatgcatgatggggccagctggaagaaagccaagactgccatcggggtgctgaacaaactcctgctcgtaggaacacatggcgacaacgaaaacaaagaaacggctgctttgacaacgtcggaaaaccagcaacaagaacagcaaccgccgacggcacctccgtcggaagaaatcgtttccatcgtgccatctgatgttggatctcaagtactgtccagcggtgaagtgaagctggaagaggagaagcaggcagatctcggtgacattgataagacacttgacgaattttttgcaagtctcaaggcgtcaaccaccagcatgtaaagatatttaaatcccaaaattttttaaagttccctcacatggtaaaaatgttgaattcacaagcattttcaaataaagatatttgttttaaacttccatgcggtataatcatttctggtccctcttcatccggtaaaacccagtttcttctgaaattcattgctgagtccagcgagttaattacaccgaacccagtctccattctttattgctttggggaaatgaactcagcggtaccggtgctacaaaaagcgggagttgatgtttatgcgggagtcccatcggaagagctgctcaaacgcatgccaaagccccttttgttgatacaggatgacctcatgttgtccattgatgagcgatacctgtcggagttgttcgccaaaaagtcccaccatcaccaatttgcggtagtgtaatgacacaaaatttgttcgagaaaaggatcaaagttgcg

SEQ ID NO: 25718 - DNA, 1307 bp, Heterodera glycines
ccgattcctttatctccggcatgagcctttttagtgatggttcatatccttctcttgaaacaaattgtctttaaaaaaaacacgttttctgaatattaacaacaaaaatttttagacactttctaaagaggaaggaaaaaaatttttcatttgcctaatatttatttatactgttgaactgttggaaatgcagctgatgccgtcggaaaagctccgattttttggggaagtttttttctttcagattcaccactgattgttgaggcaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcactaaaaaaaacacgttttctgaatattaacaacaaaaatttttagacagtttctaaagaggaaggaaaaaaatttttcatttgcctaatatttatttatactgttgaactgttggaaatgcagctgatgccgtcggaaaagctccgattttttggggaagtttttttctttcagtttcaccactgattgttgaggcaattttttcgccaatttcttttgtctacaaacattatttattgcgtttcatcctgtagtagtaaaaaattttcagtaaaaaaaacttgttatctgaatat

SEQ ID NO: 25719 - DNA, 1762 bp, Heterodera glycines
cccccccccgagaatgaaaatttttaaaaattttccagcaaataatggaaatttttttcgaattcccccccccccaaacgaaaatttaaaaagtttaataggcaaatttcgtaacaagtagcactcaaatttccaaaaattttttccggcggcgcctatcggcaccgccggacctacattttccactatttttacaagttttttgccttaaaacggccaaaatttggtcatttttagtgaaaaagtgcagtagttacccagcagtggaaaaaaagttattggttaaatagcaaaaaaaaaaaaggtcttcaggtcgggtcccccccccccgaaaaatgtttctagatacgcccctgtgtatacggtagccccggttttcgggaatttctaatctaaaattcaatacaggtgacgataggagccggcagaaaaattttagacacttttggtcatttttccaagagttgaacaaaaccaataaatttggatggggatgggttgtctcttttcagaaatggatcaaacacaattatctgtcggcttgtcagcacctgtttcaaaacgaattcgcaaacactttaataaataaacaaaacaaaataatttacgacgataaattttaaaccgcaacaataataattaaaaagacgagaccacaacaatcaattgagaagaagtcagcatcaaaagaaattcaaaacaattccagagaagacaagacaaaaaaaaccaaaaacagaaccgaacagtaaagtaaaaagactcactaatattttaaggtccataaaaaaaagaaaacaaaacgccaataaataattataattcaaaacataaaagaagtcaaaaggtcaattaagtaccacagcggccggaggaaaaattaagaattttgatcatatttttagcatattttcattaaaaaaattcataattttgtgaattttcggaaaagaattggttattttctagtttttatgaaatatttaacaaaaaaccacaaaaaatctcaaaatttctcaaaaaaccacaaaaagcctcaaagcctcattttaaaaatttagcctcattgacctatcaaaaaaccacaaaatgaggctaaagcctcagatctggcagccttgtacatagtaaatacctttaaaattttagtaatgaatgtcaattttaagaaacaaattaacaaaaattatttgttttttttcattttcatttttaattccttttttcacctgtaactgtgtatttcaatatcatgcaaatagcaaaacgtgctctgactttggcattgattggttccggcagagcaaatgttagattatcagatgtgagattacaataagcagttaatttggctatatgcttgtccgcttcaatactcgagaacagcaaagtctcactgatgaggatgaagacgaggccgaagatggagaggagcattttcaataaagagaattgggcaaattgctagaaatgatttttgtgaatttgattttttgtgataattccctcgttattcaattggcatttataatgatggcaccgcacgcacacctaagcatttgccaacaatgcaatacgtacgcttaagattttatgaataatgcacattttaagctatgcccactttataagttatgaatataaattttctatgcatctggcttctcatatgtatatattttataaatatatgttagacacgtttttaggcacatgctatattgtatgcataggtatatttatttaatatgcacattttatg

SEQ ID NO: 25720 - DNA, 1099 bp, Heterodera glycines
tagagatcggaattttgagaaaatacggataagggtaagggttacgggcttgacatctatacgggttacgggcttacgggctaaaaacccgtaaaacccttaacccgtaaaaacccgtattcagaaattatacgggttacggttacgggcccgtaaaaacccgtatacgggtccggcccgtatccgatctctaatattaaattcagcaccagtcatacaaaagcatttttgatgaagaagaataaagaaaaatttaatcacaagagagtgttatgggaagagatataagacagagagtgaatagagaacatatggaggaatctgcgtctattaccaaaagaatcagtgaagaatggaagtgaattctcttcccattgcactctctatataattattttctctactctccttcataaaaatggtttgtatgacagagagtgaaacaacatatattacctatttttgcgttatctctctcactaaaattattaccccttgaaatatttaaacaattatcgcaattttaaaattacgttgatatttacgttgatggcataacattgtttggtttaaataaatttcgcaaaaaaccaataaaaagggttgatttgccattctctacttggaattttaaattatatgctattatgtgatttaaaatatgctttggcgttttgttgtttgatttttagtaatttttgtttgtgatttttgtaagttgttagttcagtaaattttatgcggtcgtcaacttcatattgataaaaaagaaatattttttgaaaaattaaaaaaaaaaactaacttcttagaggggaactgatgtaactaaaaaatacggaacagagccaagagcacaacgaactggataacgcatttgtgaaaagaaatgaaacaaaatttaccgagaccgaaaacccgagaccataaaacacccgagacttttctctagtcgagattcgagaccgagagcccgagcatcacgcgcgcaagtgcaacgccgcaaatgcgcatcaccggcagaaacattcataaatatgccagagcttaaaaatggttgcgttcttttgttaatttagtgcttgaaagaaaaatttca

SEQ ID NO: 25721 - DNA, 1250 bp, Heterodera glycines
  misc_feature (1226)..(1226): n is a, c, g, or t
  misc_feature (1229)..(1229): n is a, c, g, or t
cttcccccaaaagcatttaaatgacatcaatttaatagagttattttatttttttaaagtttacaaaaattaattttaaaaaaggatatacccataaaaacgaaaaaaatgaactaaaaagccaaaaatattcatgaaaaaaccgaaattaagcaccataaaggcaaataatatgcataaaatgcaaaaaaaaatcaaaaaaatttgccaagaattgcattatacataaatcacttgacatccttatttactaatttttaaaataattattttaaaattataacggattaagcaaaatttatttgttaaaatgtttggaatcagaaacagcaaacagcggaaattaatcgatgatcaattggaggatgacgacttcgagatggagcagttcagcccggattggcaactgatcggtaattgtaaattaagattcattttaatcaatgtctaggccctcaaattgcctttttcccaatataataccttaatttatgtaaatctggcatttttatgtaaacttagtaaattttgtctaaaaaacaaaaaaaaaatatttaaaattatttaaattttttgggtatatttgggatttacatatttgccatttttaatatttagcgatttttcttctaaccccaactttgaaaattaatagatatataaaaatggtaaaagtgataaataacaactataattttcaaaactgggtttagatgaaattagcattaaactgttggagaatggcatcggcacttttgagacattgcaacgcgcgttaccatccgttgtattggcacaaattgaacgaattgtaagcgttttcttttaattcataacttaattaataattaattattcgtttgatttgtgagctaacagattaaaaattgctactttttggtcaaattttgaaaattttagtggtggggaacggcggtgccggttggtgccgccgggaaatttttttttttgtaatttttatttaatttgttaattaattagcaaatgaggatttatatttttttaaatttttgccatggaaccaaattcgcttagctttaattaatccctccaatatttgccattgtttgaggtgcccgacggtgaggaaaatttgccagaaattggcggtgcctgtagcgctgcccatctgctcaaactgttccggctggcacagctacaaattgactacctgctgaagagccaacaaagtctcgtggagcggntgnccctttggagaaccgtgccag

SEQ ID NO: 25722 - DNA, 1613 bp, Heterodera glycines
gtggcgcaattagaagttaagccacctgtgaattagttggtggcagaccacgaagtgatgaacaactgaaaagtccaagattgtcgtcaagaatttcgaacgcatcaattgattccatgttgatgccgccaccttcctcattggctccccgaagaagctcacgcgttcgacgcacaccgtcaacattaagccaccaaagtttatcgatgacgccatcgcacactcctataacaaaacagtgtgcaaacatcgcacaaacaacacattttggatacggatgtgcagcaaggtcttcaaatcatctgccaaaatattacaacactcttgtaaaggtattaagaatttttatataacatatttataatttatattaataaaaggatgcgtcaaaatgtccgcattgctctgccttgctcttcgagagagaagcaacaggccatgctgctttttcaaaatgttgtgcaaaaggccgtgtctctttgaccgcaaaatacgacggattacaagaaaggcccgaatacctcgaagccttatttacaaacaaagacttggaaactttgaggcgacaaaaacatctgatggaaaatgtcctgcgctacaataacagtctgtcgtttggccatgtcattacgcagagaagcgaagaggaatacttcagaattgtcaagtgtaacaacttgatccagtatgtcctttgggactacaatcccccggacgggtctctgccgcttcttcatggacaattatttaccatcccgagtgaacaagctgaaacccgcttaggagaaattgctgagcaatttgaattaaatgtaaaagtttaaagcaattttaaatataatcttacaattaaaggctgttttgttgtgcaagctgcatgagatgcttcgcaaattacacccgatggcaacactctacgaaactgcagcagagactttcaatcaacttccgccagatgagcgagtcaacttgcgaatgctcgtagttgggacaaaccgacaaggcaaagagcgaacactcactgaagatgaagcccagcccattgatgttcaacttccgcacgacagtttgctgaagcagatccatccgggtcggctccaagttgaaacagaagcaggcagtcaccttgtggcccaggttgatttaatgtatgtaaattattttaataaataatttatagttatttatggactctggtcagaatgtcatgccgaacatgaactatgaagttgttctacttgggcgtaaaggcacgggagcgcaacatctgaaatggtggcgcagggaaattgatcctgcaacatttccgctgatttttccaaaaggacaatttggatttggtaaaattttattaaaaactttaaaaaatttattacatttaagaggatggactgccgctcaagctcaaggagggagaaaaattcgacacaaagcaaaacgccataacaaacaagaacaacgacaagccattggacgacaacgaagaccttggcgaagcggaagaatttttgggagcgtttgaacgcgtcttcaggccacgtgatcgcgtctcacgcaaccagttcttccgctatatggcccaaattcgagaaaacactggcgcgtacatcact

SEQ ID NO: 25723 - DNA, 1957 bp, Heterodera glycines
  misc_feature (147)..(147): n is a, c, g, or t
  misc_feature (152)..(152): n is a, c, g, or t
tttcaattcgtccatttgttcttcaattttttttgtcagcgtcacttattttctttaatttatgcttttgtctgttttatattagcttcccttaatctttctgctccaaatgtcaaaggttctcgtttccggcattcagcccaccgngcaanttgcacatcggaaattacctggtccgattttggattactttttaattttcatttatttttcctcttaagggcttcatcaaatccttcgttgcctttcaaaatgtgagagaatggattctccgttcctttctcacagaccccgtcttgctttaggatatgtccatcgcccgtagggttttgttggtcgctgaccttcactccatttcgacaggccgacatgaacctgcccaagtgactgctgacaatgggggggggggggggtcaattgctcattcccattggtgcgctgtttcagttgcggttgaactgctttcgcacattggccacactgctcgcttgtggggtaagcattggtcgttgagtcaaccaatccctcagaatgttcaatttgtcggtcgattcggagaagactttgctggtccaacagagtcgtttgcccgaacacaccgaactgatgtggattttgggttcaactacgactgtggttggtctgtcgatgctcaccagtcaaatgatcaaatgttaagacgagtttgacctcgatgtcgcaatttaaagacaaattcagagggtaaatccgttgttttgtggtcaattggtgatgagtcattcatccgccgctttttgaaggtttccccaaggcgctgcccccctcggcttgcttgcctatccgttgttacaagcggccgacgttttgacgtacagagccacccatgtgccggtgggcgaagatcaaacgcagcacatggagcttgttggtgcccacgccaaacggcagattcctttggtccctttaattcagactcgtcatttggctaacaaattcaattcgcgattccattgcaatttctttcccgtgccggaaaaagttctatttgcgaggcgattcgccatatatttcattttcaggtttcaagtgtttgcactcgtcttcgaagtttgaggaatccgacagtcaaaatgagcaaatcggacacagatgcgaagtcgcggattgaattgacggacaatgcggagacgacggccatcaaaataagaaaggcagtcacagactcaacttctaacattacgttcgacccggtgcagaggcccggggtcagcaacctcgtgagtggattggcataatgaataatcattgctgcatgccccctttttgacgtttttttttgcttaatgcaggtcacgttgttcagtttgttctctgacctgactgttgatcaggtggtcacccaaagcattggaattgacactttgggcttcaaagggaaattagccgaactgatcaagtcagttcagtccattgcatttgttgtttcattgctttgattgatacattcagtgatcgattgggaccgatcagggaacgttttacaaattttttggacaacgaaaaagaattgaaacggatactggaagatggggaagagaaaggccgcccaattgccattgagacactgaaagaagtgaagagaattgttgggatgagatgacagacaaatagagggatgggtggagtgatcagttaccgatcaatcgatgactgctcacatcggatcgattgaactttcttttgtcgaatatacaaattttatctgttaaaattgctacggacagcgaaagtgaatgaaattgcaaatattaggatattacgaagataagtttaacaatttaaatattaattaattaaatgaatttgaaaaaatgggaagccaaaaaattaaaaaagaaagttttttgaggtatgtataggaaattgttatgtgtgagaaaaagcgtgtgatgagaagtgagatggaacggaagag

SEQ ID NO: 25724 - DNA, 2278 bp, Heterodera glycines
acttttattttaatgttgtcgttgtgtgcaaatttattaaaacaaagaaataaaacaaataattttttttaatttttaataaaaaaataaatattttaaaatattattttatatctaataaaatatatttcctttctatttttcaattttcgctttttaataaatgtagtgataaatgtattttaaatgttgccagcttgtgtcggtagaatgaaaaattttgacattggaaatgtcagaaactattataaaccgattttatttagtcgttataacattgttatgatcttacttttgtttattggtaaattacgatttgcagtatatattcgtgttcagcaacttaaattaggtcataaaaatgagtcggggtcgttttggcgcccacgttttggcgccgacgttttggcgcccacgttttggcgccaaggtcgttttggcgccgacgttttggcgcccacgttttggcgccagggtcaggtttttaaattttgtctatgtttgaataaatgaaaatatgtattcgtcagttttctgagtagctaatcacgaatattgtattcattttgacaattgcgaagcccggacttgatttaaatgaaatacaatttttgaacatattagatcaggccttctatctgttttgttttatcaaatgttttaatatggtgggtccaaatctgagaaaatgatttaccagattctgatttagggatagtgactattatttattaaatataccgttaaggttatgtttataatcactaactcttttgaaatttcaaccgaaaaaatttaagagtttaaaaatattcaaaatgttttgacattttttgaagcatagcgaagagaaaaatttgaaaaagttcttgctaagtcaatttttcatgttgaccaacaaaatgttcacagcaagttgatcatatcactccttcatgttgatctacactagagatcaacattttgaaaaaaccgtagttctacctgtttcaaaaaatggcctgtacctattttttcctgtacataagtacaggaaaataaatgtacaggaaaaatccaggttgccgaaaaatggcctgtgcctgtacctggatccaggaaaaatacagggctggatccaggtacatgttgatctctaatctacacccataaaacacagtcaaaattgggaagtttcaaaaaaaattctagggggttgtgaattttttgaaaatttgaaaaacccattggaaggtaaaagtttttcactttttttgtaaaatttttgatcaaatttttaccttttttaatttttggcttcgcgccaaaacgtgggcgccaaaacgaccctggcgccaaaacgtgggcgccaaaacgtgggcgccaaatcgtcggaaaaaaccattgcttggaaaaaggtttcctcatcgtgatctttctaaaatccagtatgcaatttggttggcaaaaaccttcaaaaataattttcatttgttaatttttgatttggacaaaaaaaatacattaatgtcgtggagcggactcgaacctccactgagcaattatgaagaatgggggatttctattttgtttattttcgagttaaaaccagtttttgggcgatttctggttgccgccaaatgtaaaagtattgaaatcctagcgatcaacagttcctaattgtgatacagaaaaaattgacagacgaaacaaatgagctgtttctaaatttaaaaaatgcgtagcattatgttttttaatagattctttacacagcgtccgggaaatgagctcctgtaccagaaaagatttgcatgtgtggctcagtggtttttgtaagatagtaaagggacaaagggtggtggttcgagtccgatgtgcaacatgaatattttcatttatttttgtccaaaataataaaaaatcacgatatttggtaattatttttgaaggtttttgccaaccaaattggataatcttggtatcttttgaaagctcttaataatgagaagctttttctaagcaaatgctaagcgatttggtgtaccagagaaaagttatgaggctttaaaattttgtttttcttataacttttgaaatagagcattaacaaaaataaattcagcattaatcgatgcagattttttttctctaacgatatgcaaaatttcctgtggatctaacatatagaaaagaagctaaacatagcgaagtaaatgttgtttttcctaataataaaaatattagatagtacgccaaaaggagacaaaaaattagagaaaaaaagataatgtttttc

SEQ ID NO: 25725 - DNA, 1401 bp, Heterodera glycines
aaatccaattatgcttgcaatgaatccctaaatatacaaacaaaagcgtgattttcaattgtatataaaaattgcataaaatataattggagatttacctcgaagactcatgatgtcgtacacaatgtccaggaagcgttgcatttgcgtaaaaatgaggacacgatggccctttttgtgcaaataggccaacagtctgtccagaatcaatgcctttccgcttaattttggccattcctttcgtcagttttgtactccttcactacctgtcgttgaccaaatgttctccctcctcaaatggttccttttcgattcctcgaaacaaataaggatggtcacagcacttacaaagttgcaccaaagttgacatcagagactgtcgcgcctgtttctctgtgcgcatgtttttggcaaagaaagctgttgaaaaaggcagcattttaaaatctcccgaattgaggcatattcgttttgaaaaatatctcgaaaatataaaaatttaattgatgacgaaaatgtatagaatattgaaaaaagcattttcaaatgcatacatggacaagggggggggggtcagaaacttgcctttacaaaatacctcccacccccctccccccctttcagaggccaaaattgttaacagattttgtggaaaaacgaccgaattttgccatttttagccgatttcatgcatttttattaacaaaattcactaaaaattgtataatttcgtaaaaatttacgaaatagataatgaaattcaatttcgtaaaaatattaacgatatgcaattcaaaatcgtaaaaatttgagttttaggcacaaaattttgattttttttcccaatttcgtaaaattttcacgtctttaccagtgtttttgattttggccaaaaattttacgaaattgcctcggacccccgtacgatttacgaaatttcccccccccttgtccacctatgttcaaatgtaatgttagacagttttcgagctaaaaaatgcaatgaatgataagataatagacgtacaccgattgctgctcagaatggccctgtacatgtcgtattggagcttgcttaggccatggtaaagaatcacttccgaacagagtggcacgtcattgagaatctttttattgcgacgcagacaatatttgtcaaagattttgcgaaaccgttgagacactaacaaatgaaaatattaatttttataatcatttggtttaacacaaaactaaataatgtccccataaagtgcattatagaaaattagaagagattattctcaccttcttcgtcatcccccagttttgcaaaacgcatgatgaaactctgctgtccgtttggtttgaattggtcaggggagggctaactttagcaaggcgtacagctcgaccaagtcg

SEQ ID NO: 25726 - DNA, 1449 bp, Heterodera glycines
ttggcaaccgaccgatttgggcacaattgacgaatatggaaaaccgaatgctaaagcttattaatattttttcgattatattttctattttcttactgattttaattgccaacggatttgatttaaaaaaaaaagaaattccatgtaaaattttatcataataaatagtttaatgaacattttataaggtgaaattttgaaatattattgaaatatgtattttttggcataaaccatctctattcaaaaggtcaccaaaatcatacatatttgacttaacggtcggtcgtcttggcacaatgccaaattctcaatttttgttattatttgagaccgcaaaaaaaggcaaaaagaatcgcgaaaaaggcactataataggcaccaaaaaattgaaaataaaggtttgaaaaaaggcatttaaattttttttattaatgatttttagtgaacaaaaacgtaaaagttaatcaaaaaacttactctgttcatttaaatgagttgaaatattttatatttttttcgaataaggaaaattttaaacgtaaaattttttatcaagaaaaaataaataaattttttggcaatcaatttttgaaaaatttttcaattcttaagggtctattttcgctattttattgctttttatggttttttttcaaaaaggcagcaaaactgcaaaatgacaaaaagggcatttacacgaaaaccccgaaaaaggcaacagctctaaaatggccaaatatgaaccaaaatatggaatcaaaactgccgaaatatataagtttttattgtcgtccattgtataaaaaatacttccaagttttactaaaatttcgaaaaaaattctcatttaaaaaaagaaagttcgcaagccaaaataaccgacgaaaattcaaatttttcgtattttagggggtataatttttaaaaattttcaaaaagtctatcttaggggtgcctttttcgctttttttctaaaaatttgccaaaaatggccgaaatattgactaaaaaggcaaaaaatggtgaaatatagatttattcccgaaaaccccaaaatatggatttatatggactaaaaacttttatcaaatcaaaaaattttaacgcagaaatgctatttttgagcccctttcttcatagcatatgcgcagaaaaaatatataaatccatataatttcgagccctaataataaaagtcaacgtagaagcctcaaaccaagtggaaaatgcgtttttttatgcttaatatatcggaaataacgcagaaaaaaggcatatgccctcaaaagtcggtattagttattatattttattgcattttacaattaagaattttgttgattaaaataaatgcattttttgtggggtacaatgcatattttctgcatacgttactgctgtggggagtgtgaaaaataaccgcgttatcaggacttaaaaactctt

SEQ ID NO: 25727 - DNA, 1921 bp, Heterodera glycines
agcaagaaattttttctcgttgtgaaagggcagaatccttgaaaaatattttgtgtccgtatttcggaattttggaaccatatatttttgctcatatttacgattttatatcaatgctgcatttaaataaacaaaattttatctcatatcatttgaaaattttaattttgtacaaattttgaatgaatttaccattttaaggcttggtctgtgtgattctgggcaattttgcgtccggttttgccggcgtttacgtggagaaaatgttgaagagtcggagttcggtgtccatttggatccaaaatgtgcagttggccgcgttggcaatgccaatttcgttggcaatggtcgcatttcaagattggcacaaagtttggcacaacggcggactcaaccagggatttgacttggtcgtgtggggagtggtggcaactcaaagtaaaacaccaatagtaaattttattcaatattattgcttttttagccatgagcggcctttgcattgcggtaaatttaattaattaactcattcatataagcaatagtcccatttggatgagtgttttttttttgttattttaaaggcttttgttgtgcttttaaaaaaacaaataaacgcaaaaaaatctattaaaattttacataattttatgcaaaaattagccattttcatttctatattttctttgctttaggtggtgatcaaatatgcagacaacattttaaagacgtttgccaattccttctccatcattgtgataagcatcgcctcaatttgggtgtttgccagcatgccgaagccgttgttcattgttggcgctgcgttgatcatcaccgccgcgctgatctatgccaaattcccgtatcgggccaagcccaaggctgatcagcgatcgaacagcaactcagcaacggacagcggcagtgctgactcggacagcagcaacatgagcaattgtggcacggcaccacccaccggccgaggaggcgacagaatgccaaaggaggaggacaaagtgtcacggctgaccaaactgttcaggatgggcagatcgccaaccatggccaaactgacgccgggccaattggacgccaatggagacggaaatggcgtgcagaaattttagagagagaaatattttatcaataattattattaattaatttttatttttgtgcattttatatcaaattttgctcctctcttctctgtgtacagctttttaataagtgtgaagagcatttgacaaaaagttatcatcaatcaatgggtcattttttgttaagtgataacttcgattttgaccatttgtgcgatcgatgtgccatcattttgatggtgacaaataaatccatgtgttttgagtggagaataaaattttattgcatttttgatttttaatggttactttcggacatttcgggacagaagacattcgtgtaaaattgaaacggggaaggaaaaatgaggaaaaaataaaacaaatattctatcttaaattaaaaaatttcgtcattaaaaaaaatcctatataataaagttgagtgtccgtatgtatgtgtccgtgtttgaatttgtgtggcgatttgttttgtttttgcgttaaaaatgaatttgaaaaaagtagagcgagggaaaggtgggaaaatagtgcactgtctgattgtctgtctacgcgggcagcggcgtgtgagaggggcatacagtgaacagacgcgtgctgctgtgcagcagcagtctgttggacgcgtgcgtgtgtgtgggagaaggagggagtgggaaaaaaagagagtaaattgcaatggaaaagaaaagagagtaaaagaaaggaaagggagagataatgggaaatttgtctcgcatcccttccttatttaaggaagatcttttattatataaaataattaataaaataatgag

SEQ ID NO: 25728 - DNA, 1336 bp, Heterodera glycines
tgacggacgatcaaaaaatttttatattaaaatgtaagcaaaaaaattggtcggacgccgaaattgcagaaggaattgaaggaccaacaatgactggtcaaaaacaaaaaattttttcaaatttttttttgttaattttagccaagcagattaagtcggaacatacgaagcttacggactatgtggcaaggagaggagaaaagattgtgatttggaaactctggaaatacgtaagtcacttttttgttttggccaatgaaatttttcttaattttcccactccccactttacagtttccggtgatgacaaatggaccgaagcaaaagccgaggacaaacagcgcaaaagggccagttgtgtgcccaacgtggtcatcgaagcaatgggaggtgattgattttgaaaaaaatatttttgtaaaacatttcgtttgttaaggcggccaaaatgcaaaaaagtggtcaatgctaagcagggcagtgccagcaaaggaaaagtaaattttttgaaaattttgaaaaaattctttttatttttcataggaaaacgaatgcccagccaaagacgaggaaagtggacaaaaggcggacaaagcggaagaaatggtcgggaaggggggggggtaaaaaaatttttgaacaatttttctgggttgtaggcggacgatgaaacactgggcgacggcaaagacattgctgatcttgaaaatgaggagaaggaggacggagaagaggcggtagggaagggtcaaaaaaacattttcttatgaaaaaattttatgattttgtaggcggacgaacagccggtgccagagccaatgaagaaaaagaaaaaaacaaaaacggcgcaatcaaacgctcccgtcggaacttcaagaagcagcaaaaatgatgggaaaaatgatttaacaaattttcaatgatctttaacaattttgaaaaaactttttttttgctaattttcactaatttctcactttgttttttttgtaaaataaatttataaaattgtcttaaaaattggatattattttgaataataattaggaaattatatagttggggtggggcgaaagagaacaaagagagagagagtgtaggataagtggagaacagcagcagacgaaaagagcaatgcgagaggggtgaaagagaaagagagagagagtgtaggataagtggagaacagcagcagacgaaaagagcaaagcgagagagtgtggggtgagagattttctctaccctctattgttccccatccttttttctctcgtccattcgcacattatccctccttctcaccaactcattggtcttcgtgaccattatgctgccc

SEQ ID NO: 25729 - DNA, 2235 bp, Heterodera glycines
atattagggggcggggggggggggggggtggcggccaaaaaggtgcgaatttttgtggccataaaagtgcgaaatttcccaaatttttaatttttctgttggaaatgttaaacaaatttacattttctgttccactgtttctgctactgttcactgtccttttctcaaccgatattgtggaagaacatttggatggtataattttcagagtttttttatttttggcatttttgtctgcttctaggggggggggggcaaaacgtcgccgcaaaattttttatttttattttagaaaaaatcaagaaaaatacgtattttttagttatataacctatttttgtttcaataacaccttggttaaaaaataaacaatttttaattttgaaaaaattaaaaaaaaaagattttttgcggcgacgtttcgaccggcaactttttggaatgttcccggcttctaattttcctgttttctttaaaaaaccttttttttattttttttttgatttggaaaatttttttttttcaaaactgctactttttgactccaaattccggttttttgtcggccatttatatcccaaaaaccgagctggcacccattcgtgcccgtccgtgattttttgccgctttttttttactgtccatgagagttttgtaaaatttgtttcttggaataaattgtgaaaagtatgcgaaagcgtgtgggccgttatgcaaatcaataccaaaacaaacatgtgacacagtcaagatcaacgtgaatacaaaagatggcacttcacgccatacgacacgttgttactgtaaatgggatgagggatactgtgttcctaaagatccaccgtcggaggatgtggcaacaacatcaacaaccaactcggaaaccgttattgtagaaacaacaatgatggacaaccgtatgttgtataaccatcaggggtattgtttttttagcaatttttaaaatatgtaataaaatcaaaaactgaaaaatagttttaaattttgaaaattcttcaaaaaaaatttcggactttttcgatgacatgacaactccgtacaaaaggcaattcgtacaattgcccaggttaggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatactttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctgggcctggcttcggcctaagttttaggatgggcctaggcttaggcatatgctttaggctggacctactgcctattgtaccatctattgtttttgaatttagaaattgatggcacttcgcgccctaacacactttattactgtaaatggcacaaaaatgaggggggtaaattatgtaactgattaagccaagtcgaagtcgaatgatgtggcaacaacaacaacaacaacagccaactcggaaacctattttgtagaaacaaaaccgatggacaaaagtaccgtacaattaatcatcaggagcatagttttttagcattttttttttgtcaggctttatttcggaaaacctttttttgcacgagttttcccctgtcttggaattaaaaaaaaattttcttaacaaaatgcgataaaaggagaaaaacaaataatatttgtaggagtcatggcatttcgcagtattttttttttttggttgaaaaatctaattttttgaaaaattttcaaatattcattaagaaaaattgaatattaaccaatttttataaccagaaaatgaaaatcatgaattttttttttggtc

SEQ ID NO: 25730 - DNA, 1290 bp, Heterodera glycines
gattcgactgaatggactccgttggtggcggtgacttttcatcttctgctggtaatcagggcaagaaaaatgactgaaaatatctaaaacattaaattccgtgtgccgatactcactcaatcattttctgtgtccattgaatgtaacggtccatttgctggagcgtaaaatcccaaaatttgtcagccaacggcggaagaaagacagccgaagaaaagagagcatccaatttggagagaagacaattggagaaggacgaaaggcactcatttttggagtcgtcgttgtcaaagggaatctaaattgggaataaagcatttattaattgatattttaggattcaaacgggaatagaaaaactcacttgaattttgaaagattccggcgccgaaataattcgcagagggccgaacagcggctgagaagcgagtttgaaatagacgaccaaattgaacttttcatgaatggaacggaacatggcacgttggacacttccccgggagggccaattgaggacgaaatcggaaatgtgtcgaaaacagcggtgaaaaaggcgagcatcggacggagttaacactgacgaaaaacgctgaaaggcgcaaaatgcaaagcagtaatggaatcattaaattattccattcaatttctttccagttaattagttgaaaagaaaacggccgcgccgcctccgttgcgcgacaaggcaaaaacgaacatgacttttaatatgcttttttaatatccgttcttttgttttgttcattcatttatacggaaaaattgacaacattagtataaaaaactctcatttcacacaattaaagattcacacatattattaaagacatagctcctcattttgttttccctaattgggtggaatgaatccgaaccaaaatgaaatggtttatttgattgttaaacaattgttaattgtatttagtctttctacaaagacacaaaaactgttgaattgtacttttacatgacaataaaagtatctttgtgtctctttagtgtgctcatattccatgccgaccatttgtaatgtaattgacaacttattgaagaattaattgccttatgactgcgcttttgatattctgccacttttaacgattattttctaaatttgcaggtggttattatacgaactctgcgttttctcaaaattgtcatataaacggctaacactactcctgacttttttttcttaaaatattttaattactttcttttttatttgggtacgcgtatatttttaagggaaaatatagtataatactttaa

SEQ ID NO: 25731 - DNA, 1725 bp, Heterodera glycines
aaattataggtatatatatttttattatttataacgttggcaagcaactgacataaacattttttaataataaatatatttgttttgcagtttttaagaaacgcccacttggcagtttttaagaaacgcccatagtggcagtttttaagaaacgcccatagtggcagtttttaagaaacgcccatagtggcagtttttaagaaaacgaccctaaggcccctgcttgagttactttaatggccataatgaaattgagcccgattcgtcacttctgtccgactgattcctccaatttaaatgagtgccaaaatttgttgtgtcaacagggatgcgtcggaatgccgatttccgattgccaaaatttttgagaacattggcacacatccctggtgccaaccaaatgaatgaatgaatttccgttccccactgatcacaggtggcacggaggagcaaaaggttgccgagatggagatcaatgttgaagcacacatgaaaatgcgattaaacagcaaaatggtgaagccacgcgttgcgctggacacaattaaattagtcagtgccgtttatttttaattttggtgtaaaatattcaccaacagaaaacactttcgcccggcattttggcccaagaagagttggaccggtcggtgctgttggcacgcgaagtgctgcaacggatggtcaacgacattctgaaggcgggcattccaatcccggcacatccgctgatgcaactgcacaaacccaaggcattcttcaattcgtttgggtgcctttgtccagtcgagagtgttgagagagaatggagagagagagaggagagagaaagagagaggggggggggggaggaacagaaaactgatcaaatccattgtcaattgccatagagaatttctttcgtttcattggccattaggaaagtaagcaaagagagaaaaagagagagagaagagagagagagagaaagagagagagaagagagagagagagaaagagagagagaagagagagagagagagaaaaaaagaaagagagagagagaagagagagagagagaaaaagaaagagagagagagaagagagagagaagagagagagagagagagagaaagagagagagaagagagagaaagaaaaagaaagagagagcgacgtgtgattgacggaacggagaaagaaaaggcaggccacggcatttgttgaaaacaattaaacaaaaaaagagcaattaaaatcagtcgatggatcaaacgattgaagctaaagaatggacagacactgtagaagagacgaacgaactgatcagacagacaggggaacgaacatctcaaactgcgagtgccctaatcgagttctaacatcgatttgctattgtttatacactccgtaacatgagtagtgatatggtcgagaccgaattctcccgagacttaaatatccattaaaactttctataaattaaaaaacaatttgtggggctttctctagcaatttatttttcaattctaattcaattatataattatcacgaaggtggggggggggggttagccctcttcaaccaaacattttagcacctattttagggggattttgggatttgagcacctctctaggcacttttttagcatttattgtatttaggtacaatttgatttgaagaaaaagcaccctcagttctctgttgatcatgttcttcgattttttctccattatcattcattt

SEQ ID NO: 25732 - DNA, 1255 bp, Heterodera glycines
tttttgtgccgctttccaaccataaaagtttcattcattgtcatcaattttcccatcttttaggcttttaccgatgcttcttccgccgtcaatttcatttttgtcgtacgatttccaccgtcttttgccaagtccgtcgtgccatttgtgctgaccaataatttgactagcgaacaattgacattgaaaagcacttcaaatagtcgtctttttgtgttcgtccgttctccaattgtacgaaatgcgagcgaatggacaaaatgggaaaatgaggcgattggctgggattttgttgatcaaccgaatcgaattgacgtgtatatgtatcgtgaggatcaaactggggacgggtgagcgaattgattattaaattcaaattgataattgatttccaattttttagacttcttaacaaattgaccggtccaattaatcggaagaagaagaagtgaatgaagggtgatccgatcaatttgaaagatggatttgggaattgacatgctcataaaaattgtcctttttttcattggattgatcaaccttggattatgttacaccattattttatttgtcgttttctgaaatgaaaaaaaaattgttcacaaaaacaccacattaaagagttgtcgggtaatactgacttttactggtcccataaaaaaaggaaataaaaagacggctttttacgattattcgttctattcgagggttatcgaggccgctgatcacgaatatgatatcagaattgtcatatgacatcatctaatctttttcggggaaaaccccgatcccaaaccccgacgctgcctaccccgacaaccccgaaatacacacccctaagaatggcatttttgtgggagaaaagtcaaaaagttaattcaaattttgaatttatttgtttgccaaatttttattaaataaagtaattttttttatgtatattgtttggtatagtggttagtacttcaacaataacagtacttttcttacagttcgataccggtcgacgttttctttttaatttatttttatgtgataaataggattttttaaaccaaaaatacccatgaaaatcaatcatccttgacataatttattgacgtatttaacccaatttcctttagctgaaattaaaaatacaattttttgactaaatcatcaaaatttagtatatttcaaaataataaaaaaaaataaataaattatcagaaattcataaatattttggtgaaaatctgttacaaaatagagctta

SEQ ID NO: 25733 - DNA, 1766 bp, Heterodera glycines
aaaccccttaataatgttttattttaatttataaatcttccataggttgttcgaatttgggttcggggttcggaattcttcaaaataaaggtcatattcgtgatcagcgccaaaaagaccatagaaaaattatttaaaatgtcttttgagtgctttttatagtgcggtcacttgagtcccagctgagtttggcactccaattccggcactttttcagcctaaaaaagggcaagcgcgcccctaattctatttttccaacccatttcgaacctttttacatcgattctgaccgttttaaagcatttttgagtttggggcctatgatcaatatttacctttgttttttttagcataggtatttttgttaagctagttttcaagttattagtcaaatggttttttatttttcgtcataatgaattttttctaattgttgacatttgaataaaattttgtcattttgcacccataattgaagtttatttaaaacaattttccaattttagcacctatttggggctttttagaacctaaaaagtaaaagatttttggcatttttagcacctaaaaattgtatccctaataatggttgtttttttgtctatttgttttatcaataaaatatgattaatttttattccaattgttttcaactttttccaatcgatggaaaacttcaaaaaatttttttcttgaattctctctcttattaaaaattttctaatttttatttaaattttttcgcggggggagggagagaagcgcacccgtagcagggctggacgtaattacgggttacggaaattacggcctttttggagttacggattacgggttacggctttttgggattattccgtaattttgatccgtaactggctttttggctttttaagattattttcaagtcggtttcttgtaagattattttttataaaatgaattttttacgatttttaattaacatacataaaaagggggtggggcggtaggctaacgaagggaaaaagaggaaaggcctaaataatttggctattttttaacaaaattcgttaaaaattctaaaaatttttctcggcggcgcttatcggcaccgcccgcgccaaaaagtcctgattatttttaaatattagctcccaaattagtcatttagacaaaaaatttgaaattttcgaccacagctctgattcttccatttgcccctcttttactattttctcccgatttcggcccatattttgggatttttcgcctcaaaaataaaccgccttaattacggatttccgtaattgagaatcagttacgtccagccctgacccgcagggacgaccaaaccgtagaacggagatgaaatgaatttgaacattttaataaatagaaaaaaaaattaaaaaaatattttatgaagccataattttaatttcataatcaaattcaattagttttataccaaaagcttttaaaagctctagttggtagctgaaactcatattgatttattaaaataaaataactataaatgaaaatataaaatgacatttttgcagttttaaattaaaaattttttttttgcactgcttatctctttgaaaagcatcaatgttttagaaaccctcgttaaagtttgctataacgcagttggcccaaagcaattaaacccttacggtgaccaaaaaagttaactaggattaggaaaaaataaataacatttaaataatttcctgtgggggataatttttttatcaatttatagcatctattcctct

SEQ ID NO: 25734 - DNA, 549 bp, Heterodera glycines
aggccgcgaagcggccgaatgtcccccaaaaaattaaaaaaccgtcctggaggggcgcgaagcgcccgaatatcccacaaaaaattaaaaaacggacgcgaatcgcccgtcctgaggccgcgaagcggccgaatgtcccccaaaaaattaaaaaacgggcgcgaagcgcctgtcctgaggccgcgaagcggccgaatgtccctaaaaaattaaaaaacgggcgcaaagcgcccgtcctgaggccgcgaagcggccgaatgtcccccaaaaaattaaaaaacgggcgcgaagcgcccgtcctgaggccgcgaagcggccgaatgttcccaacaaaattaaaaaacgggcgcgaagcgcccgtcctgaaaccgcgaagcgggcgaatgtcccccaaaaaattaaaaaacgggcgcgaagcgcccgtcctgaggccgcgaagcggtcgaatgttccccacaaaattaaaaaacgggcgcgaaaggcccgccctgaggccgcaagacgttctaatgtcccccaaaaaatttaaaaacgggcgcgaagtgcctg

SEQ ID NO: 25735 - DNA, 716 bp, Heterodera glycines
acagccggggaatttgcgggggggggggaagatagaagttaatttgtcgagggaatggcccctcggggaattttggctttgagaaaggggcggagagcggcgcaggcaaagccatttgaaattattaactcaatgatggatgcttttggcacaacaaatgattgcgagtgatttccttttttgattttggagagggaaatttggcggatgattttacaattaaaaagggaggggggggggggggcggggggaaggaaaatttgaaatggaaaagttggaaaggaaaacgaacttttgaattctttcaatttacccaaatgcgtacagacaaagtttgaccagcagccgaacgaatgaatgagcacagatcagcggagaatgtgcgaacgaaaagtgaccactcaaattcgactgactttttgccgagaatgcaaataaaggcaacagagaaaagatgagggaaagggggggagaggggaagagggggagaaagagagagttcaggggggagagagtgatagggagggggagagttgagggggagagagagaggggaagaggagatagagagagagttgagggaggagaggtgtatgggagagagagagagagggagcgggagtgaggaagggagagggaaagagagagggaaagagagagggggtgggttggatgtgtttaatgctcggcaacatttttgaattcgatgtatgttt

SEQ ID NO: 25736 - DNA, 1567 bp, Heterodera glycines
ggggacctcagagtctgcatgtaaaaatgctgttttgagcttttcatgcaagcatttgcgcaaaaaaatatgtaaaacaacaactaccacccaacaatcaaagaaatatttattttatgtaattattttgtattttccaatttttttttttgttcaattttaaaaattttattcaaaattaatttttgaataaatatttttatacgcccgttggccagaaaattgaagcaattctggcatagattcgtacgtttacttttttaggcggctttattgcaaaataaaatgcacgccaacaaataaggactgaaattttcgaaaaattttcaaaaagacaggctattaattcaaaaaaatggattttttctggcgctaaaattactcaaattacaaattaaaccgccgacttttgcatgaattttaatccaaaatatattaaatttggatattaacaagcatacactatttgtttttttctcttgccattttcgcccatttttaggtgctcttataagtcatgaaccgcaaatttattatttcattaaaatacatatttcaaacaataaaaaaaaatttgcggtgtccaattttctggccactattttgatgatcaccaacagcagcaccgattgatgacgacgacaccacggcggcactgtgccgcacaaattgacccaaacagaacacatctgcagaattgcctatttatgcaaatttattcaaatgaaaaccactttccaacttatgcttaaatcagtgtattgggattggtgctatgtcattacttaaaaaccatcataatgggcgttacttaaaaaaccatcataatgaaaatttttgcttataactttgctctaaaaagaccaaatttttaatccttgctatcattcgatagatctaaatgttctttatgagcctttaaaatttcaaaaaattttattaagtttaaaaaaagttatggccaaaaatgttcgaaaatcaaggtttcagcaccttgggattgtccgatccaagtacagaaatccatttcaagtacataacggggaaaatcttgtaaaaccaaattggcatcaataatttggggattttaattaaattttgaagatttcaaagagggacggactgagtccgatgattacgataggcgccgaagtgaaaattttttaaaatttcatgagattttttgcaaatttttctattaataaattttgcaatgtaaaaaaaaatagaaatacaaaacttttcgaatttacataaaattctccctttttacccttttacgaatccaaaatcctggctttaagcacttacttttaatgtgaatttcccctcttaccctgctgctcaccaatagctggcataaaaccgaaagatttcgagtcgaatggatctgccattttatttccaataaaaattaatctgaacatatagttaatgtttattttaagataaacaaaaaaatctaattgtttttgctgattttattttaattatttaccaaaaaacaaaaatcaattgttttgcctatttaattaatttgtttttttacgatatttaaataatgatg

SEQ ID NO: 25737 - DNA, 746 bp, Heterodera glycines
cccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagttgaaaaaaacgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttt

SEQ ID NO: 25738 - DNA, 1764 bp, Heterodera glycines
aaaactcaaacaattttgaatattctttttttcacattctcataaaaaatatttaaactatttctaatttaattttttattttatttttcttcaaatttcaaaaattcgcattatttttcttttttcctttgtcatcgatcaagggaccatctccgaaaagagaatgttagcgcgcacccccatacgcgagcggatttttatttcaaataaatctctattttttgtaataaattatatcttccattctcacatcttttttttattgaactaatcaaataaaaattgtttagtatttgtggttataattttctaaatatatattctggtgaaacttcctgcctctgctgagccgctgctgacaatgagccaaaagggtcaaaacaaataaagtttctaccaaattttaattgtgattaatttttctctcaaatttatatatatattgtgtccttatttttcgatactattagatttgtccttaatttcaattattttttgtcatttatttctcatcttttaattttccaatcaatttcctttgccatcgattaaagggaccgtctccgaaaaggcgatggcagcaaaccacctcccccctatccgtgcggcttttatttaaattcaattttaagtacattcaattggtattttccaataataatttggtatatgtataacgtactaaaagggagagattctagaaatttttaattaacataaattcttttaaaaattgacttgaaactttttcggaattttttattttgtataccttaataatttttatagcaaataaacaacaattacaatcctcaagaagtacaataagtcattattttttcactcattttcattgaaaaactatctctctctgcactaaaacattaccgtaggacaaaagagaacaggaaagaaggggttattttaaccaaatcagtttcctaaattaatttatttttttaattcataatttatatgatacattaaaattcacgatcgataatttccgttgatatcgattaattgagggaactacaaaaaaagggctgaacacttgagcagtggtgctaaatatacccgagaatagcaaatgggctggggtttttacacaaaaaatagtggcgggctctctttacatttaaatcgtttttctttgttttggtgattactctttttctctaattctctcttctctcctatggtgaatgcgcgtctctctacccagggggggggggggacaagatttctgtcccaatactactcaggggtattattttgaaaaagttttttttccccaataaacttttcatacctcatttttcgcaccgtgaatgttatttttattgaattctgaaccgttttgagtagattagagtacaaataattaaaaattttgaaatcatgtttcccactcccttctcccaggggtattattttgaaaaagtctttttttccccaataaacttttcatacctcatttttcgcaccgtgaatgttatttttattgaattctgaaccgttttgagtagattagagtacaaataattaaaaattttgaaatcatgtttcccactcccttctcccaggggtattattttgaaaaagttttttttccccaataaacttttcatacctcatttttcgcgccgtgaatgttatttttattgaattctgaaccgttttgagtagattagactacaaataattaaaaattttgaaatcatgtttcccactcccttctcccaggggtattatttgaaaaa

SEQ ID NO: 25739 - DNA, 1395 bp, Heterodera glycines
cagagggaaaatgaaaagcaaaaaaatgggagggagggaatttgaggaaaatgggggacaaaacaatcggaggtttattaaagatttaaccatttaaaaactccaaaatatttcaaaaacgcaaaaattaaaaaatagacaaaattagcatgaattcatcagaaaagacttagacttgtcattttgaattcttaaaatgaaaataataacttagcaaatttaaaagttagaaatcttaaaatttttctaacttaaatcaaactcaaaattggttaagctcttacataaaactgatcagaaagaatgtgtctgatcacttttgtcaataatattgaattttattgtctgatcactcttgcatttcaaatatttaattcatcattcttccaacacgatttaattaattacatttttgtgaattttggaaaacaccacttcactttatttgttagagggattaggtatatgaaaaatgtagcatttgattgaaatgtatagataaatatgtgtatgaatggggaggggggggggggggggcgtttcggccacggggaacggaaaaagcaaattaaaaagtatttgcattcgtggcacggatcattcatccccactcaaatccatatccattcataattcatccaacgcgatgcgggtccgatgggggcttgtttcggtttatcttcctttctatttttccccgtatcgattttacccccgtttcggtttaatccaaattcgattttaccccgtcagtgccgtcgtccgcacgtcgcacgcggcgccgccgccaatgcatcggtgcccaggcgacgcacggctcagcgcagcaccgccgtaccctgaggaaccatggtgttaattttaagagcattaagtgataattaaaatacactaattatatttgtttgaggggggggggggtggagtcatttaggacatgtggaatggaaaaaagaacggaaaaataaaaacttagtatataatttgagtttccagtagatgcgaattctaaactcttctgggcacgtgttttaaaaaaacgcatttcggaaatgtaaatttgcatttccgctaattaaaaaggcgagataaaagccgtacgattagcctaattattcctaattttcacggaaataaaaaaaataccttaagaaggaaaaacaatcaatttttaggggggggggcaaatgattattaaatgaattattaaactaaaaaacaaattaaaatattttcaaaaagagaaaaaaaaattaggcaaagtgagttaatcagggaaagacttcgattgatcattttggcaaaaatacgatttttacaattaaaccatttgttttaattaaatgtcaaattctttaaattaaaaccgatatttaaaaattcaaaagttcaatc

SEQ ID NO: 25740 - DNA, 1028 bp, Heterodera glycines
  misc_feature (20)..(20): n is a, c, g, or t
ctttccattccatcatatantttgttaaaaagtcattctattggacttaggaattagttttttgcaattggcgcggtgaatgctgacaaacgatgacgcataaaacgtaattcttttttgcttttttttatttgtttgtgttcctttgcgatttgtgcgccacactcaaaaattcggaaaaggatcaatgtaatgaacaaacattggtatataaaaagcataaacggacgatgactcgtcaaaagccaatggcaaagaaatgcttttgctttacgggagaggatgggacgatcaataaaattaaaaatttaaattgaattgataaaattataattgatttcttttttaaaaatagggacggcgcggaattatgatttccaacatttttggggttgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacacaaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttatttttcggggtttgggctcaaaaaggctaatttagctgctgagggccgttctaatagaggtttttttgaaaaatgccaaaatatggacataaaatatggatcaaaatgccaaaatatggaaaaatatggaaatatggacataaatcgcgaaatatggaaaaatatggaaaatacggatatagaaatccttcctagaagcttcaaaccaagctaaaaacatgtttttcgtgcgtttcaggcctcccacagtccaggaaaaaaatatggatttccatgtaattctactccctagtgatca

SEQ ID NO: 25741 - DNA, 1681 bp, Heterodera glycines
taagcaaattgaaagcgctttttgtttttcagtttttcgaaaatcaatcacttttggagttgcattacataaaagcattttccaccgatgattcagcagagcatgaagcacttaagctggctgttgatcttttcatttgggtgatgtggttcgaaaaagaaattctccagctggacaatgagcatgccaagacggcaccacggcttaccatggcatggaagcaaaaccggtggtattacgaaatgacgtacgacaaactgtttgacattgaaaaggaaaatgagcgggaagaattggcaaaaattcggcaagaaattggcattttgctgcaagagtcaaaaaattttgctgaacaaaaacggcaaatgattgatgcgaatctgaaaattgagttgcgcagcaaacggcttcaacgccttcagaagcccagcagaacggcaccgcctttcggcactttggacagggaattgtacgacattcgacgaaaagccatggcacgggacgaccaagttgagccggagtttaagaaatggcttcagcaaacacattttaatcgccttagtgattatgttagccaatgcaatgagttcaatgccaaatttgtaaaaggtgctttttttgtctgcgtaactcctaaactgtcaattgttatcttcttcgttttacagcccatgtttattcccatttttaatttttgtaaatttttaaacaatgctttaaatattttaaatgacggattttcgcgccaataattgttaatatccttggcattccattaaaaaataattaaggaacatcaaaagaaacattaaaacgagtggcggaatttgtgggcgaagaaaatgccgatgaaattaaccgaaaggcaaacgattgttttgggaaattgtcaaattttgaagaatatttagcggcggatggcacacatattcatggcatttatatgaatccaagtgaaattttggaggatattcgtaaaagtgaggaaattgataaggaaaaggaggcgaaggaggcggaggagaagccgttcgatttggatgcaacgatggcatttttgaattttgggggcacagacaaaaaggggaaaatggcaaaaaaggacgctaaagatggcacaaaaagtagtgatcggagaaaaaaaggagacaggaagaagcaattggaaggagagttaactgacgatccttacaaaacgccaacagagtcatcgataatgcctaaatcggatgaaatttgcatggaaaaatcgaaaacaaaaaaatcaaaaagcgacagtaaccaaaaggtaaagaaaaacaaagtggaaaaaccaaaacataaaaaagaaaaacctgcaagcattaagccaaaagagaatgaaaaaggcagtcgaacaccaaaaaataaaaaaattgacaaaatgccaaatgacgataatgcatccaaaacatcaaaaacgaaaaaagaaaaaactgtcattacgccaaatgataaatcagaaaaagaaattgagcaaaaaattaacgataatgtcatcactgatcagaaaaatgaaattaaagaaacaaaaaagaaagaggaaaagaaagccaaaacattaaaaaagagaaacaaaaatgatggagatgcacagaaagaatttgaaagcatcgggataattggtaataataaaattattaaataatttttaaaatataat

SEQ ID NO: 25742 - DNA, 2011 bp, Heterodera glycines
  misc_feature (1967)..(1967): n is a, c, g, or t
tcggaaggtcacttattgttagtgctgaacctgttgtgtttccaccgttactcgatatgcgtcttcgattttgcgcgacgtccgttccaaacgttcggtgtttgtaatgagtttgtccatctgttggaaatggaggatgacatttttgacattttccatggcgacaaacattcatcttccctgcaatttgttctttttttatttcttacctggtcaccgctcactgatccgtcgccgcattggaaaagttcgtcgcgttcggcgtttgatttcgccctttcaattgccttaaatttcatcggtgcattcgttcgttcgtttcgctaacctttctcagttcggcgtccaattggcgtttgtcattgcgataacttttcactcgcgtttcgtattttgagcgttccgaactaacgaaacaaataaatataataattagacaatttcccacctgctcgaaggaatttcgcgcgcgctcagttccatctgctcgagcagttcctccacgtcggccaacaaatggcgcacttctttggccagctgtgcgaattcggaaggtcccaaatgatggagttggccaattttggcagttatatctgaacagaaatcaaattgcaccccaaggggtgaaatggaaccgaccagcagtactgacggagtattggtgctcgaattgggtaagcaatgcaactgtcgtggaggaagcagcggaatttaggggggaagccatcaaaaaagaaagaaacaaagtaacaaataaattaatatttaaaaggaaatggaaggaaaagcgaccaaaaaataaataaataaaataaaaacggatcaaatttagaccaaatcacaaaacaaagaaaaacagtcagaatttcttcatgctcgagtaacttctgttctgctcgcacattttgtgcagctcctgcttcgcctgaatggtcagtccttcgttttccatcgcggcgagcaattcggacgcgagcacatcctttgggaggaatttcagataaagggcaaacgaatgcatgaaaaagtgccttaaagtgcgggtagtgcggccttttctcattgcgcttctttcccgcctttagccggcaaatgtcgcgcattgttttcatcgctttgaaaatggcgaccttttcgctgattggcattggcactaagtaaagggtgccggctaaagaaacatttccattcattggtttcaactttcggcatttgtttgtcgattagtcatttgtacctttgatcgtcttttccaacttcatcaaaggacgacaattgagaatggcgcggttcgcaacttcgatggggtccaaaatgatttcggcacgtcttttctcgtctttttcattaagccattttctgaaaattaaactctctctccaaaaaccttttcctcacttttactcgtattgcgttcgtttgacaatttccagtgccgaaagaacatttacgcgtgacaattcctttttgccctccatcaaaaatacgcgcaccattttgtccacaatttcatcccttacaattagagagaatattcaaatttagttttcagtttctacctgtagaaaacaggagtttggtcaaataacattggtttcagatacatataattgcgcttgtcatttggcggaagtggtttattcaactaaaacaaataataacgaagaacagagtgaattcagatttgatggcacctcctcagtagaaacgatgggctcggtgaaaattcgagggtcaaacactgtgagggcaaagaccgaagtggaaattgtcttttgctgatgaaaaggcaaatggacaacgaaagaaagcgcatttgaaaggagcggaagagaagggcacggacgaagaagcatcggaaaagcaaagcaaagaattctctctctatgacaataagccaagtttcgttttttatggttgttgtttttcggataggccacaatttccgtaacgtttaatattcattnaaatatggcggtaattaagattcaaaataaataaatttaaaaaa

SEQ ID NO: 25743 - DNA, 1588 bp, Heterodera glycines
acgctttccctgggctgagtggtcagcatcagaaagaagtgaatgaataattaattggtgcaaagtgtttgtggtcccgaaatgttgtactattattatatgttgaacgtattttactctgctttctcacaaattcgtccatttcaattgtgtaattggtgtgaaggctttgataaatgattgccccaaaacggaaaagtaccaacctccattttcgactcatttcttttcacattggtgaaaaacaagaaaaacaacaacaatcgctcggttcacttgtgccgtcatcattacggatggaaatttatgccatgaaaaatcccgaaaatcgtcaaaaagtcatgaaaaccctataaatacgctaaacagtcataaaaaatgcaaaaatttcgaatcccggacccgaattcgaacaaaaagtcgaaaactcggaaattttctaaattcacttttatcttcgtttctgtgaatgatcattggtaatactatagatgtaccccccccccctttttgacgaaaaatttttttgttctgaaaagtcttggaaacatgtttatggtgggttttcgaggtcgctgattacgaatatggcatccatttcaaccaattcgggatcccggacccgaattcgaaaaaaagtcgaaaactcaaaattttgaaaattcacttttatgttcgtagctgtatagaatgaccattctttgatattccaatggtttgtgactaaatttagcatgttttaatcaatttaggaactaaagtgagaattttttaaattttgagttttagactttttgttgaattcgggtccggtattcgaaattggtccaatgaaggtcatattcgtgatcagcgaccctgaaaccccccataaacatgtttgggggggggggggggggtaccatctatagtattacccccaattactttgtaaacttcagaatttgcatacgccttcatcggatcgaacaaaatgaactgtttgcggattggattaaacagcaccaatgaccaatgagaaccgcttgaaaaatagataaaataaaaaggagaatcattataaaaaggtcgatgagagtaaaaaaccaccttaacacaacattcggttcggtgctgtcgttgtacaaaaaaagcagccatttgtcaggggaagcgccgaccgactcgatcagtgcgtccatttgttggccttctgtcggagtgtatttgatcagctcacagatagtggcatagatcacagagaccttttagtggataaattaacagaaaatacattaaataggtaattactttttctcgaaattgcggattcaattcagcactttgattgaacaaataactgactgcgaaattcaccacattatccgttagccaatttgtattttccagagaattagctagaaaaatgatacattcatttttaaaaaagcacaaattgcacaccatcactttcgaacagcacaaattcctcgtaagaaaagaggcgtcggtcagcaccaatcatagataataaagaaatatcaacaaaataaaaataaaatattagaaaaaagtcgaaatattttaaaaaagtcaaaacaattgctct

SEQ ID NO: 25744 - DNA, 1131 bp, Heterodera glycines
tttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaattggagaagtgccccaaatcggaaatattcccaaaattcaaagaatttaatgcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatctaaaaataatttcttgcgtaatattttttacattatgttgttgaagaatttgaggctgcttctgatgcgattgaaaatttttcagcttttcttgaaaagttttttccctagaatttatacagctttcccgacaaattgtttagataattattctagacgatttgggtatatctcagtgcttaactattgcctttttgtatgataactg

SEQ ID NO: 25745 - DNA, 2087 bp, Heterodera glycines
gtgtgttgcctgagggaattcccctcgtactgccgcaatagcagactgttcaaagtctgacatgatggagacggcagcccaacccgggatggtatttttgatggccgcaaacacctaaaagtatatggaaaaaataactaaaattaatttttacgcttcgataatgctgtgccgttttggaattgagtaaagcatatgcacatgggaccgcagcaaaatcaataatgaccgaaacgttataaagctgcgaaaacggagtagaggccacctatttttgaaaaacatggaccaaatttttaaatcgggataaccactttaaacgtgccatcaatcgataagtactgcccataatgttgtaccatgtatcggccaaattccgacataaacacaattaccctctggccctcaacatatccatcaaaaattgtcattggttgaaaaatttggccaatgacaattgcgtcgggatcctgcgcatccaacaaattgtcacctgcgtctgcccgttgcctagcaacttcacgacgataggaccgccccattgcggaagaagatggcgcaagcgcagctcgtaccccttctggtatgcttgctctggtattgtcaacagtttgacgcgttgccatcggatttgctgcttcagccgatgtcctcaaagtcatttgtgccactcgaacagtttcatgagaagccggatgattgtgattgccattttttacaattccaattttgtatggtcgtccagcggcattatgatgtacagccccacgtacatgtatacgcccaggacagtagggatttcggtgtacacagcgataaatctcaatccctaagccaaaattgccagaaaagccaaagaatctcaccatccgccattcgactatcggctttaaagttgtactcaaagccgtccgccaaaagaacaactcggtgctgtgttgtttcagcaacaaaaaacattttttcatttggttgaaggttcgggagggggtcatgggcttgtggatttggatgaaattcttgaactgggggatttggctgtggatgctcgtgaatttcgccttcttcggaagatgaggaatacattttttgagggaataaatgaaaattttcgaaggaaaaggaagtgttaatttgtgcagtgcacgagaatggtcatttttacttgcaagtaatttggcaaacatttttatcatcgcattttcacatcatttacattttctaggtcattcgcaaaaaataattaatttatttgcctattttccttttttttcttgatatggcaaaatcggtccctttcggcgaccggcattttcttatctatttgtatatttgactgtcggattgtccactgtccgattgtccacctctgtccgattgtcctcactgtccgataattaattaatagaattttatattatcagtagggattagcttttaagcacaaaaatcgcaaaataggcataaaataggggaataaaattgtttatgaacgctttttaggtagcaaaggaaataaaaactaatcaaaaacttatttaagtgttatattcaaatttattagaattttttttcgaataagaacaatttttgtaccaaaaatttttatcaagaaaaaaaatttaaattttggggaccaatttgaagaaaaatttttcatcctttgtggcgtattttctgaaatttttcagatcatttctcaagggtatatttttcgttttattgcatttttaaggcttttttagaaaagcctcaaaataagcgccaaaatggtgaaattaggaacaaattaggcgtctaggcattaagaataaaaaccccccgaaataggcaaagaaaggcattataataaaataggtcctagaaacctcataccaaaacgcgtttttcatgcttattggagcgtagttttaggcatttgcctaaaaacaaatccctagtgataataatttgcaattgaaagtagtaaaaaaaatcaaaacccctggatttgtcctttgtcattttagtcgtttttaatcacatttcggccttcatttcctttggccgtttgctttgaaaaggaaaatagggctaaagttcgaaaa

SEQ ID NO: 25746 - DNA, 1193 bp, Heterodera glycines
cctctgcagcatgacactaattaaaagtgacagctgaccagtggaggggggctaattagctaattgattgacagctggtcaaagggaaaagtgacagatggggggaattaaaatcaaaacctatgggagggttttcgggtgactaattggggggggggggtggtcaattaattaattaattatttgggtggggaaaaagccaaaacatatgagagtggtagggatttaatatgtccaatatttaaaggttccaaaatgaaatggtatgggaaaatttgattgagaattaaacagacacttgatgtaaaagtaaatttataaatttttctcaattaatttgaatatgcgggtggtcccttaatcgatgaacggcaacgaagggaaaatgacgccgtcactaatcctttcccatccctcttcgcttgaccccctccccctcccaaaatgtaagagaggcacgccatgccattgattccttcataaaattaatacaataacctcaccattatttgtcatttatttttggttttttttcaaattcttttttaaatttaattaatttataaattctttaatttttattatagcattcatttctcatttcatcaattcgattgcgactttttgtcatcaccaattacagtgaataataattaaaaaatattttaattaattttcgataattttgcaaatttatttcaggtttgtcttgttccaacaattctttgtgttcttcaacggactgtgacttagacgaacaatttgccaattcattgatcgccggctttctgttcccgctgtcacttcggaattcgtcaattttatcacaaaatcgtccaacaaagcggcattgaagtcacttttcggcaatggacaatcaatttcaattggtggcttattccgatgacgagagcgaactcagcaacaccgtgccaccaaaacacggatcaaaatgtgtataggggttggcagtcgacccatttaggtacttttaatttaaaattgattttaaattttaaaattatcctattagttttgcaaatgaagggtttgagtccagtgagattgtaccggtggaaaatgcgtcagttcaggggggggggggctttaccggtaaatattataatttttctttatttagtgcaattcagcagttgtcattagtggtacctaacaatgaggcagtggaaatg

SEQ ID NO: 25747 - DNA, 1211 bp, Heterodera glycines
aaagagagaaacggcgaaatgggaaaaagtgtcgtggacagatggcggagagacgagcaaaacccctcgggggggggggggcaattggacattgctccccattaggacatggccgagggcggtgccaattgtaagtgacgaagtgatttaagcaattaattgtctagggttgcattggcactttcattttcctttttgtcactttttcactctcttcctctccactcctctctctctctctctctgtctctctctccttctctcctcttttgtttcccgtttgtcatttcaatttcgcacaagaaaatctcaaattttcttcctttttcatttcttcagcagccatttccttcccgtttttcgggaattgattgactagagaaaagatgcacaacgaaaaagggacaatggagggaagaaaaagacgggagggaaaaaaagagcggaagggaaggaggacagaggaagaaaagagcggaagggaaggaggcgcagaggaagaaaagagcggaagggaaggaggacagaggaagaaaagagcggaagggaagggggcagaggaagggaagagaacgagggaagagccagcaaaaatcacatgctgttcatttgagggaaaaacaaaaaccgcgagaacacaccaccaccgtcagctgctgaacagtcaatgttgagggtcggtcacaaattcaaatttgcatttttggctttctctccgtccgccgatggattgccccttcggcacaatcggtcggtcggccatccattcattcgttctttcatccctcctcaattcgtatgtacggagcaacgaacaatcccacaatttttcggacggctgcttctacgaaaaccccgggccaattccattcccccctcccccgcccattccattgacagtccgccaaatgctacaaaatcaatgaacggaaagaaagaaaacggcggacgaacgaacgaagacaaagggagagaaagaaacagcagaaacaaacaatgcattagcagttaataatagctaattggattgattattaaaatggaacaactgcaaaatgaccaccaccgaatggccttcctttgactttccgcttcattaattagtcatttaataattggtgcaatttccatccgcaccgatgcaaaatatgattgataagtgaatctaacaaaaaggggagggtttattcccccccccccccccccccccc

SEQ ID NO: 25748 - DNA, 1438 bp, Heterodera glycines
aattaatcaatgattggttaattgattgataatcatagccctttgatcttcccgccgtttacttgttggtccttggccgcataaatgaccgccactttgtgcacttcacggcactgggccaagttgaggtgccgaatttcacggtgaaagttgctgggcgcgtgccgaagtcgagccaataggccgaaactcgcagcaaaacggcaccaacctcgccgttcaacagcgtcagccgacgtgccggcatcagcgtcgccaaagtgttcatcattaccaatgttggtgccgttgcggatgtttttgttacgacatttctccgccagatgccgttcatctgaaactgtttgataagatgagatcagtaaaagtaagcgccatcgctctcaattccccgaaaatttttaaaatttaatctaaaatagccaattttcggtgaaatctgtcaaaaattccaatattcccccaagggtttttttaaagagaatctcaaaaagtttactcatataatagaaactggtttgtttttttcaaaatttatccctacataaatctccaaaaatggtcatttaccttgccaaatcagtcgttcgtcgggacacggttgctgctgtggaccaactgcaacatttcgggctcgatgatgtcgaaatggggcagcatttgttgctgctggtgattattggcacaaaaggaaaccgaccgcatggatggacggggccttaaaacatttttagatagaactgaaaaaagccaaaactgttttatagtatttaaaagaatttttattgaccatgtgtaaaatcttaggctaattacccgcctaattactaaaatattacaacaattatcaatttaatttgctataatgtacaattttcgacacgttccatattccccgcgtccctctcgtccgaatacgtctcggtcagctgctacctgaaacgggtcaatcggggcaccgaaggaggacgacttttgccgaacgctggccgccttcgcttgttgaagcgacggaatggcaccgtcattctgttgggggttggccaacgaattgaaccattcttcgctgcaaaatatttaagttttataaaaaaaataataaaagtttattgacaaatttcattcaaaaaattcttcagaggtacctacaaatactcacgaatttttaataaggaagaaaaattttcagtaaaacattagttttccttaaaaatttcgagtgtgaatgggtgttttttcctctgaccccactggtttcggagcaggtgtcgtcgcccccacccccttaaaattaaaaaaaaatcagcaaatttcatttcatgaaaaaaatttggtatgttttcagcgcttttttcagtgcaccccattgaaattcgtccgtaaggagttggttcggccccctacaatttcacctattcactggcgattccgtctcctc

SEQ ID NO: 25749 - DNA, 1751 bp, Heterodera glycines
cttctatatattttcaattgccctcttttacagtctctctttccccctaagaaacaaaattaagcattttatcatagtaattttcaatgcaattttgtttgttcctcctccactgttgctctaatgatgcttttcctctgttgtttcgtcttgttttgtgtaaacatttttacgtgctaatcagaaaatgaactgcacaaccaaacacaaaaatgcacagcagcgaaatccgagacgatcgcattttcgctttgtcacttcttcggtccgccgcgttccgtcggctcttttccgccccccccaccgccatatcagtgcttttcatcggtcggtaaatgcgccccgctttcttcccccccccaaaaaaaaaactcccacccacccattttccgcgccaaacatttcattgcttcttctccctccgcctccttttcctcttttgtattcttcgctttgtgtgcagcacggcgccgaggttggctagcagtaaaatcgggcgcaaaagaggggaaaagcaccggcagaagccgagaacggctggcagcagcagctgaagaatgaactggaggaggaagaggacagccgcgagagagataaagcggctggaagcagccgagcaaagagataaaaatccgtccgctgtccgttgtgtcgtcgtgttgtgcttcttccataaaatgggtgttgctgttgtgtgttgtttgttgtactgctgctccctcccctccccccaatcatccaatctaaaatccgggatttccatgcgttgggtcgcgctgttctcgtcggtcggtcggtcggtcggtcagtcgcgccccgtcgttgtcgccttatctgcccaccaaaatcttttcaccacgcacccctcagcgtggtgcccttcccccggctttcctttcttttgtgcaaacccagcaaaacgacgacgacgacaaaatgtgagcctcggcagtgccccgccgccactttcacccattttcgctgatcactcccctacgcaatgacaaaacaaaaaaccattgctttcattcattcattccttttcctctgcttcttcttcttcgtcttgcactgctggaaaagccttccttctcatccccatttttgtacataattaggcgctaatttgcttttgtcttctccaaataatccaatactttaattaatcactatgattttattatatataatcccctaaatgaatcgcattttccttcccttccgcccactcattttcattcgacattttttttattccccaaaacactaattcattctcaaaataatttttctgagacgatgctttaaaaagtttggaattgtgtataataatgaatggatgtgtgctgctgctgttggctgtttgtggattggatccgccgtccccccccccccccgccacaacagtcactttgggtggggggggggggtcagacggaaataaatatgtaaaaagagcgaatgcccccgggggagcggacattcccaaaaattggtttcctttcgctttttgggcgtgtggcggcggtgcatccctttttcgggggctcgtttttgtggcatcatcggcagaaattgttccatccgcgagagtttatttaatagaaattaaaaaaagataaatcaattataatgattattgcgaattttgtcgaaccctaaaagtctgaaatttggcgattgtcggagtgagaaaagttgggagattgcgatgggtaacgcccccaatatgccagggtagaggtatcagt

SEQ ID NO: 25750 - DNA, 1678 bp, Heterodera glycines
aggactgaacccaccagcatttcaatcactggggactcaatccaccaacattccaatcactgggactgcattccaatcaccaggacagaacccaccagcatttcaatcactgggactcaattctcctgcatttcaatcactggcactcaaatcaccagcatttcaatcactgggactcaattctcctgcatttcaatcactggcactcaaaccaccagcatttcaatcactggcactcaactcaccagcatttcaatcactgggactcaacccaccagcatttcaatcactgggactcaattctcctgcatttcaatcactgagactcaacccaccagcattccaatcactgggacttaacccaccagcattccaatcactgggactcaacccaccagcattccaatcactgggactcaacccaccagcatttcaatcactggcactcaacccaccaacatttcaatcactgggactcaacccaccagcattccaatcactgggactcaacccaccagcattccaatcactgggactcaacccaccagcattccaatcactgggactcaacccaacagcatttcaatcactgggactcaacccaccagcattccaatcactgggactcaacccaacagcatttcaatcactgggactcaacccaccagcattccaatcagtgggactcaattctactgcatttcaatcactgggactcaacccaacagcatttcaatcaatgggactcaaccgtacgggggcctttcggccccactcaccaaatttttgcgccaaaggtactcactcggccgcttcgcggcctcgtaactggggccttcggctccattccagtcaccaaaattaaatctcaccaattcttaaaacccaataaccggaaatgaatgataaaaccgacagcggctcgaccacttagcggcctcgtactcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacacacaacaaagaaagaaaaagaaacattttaagactgttttttatacaaaatgacaaaagaaaaaaatgtaaaacaaatacatttcatttttcaaagcatttatacaacacaacacaatgttaatattataggattttcttagtgaacaaactaaggagtgtcctctttcttttgttaaatattttatacaataaaaaatgggttataaataaggaagggatgcgagagaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctcacccgccgctgcccgcgtagacagacaatcagacagtgcactattttcccacctttccctcgctctacatttttcaaattcatttttaacgcaaaactcaaacaaaacgccacaccaattcaaaccacggacacatacatacatacatacaaacac

SEQ ID NO: 25751 - DNA, 1683 bp, Heterodera glycines
aaaaacttattttaaattttaataacaatttagtttttttatgaaatatgatcatcactaaagctgtgatttgtcttctcacccgcaatcgaaatatttttttaaataataaaaattaatgataaatttaattcataatttttgatgctttttgtgggatatttacaattaaaatatttctaataaatataaataataaattttatttaataagttattttggtccgaaatttaattgttttttattttaatttttaattaatttttgttttttaacaaaaacatattttactttttaataatttcaacatcaatcttatacattgttattttcattaataaattggcaattacttttaattttatataaattttgttttcatcttataggctaaattatcttttttaactaatagtaaaataaaattcaatatttatatttttcttagtagctcatctttaagccaataccattatgcgaattttattttaaatttgtctttaataaattcttggttttgcattttcgcttatgtgcattttcatttcagattaggtaagatgtaagatttttttcaaataatttttttttattattataattatattaaaattttcatagattgcaagtatattttttatccatgtgttctgtgtgcacgtcgttgttggcacgactacaaatatttttatttttttgtaaaatgaaaaagttttaattttattttgattaattcttttttctataataataaaaggattacaacaattttcaattaaaaatttattaatttaattttttatttaatttaaattcgaatactaattatttcaacaatttaagagttaaatcaaatgataattgaaggatatttcttcgaaatgctcacagtaattaaaatgtatatttataatgaatagctttaaatatagtgaaggtgctgatgtccagcccagaatatgaggaagggacgagggaaattggggattggatttgggggaaaaaggaataagccaaaatccgggccctggataaatgacctccccaaatttgtaatcccatgggcgcctattagctaatacgcgtgcggggatgggcgagaagcagtaaaataataatataaatattggccaattacattaataataattccgccgcgttctgctctcggctctcgctcgccgattaactgcccgctcaactgaccccttatcgagagaatgctcccgattaaatagttggacttatggaacggaataaaggtggggaaaagcggggataaatggtgtgagaaagagattgaacggatgtgataaattgcgccttacaatatatatatatatatataatataatatatttatatatttcacatgaaataattattattcaccacatcaagctgttataaataaaaaacggactttaaaattttcgtttattatatggatacaaaatataaggttttaaaaatctatttttattgcgttttgattctgatgcaaagtaaagcgaatagacattaaaactgaatagaatattaatttgttaaaaattaagataaaaattatttgatttcaagaaaagacaaactaatgattatacttaatttcacatatgctatatatgtgcaaaaagtaagttatcaaattatgatacaactaaaatttgaaaagtaattaa

SEQ ID NO: 25752 - DNA, 2362 bp, Heterodera glycines
  misc_feature (2162)..(2162): n is a, c, g, or t
  misc_feature (2233)..(2233): n is a, c, g, or t
  misc_feature (2245)..(2245): n is a, c, g, or t
  misc_feature (2285)..(2286): n is a, c, g, or t
ttctttcatttgtccgttttctctttgctctttcatcgcttcctccctttagcagctctatttgagccaattggccggtctcggtgcttccgatgcttctggtgctgctcctccgcccgattcgtcctcttccaccggtgctgtcaatcccttccagcacttttcgtcgtccgctgatcttccgacgagttccgcggcggtgtgtcatgcgtccgactcggccaccaccaccacgagttcggaatcttgcacttcctcagaaacggaggggaaggcgcgaggagccgccgaagcctcgtgagaggaaaggacaatgacgaaacttcggtgtattccggaggagtgatggcctgacaaatgaatgatggaagaaagagataacatgattaaggggggatgtaagactacggaagaagggatgaaacggaaagagcggatgattggagtggaaataacgggtgacgggcttgcttccccggtttgggtaccgtacagggcgtacccgcagaacaatgcggatgttattatgcaggagattaataagttggggcagagcggggacggagatgaaaataagaaaacgcttttgttgtcggagcctattatgatgaaaattacttgcgtcacactgcccagtggagacgggccgaggaatgtacataaatttgatttcggatttaaggaacaccaacggataaggtaagttttttgagaaaaaaaaaagaaaaaaaggaaaatagaaaaaaaagaaaaaattataattatttattaaggatttcgaatgtggataaattttgtttgttttacgcactggcgtcgtcgatgaattatttaattatggaccgttttgcatttaatcgatttatgaacaatattatgagacagagggacgcagctactgagcttttacgtaattgtggaattgatattaacgaatatagctatggagtggagcacttatcgagggttcagaattatttggtgggttctaaaattttggaaaaagtgataaattaatggattttcaggatgagatttaccccggaaagtaccgagtggtggcatttgaaaagtcagctgatccacggaaatcaatccgtggttttgtggaagggccctatgggacgtgaaaatgtagtgccgatatttttggagaatggtcactgggatggtctgaagaattacgtctgtttttttaatcgtgggaggaaattttgcgttgattgcgaatgtttttattcgcgggatgtttttcatacgttggagtgccgggcgagatgttattattgcaacagagtgggcggagtgccctgtggaaaggagagtggagtgaagattgaatgcccgaagtgccatcgttacttttacaactgggaatgctacaactatcatcaaggacatacttgcaaattatggaaacgttgtgtgatttgtgacaaaacttatcagttcaacccgaagaaggaccatgaatgtggagagacttattgccagctttgtagtgtgagccacgaccccaaacgtggatgttatattatgccgatcgaagaaaaagaagacaaggacgtgtacagaattgtcgtttgggtgagattaagctaaaaaatatatacaaaatatgtcttaatttttaggattcggaaacatcgcaggattcgatttacaagggggaccagaaggagcatgtgattaattatatttcggtgagagtgacgtgtacggaatgctgtgatgataaaaatagggcgaattgcaaaatatgcggggaggagaggaccaaggattggagcgaggctgagggacatgagccgacgaaggattttgtggaatggattttaacggcatttacaaattatgatacgtacatttttgcgcataacgccggacgatttgacggtaaattatcgtttaaaaatgttttttattttgaaaatttcaggacattttgtatttaattatctctgccgtaccgggaagaacccgataccgcttatcaatggactcaaaatttatgaattcaaagtgcagaattcgaggaaacattcaatgctgatatggagagactcatgcttattgatgccagtgaaactcgagtcgctgaaggcgacatttaatttgggctgtgaggacaaaccctttttcccctactactacaataaganagaaaattatggaatacgattggaacatctaccaccgatggaggactattcgccgggatctatgaacaagngataatttatanaattcgaaaaatggtaagaaaacatgaaaaaacaacaatnnaaataaattttgttttcaggtaccacgaaaacaggagacacccttttatttgaatgacgaattgcgaaattattgc

SEQ ID NO: 25753 - DNA, 2154 bp, Heterodera glycines
  misc_feature (14)..(14): n is a, c, g, or t
aaaccagggatggnccgaggtttcgcatttcgcctttcgcattattcgcatttcgcttttcgcatttcgctttttggcgagaaatgcgaaatttccacccctaagaaatgaatatatttgaaaatttaatttttaaaacgaatgctttcagtttattatttctgttaacatattacactcaaaattgcataatggaaaaattcttcgaatttctccccacaaacgagaatttaaaaattttatgggtacatttttgaatataggcaatttttcgtaacaaagtgcacactcaaattttcaaattttttttcaaaaaatttcatttgggaaaattcccggttggtcccagtcccggacgaaaatcgaggtcccggtcccgacatttctggtcccggtaagtcccggtcccggtttttgtcaaaattcccggtcccgtgcaactctaatattaccttttttgctaacttgctatagcctaatacgcacgaaaacgagtttttaacttcgtttgaagcttttatcttgaactttttggtgcatttttttgccttttttgcgatttatttttttgaaaaacagtaaattttttgaaaattttgcaacttttcctaccatattttattacaatttccaaaaaattttccggcggcgattatcggcaccgccggaccttcattttaccttaatttttgaaattttaaccacaaaatgggtagaatttgtcattttttatctgagaaaaaagatcgaaccggaaaatgcagatttttttttgcatcacaacctcaaaagctattggtaaatttaaaaaaaaaattcgcttttcgcatttcgctttttcgcatttcgcatcgcaaatttcgcatttcgcttaaatttatatatttaaaaatgaaacaatcttgaataggataattggagcagcagtgcgctgaaattttatccaacaaggcgtggtgaccaattatatcttatggcaatttattaaatgctaacaaaataaaattcaaaataaatatttatcaaaaaattaactaattattaaatattaaaattttaaaacatattctaaaataaaaaaaaatttcaagaaaaaagaaatttaaaaagaccaacaaataaattaggaattttttaattttcacaagcgaggagagataatgaaacaaattaagacgaattgttatttaaaaacaaaattccttaacaaactttataaaaattgattcttacgcaaaaaaaataactaaaataatttacaaaaaataaccgtcaacctcaattgagaattcatacgatcctataccactttgaaaaaaatattgttatgaggaaaacaaaaatgattttattgttccaaactaataaaaagtaaaaagataattatgaaaacaataacaaacaaaaagacactaaatattaaatataaatttaaaaaatcaaaaaaaaattcaagaaaaaatgcattaaaaaaatcgacaaatataattatatttcaaataaaaatatagagacagcaaatcagacaaatatgaaaaataatttaatgaaaatagtttttatgttttttgtaaaattaataaacaaatttaatctaaaaaaaagatttatttgcggttaaaaaaagtttttaaaaacattcatttattagaaggacagacttattttataaacttgtgttctattcctttgaattaaagaaaatacaataaaaaaaaattctattcatttctctcaatttaaaaatgatttttaagaataaatgaaaaaaaattacaaaaatataaaaatagtaattaatataaaccgtttcgagacagaatttaatttaatttaaaactcattaaatgggaaaaaattaatattataatttaaaagctaatatatcatatgaaaatatttaaaaagacattacaaattcattcgcattagatagactcaaccaaaaaataataataatatttaaataaataaataatttaaaatgcaatgaaatttaaataataataatttaaataatattataatataattgattgaataatagtgaatgaaaatatcagatattttatatgaactaaatattctatgatatcataaaaaaatatttaataaataaaattaagatttgaataaaaacaaatttatttatta

SEQ ID NO: 25754 - DNA, 1856 bp, Heterodera glycines
agaaatagtgaattgaaaataaagaaaatacaaagatttgaaagtaaattaaaatttatatactaaatgtgtgacattgaaaacaatcctcgttacacaacgcgcgtcaacgatttttgaatgataataatcaaaagttaaaaagttgttattatttcaaaataataaaaacatattgaaaataaatgaaaaataataaaaatatgcaacaaaagatttttatttatttagaggcatttattgaaaaataagacagcctaaatcagatttcatatttttccattgcataaataaaatgtattaaaatttttaattttacacttttaaacataacgtgcaattgagaaaaatgctaatggaaacagacaagagtttttaaaaacatatttttttataataaaaattagaaaccttgtcagtaatttattataaaaaataattaatattctattgggataatacgaaattcttatttattcattaaacataataaaaataattgctacaacacatgaatatgcaatcgttgaattgtttctttttctaatatagtacaggatagtagagcttcctacattactttttgagctaaattatgatatattatttaaccaataaaatttaaattattaattaaatttaaatatttcaattattgatacgtttgccacttgggctcactacggttttataaatcatcattcaaatgcttgaaaataaacaattttctgagcattattacataaccctactaatattccaacttattaatgaaaattcaattttaattttaaacaacatatttttaaatacaaaaacaataaattgtcaacttattaatgaaaattcaattttaatttaaaacatttttttacatttttaaatattaatttctttacacattttaataaacattaaatatttgaaaggcaagaaaaaaagtaatacccaacaaattaattatgataattataaaaagtaagaagaaacttaatataatcaatcaaaagtatggttttcaaaaatggcctttaaactaagaaagagcacaaaaattatgtaataataattaaataaaaattgttttacataaaattaatacagattatttaaagtaaaagaccgtaatacatcaaattaattatcttagtgaagaaatgatagcattaaaatatttttaattgcttctgtatcctagggttcagccccgaccccgagccccccggcccccgacccgggacgttttttggatctattccccgacccgacctaaaatcgggattgagctgagtcgggatttcatcgggacgtcgagacgggatgagacaaattatctgataaaaattaatacaaataataaaaaattattaatttagatattttggtacacattttagggtttgtatattcttatatatttcgaatttaattttttttatgtatttcgcatccctatatttacgaattaatgtttttctatattgaacttcaaataaaatattcctgtttagaatttattttcaaacaaataataaaatataaaagaaaaaatgcgtttaaacaattataaataaatttctactaagtattaagataatttttatagaattgatcatgccggtagttgctgataacttaatgagttaatatttttcgttatcttttttcactttttcaaaattatgttaataaaaacaatccaaaaaaatttcggcggtgcctttcggtactgtttggcacccaaattatttatctatctaacgaacaataaaaattaagaaatttaaacagaaaaacaaaaaaatatatatgtttaggtaaaaaccatcctggtctgattgcaagaaattctttat

SEQ ID NO: 25755 - DNA, 1093 bp, Heterodera glycines
aaaaaaattcttgccgaaaaaatggctatctctttttctcttggggatttgaccgcaaacttggtaccaacatttgccttctctagtctgggctctaccaaacactcacacgatatttgaaatgctaacgaaaaaaattcttgccgaaaaaatggctgtctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctgtctcttttttctcttggggatttgaccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaaatcttgcccgaaaaaatggctatctcttttttctcttggggatttg

SEQ ID NO: 25756 - DNA, 1853 bp, Heterodera glycines
gttccgtctggggtcagttccgtctggccagttccgtctggccagttccgtcctggggccggttccgtcttgggccagttccgtctggccagttcagtctggccagttccgtctggggccggttccgtcttgggtcagttccgtctggccagttccgtctggccagttccgtctcgccagttccgtcttagtactcaaagggccggttccgtctcaaatatttttggactcaaattttttaaaatcaataactaatttagaaaaaaaagtaaaaattcttttactacgcagcctaccgcagcctaaatatacctggttttttaaaagttgtggttaattaaaagtatattcgaaaataaaaattttttgaaatgaatttaacattgcaaatgtccagtaattctgctcgggattctcagtcttggtcatcgtgtcgggaaatttagcagccttaatgtgtccagcactttgtttgcagcgaatccggcacccattttggaccccgaacccgaatataaagattaatttacataaatttcgtctaattttcaaaaatacacccctgagaaatgaaaaatttcctcaaaaattttgttattttatacccctaaattgaaactttaacacctattttgaggtttttagaaccgaaaacctaaatattttggcagtttttagttttgaacacccaaaaatattaggcatattaaatatcagggctgccaaaaacatgcaaatgtattttttccctgccttttccatgctataaataataggaaaaacacgttctttttttgtgtttgcgtagaaaaatcggtatttttatttgcatatttcgagatttttgtgcatatgcatattttggctacttttcgtgcatatttttggcagcactgttaattatatctcaactttctgttcacattctgaaatttaaaaaaatttgggtccaaaaatatttgagacggaaccggctcttttactactaagacggaaccggccccagatttatttagcatagagtataacaatacagatcaggcagaatttctaaccactcaatttatattgtatttttagtggttttttaaatttttttgccaaattttctggcactgaattgtcaatttttcaacgtacactgaatcttcgtcactgaatcgtcgtcactgaatcgtcgtcactgaatcgtcttaacactgaatcggcgtcactgaatcgtcggcactgaatcgtcggcactgaatcgtcggcactgaatcgatgcgaaatgcgaaaagcgaaatttgcaaaactgaaaaatgcgaaatgaaaaaaaagcgaaatgcgaaaagccaaaatatgcgaaaatgcgaaatgcgaaaagcgaaattttttctacaaatttttaatagttaaaatcataaagcaaaaataattttttaaaattttattccaaatttaaaaatcaataaaacgctttattgaggcgcgctttttccaaaaaaactttttgggaagagggggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattggaaattttgatcattaataaacagtttttcactgaaaattagccaatttataggtaaaatttagagaaattttatgggaatttaatccaattcttaggggtgt

SEQ ID NO: 25757 - DNA, 1033 bp, Heterodera glycines
aaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaaataataaacagttataaaaatttgatcgtctaaaaaaatttaaaaccaattacaattgttatttttgcagggttagttagtcctgtaccggggagtatgcctataaaatttggtacgattttattgcttattgaaagagctagagccgaagaaaatttttttaatttaagcctaaactttttggcatgtttaaaaagcaattaaaaattttattcatctccctttttgatagaaaaagcatcagagtgcctaaactagcatgtaaataaaatttggtgcgtttcagagctgtttctgtaaaaatatttatgaattaattttgcaaaaaataataaacagttaaaaactcagaatttctaaaaaaatttaaaaccaattacaattgttattttttcaggttagttagtcctgtaccggggagtatgcctataaaatttggtacgattttattgcttattgaaagagctagagccgaagaaaatttttttaatttaagcctaaactttttggcatgtttaaaaagcaattaaaaattttattcatctccctttttgatagaaaaagcatcagagtgcctaaactagcatgtaaataaaatttggtgcgtttcagagcagtttctgtaaaaatacttatgaattaattttgtaaaaaaataaataaataatgaaccctcctccttaataattttcctgcgcccaaggtactcact

SEQ ID NO: 25758 - DNA, 1165 bp, Heterodera glycines
ttgatgggactcataaaatacctttggactcattaagtgcattacagccaaaatttttaataccgatcctgcccggactcttacaaaaaaccagacaaatgaccggtcaataaatccatgagatctcgttaaaaaaagagaaaaccttttgatcaaatggtcaaatgcatgacggaaattgctgggcccactggtcatcgaacgggcgacatggaaacgagcaaactaaaaaaagtggaaattaaaatttgaaattattgaaattatgccaatcagacaacctccgatttaggcggtgacacgcaacagttgaacaacaatggcgaatttcgaggaatacgaagccccaacatttggtgaggatgaagaaaattgacgagaaaaatgcccaatcaaatcagcaccaattgaataactcgggactttttgcctaaaaatttttgagcaaataaaaataaagcgagaaaggcgggcacaaaatatttggtatgctgaaaaatttttccatatgaacagattttcttgaaattatgcgtaggcccatattttgacatcctcaagtttttgcaagttttggcgttctgctttattaaataaaaaattcgaattatttgcattgggaggcccaaaattgattcgctgtgttaagtgggggtaggaaacgtacgacttgtctccgtgtacaatagccatagcgtaaagaaacgagtacattattcatttatttccctataattttttacaagaaatttttttctaataatacatactaatgatttggatcatttgtaacatatatcgatcagcagtcctcttcatttgttgtcatcctccagcttccaccacactgtggcgtcggaatcgccatagattgggtagccaactaaaaggccaaagaatccaaaaaacacaatggcgccccatttgtccggcagaagggcgtcagctttcctgttgttgtaagtgtattttggcatggcaccgctggcgtagtggcgccgctgctggctgaagcataaattggaattattggaaatttcaaatttaaagccaaaacaaaaaagaagcatttgggaagggcaaaattcgaaaacggaatattgggattgacgggtcgccgatatccacaaattaatatagtccacattttgactctaatgcgctt

SEQ ID NO: 25759 - DNA, 1534 bp, Heterodera glycines
  misc_feature (66)..(66): n is a, c, g, or t
  misc_feature (73)..(73): n is a, c, g, or t
tatttagttggtgctatgtcatataaaaaattcatcaaccatgaaattttgcatgctaataaaggncataggngctattaccttgaaaaataataatttctaactaaaattttaaacaaaaataaacttatgtttaaaattttcattaacattgcttcaatacatagttttaatttttctatgttttttctatctttgaatataattcataaaataataattttaatataatttgataaatcaatttcaggtttaattgaagttgtgcattttttgtagatattagtttatataaattaaatatttcataataactaatataatttaatttaactaatctttgtttttctcgtgtttttttataatgtaaactcatgcgttgaacattgggaaaagattcgtcggcgctcattcatttttttacttcttaaattaaattcgttaattaaaattttagtttaattattgtaggttttttatttaattattttttataaaagtgaatatattccaaattatttcttagttttttattttaataaaatttaattagaatattcttttggaaaataaaactgagataattaatcttctaaactctcaattttctttactcatttttaagtgtttgaccattcaatccacttttattaggttttgttaaatttttatcttttaagtggtttgtttatttagttttgctaaactaattttaattaatatatttaagaaacaataatttttcgttttctttcatttattatatcgtacgctttgtcagtggcgccgattttgccgaaattgtggccatgttgcctatcttggccttcaccagtgtccaccacttgactaagtcgatgagggagcgcaagactgtcgtctttgtgccggaccgcacacgaatgatcagccatgcttcatacagccacttggccctggaccatctcgcgctgcgcgagtcaacacaaagtttctgtttagacttagacctgaataccggcttagttgggcccgaaaccaccaaatgaaacggtgagcaaaattcgaacccgattttagacataggcgcaaatgtccgaggcgcaaatgtttggctggacacgggacaatcagaaatataacatttgaacattttaagcatgttttgaataaattttgtaaaaagaggctttttacccaaaaataaatttttgacaaaaaatcataaacaaatcttttgcttatacaaattgtacattaatattaatttatgtgtacaataaatcatttagaacattattaaaaagtactgtcgaaaacatctggtacggtggataagcacttgaaaagatttgtcattattcagccaaccacttttaaaggtgcagaattacgcgattcaaaaaatagcaaatttcaaaaagcatttttttccctgataaaaatgcgctgattatgaatttgaactcggatgctgtaaaataatttttgttaattcatattcatcatgtttttagcatgtccaattctataatcttccgtaattttaagcgct

SEQ ID NO: 25760 - DNA, 1041 bp, Heterodera glycines
ttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctcttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttttggaatattttacgtctcaaagggtgtgcatttaagcgactcgctgtgcttgccactgcatttcaaatagctggtaattttatttctccggcctaatccaaaaaatcactatctctttttt

SEQ ID NO: 25761 - DNA, 1234 bp, Heterodera glycines
atttagtagtgatgctcgagaccaaaaatttcccgagactcgagaccgaggccgagactcgaccccgagactcgaccccgagactcgagaccgagacccaaaaccccgagaccgagaccaaaaaaacccgagacccgagacttttttcaaaaattttttcttacacacttaaaaatcgaaaaaaatcaatcttttgagttttctcaaaaatttttgtttttttccttatttaagctaccatacatttttccttttcatatgattgactttttttacaccattttttgtggtgctctttttcaaaaaaatgtttcgggaacaggggtccggcggtgccgataggcgccgccgggaaaattttttaaaattttactgcaatttgttaatggattttgtccaaaaatgacatttttacgattttaattgttaaaattgtgtttgaactcccatcgaaaaaaaacattaattttgaaaaatgagaagaaaaaataatacttggaggggaactgatccaacgcaaaaataaggaacaaaaccaagaacacaacccgctggaccacgcatatattaacaaaattgaacaaaaaagaacctaaaatttataaaaatagaagtttaccaaaggccaacaatcattaggggtgtaaaaaagtctcggtctcgagtctcgaaaatcgagaccgagacttgaaaacccgagaccgagactcgagaccgagaccaaaaaaaaccgagacttttctcgagtcgagactcgagaccgagactctcgagcatcactagtaaatagtcactccttttcccaaaaatgttctaaaataatgaaaaatgacaaaaaaagattttgataaaataattgaataattttttcaagcgaatatactaaaaacatttgtgaaataccttttactatgttaagaatttaaaaatttagcctattaaaatatttagaaatttttttattatattgtatattttttgaaaaatttccgatttcttgcaccgcaaaaaagtgggtttgaaaagaaaaaaatagtcaaatttatgaaccgataataatttgatttccgatcaactttttaccgtcggatccaatcgaaaaatcttagtcgacccatcagccccttctaatgcatcccgccagcccttttttggaaattctttgaatttaattgaaattttttcgattttccaaaatcccgcaatcccgcacgggatcccgcaaatattaaat

SEQ ID NO: 25762 - DNA, 1002 bp, Heterodera glycines
gtcccagtgattgaaatgtggtggggtgcagtcccagtgattgaaatggtgtgggttgagtcccagtgattgaattgctgttggtttgagtcacagtgatggaaatgctgtgggttgagtgacagtgattgaaatgaattgagtctcagtgactgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctggtgggttgagtcccagtgattgaaatgctgttgggttgagtcccagtgattgaaatgctggtgggttgagtcccagtgattggaatgctggtgggttgagtcccagtgattgaaatgctgttgggttgagtcccagtgattgaaatgctggtgggttgagtcccagtgattgaaatgctgttgcgttgagtcccagtgattgaaatgctgttgagttgagtcccaatgattgaaatgctgttgagttgagtcccagtgattgaaatgct

SEQ ID NO: 25763 - DNA, 2069 bp, Heterodera glycines
  misc_feature (196)..(196): n is a, c, g, or t
gcaaatgttttatttatttttaaattaatcagtttattgaacaacaaatcgcaaaatgcgatctgaacattcgctttataagctcaacttggggcggtgtgccaacaatttcttcctccacaaaatttcctccctcggcgactgttctttgcttcacacttcgcctgtcagggaaaatggccacacaaaactgagntaataaatatttttcttttttcaaaagcttttgcgtttaaatgcttttatttcgttttcagcggtcaatgggttccattgcccgccaaaggaaacgaaaaattgggaggaaaaaaaagataaaacatcgcaggaaaaggaagacggagagaaggggaaagcgaacggacaacggaagaaagagcaaattgagccgaaagcgtgggaagaggaggaagaattcgaaaaggtgggaagaaaacggaacaaatggacagagaggggacggacaatcgaaaataaattcaaattctattttcaatttcggatgaatgccatccttccccctcccccctcttttagtgccattccctcgtcgctttctccgtctatttcacttggttcgtcctcactgtccatgcgtattttcgcgagtttctgcgccgttacggaatcgagtcgaacaaagcggccgttgagcgcactgagctgagagtaataataattttattaaatttataacgaatttattgggttagagacggaacacagaaccgataaacccaattcgtatttgaatttaagggatttgcgccactcgtcgattctttcgaagcgatttacgcccgaaattgttacatgcgtgtccggtgagtgagtgttccttttactttggtttttgcttattccggtgaatttagcgatgtttttgagcggccaattggcggtgtgccaggggcgaaagtgtctgttcattcttttattccttcaaaaaattgataaattttcccgccaatttagcaaattggtcgaccgacaaacagatgacttctgctggacgttcaagtgctttttctgctgtttatgtgcttaacttaccaatttgaagcttttttgttcagatttcccggctctcaaacggaagtgataaatgtgagcagttacaattatttgggcttcgctcaaagcgacggcccatgcgcggaaatggcggcaaaagcagtggaaaaagggggactatcgacgtgtggcagtgcgcttgaagtgggtgggttggtttgcatctgattacaatatttggatggaaatttatttcaatctcccatgtttattacctgtcccgatattttgtggggcccaaaactcacatattccttaatttcaattttgacagaaaattgggtgggagaactgatgccattttcgagtccatttttgcccttttcattcacttttgacgaattatttaagtttattttccaattcaggtcagtgctcaattcagtccgacttggagaatttggtggccaaatttcttggcgttgaggaggcaatttgcttttcaatgggattcgccaccaattcgatgaacgtggcatgtcttgtggacgaggtgggcaagacgtacccaggaatttgacagggaaatgtcactttttaataaaatttcctcagcttaaaagggtggtgtctctacagttttcatttttcaggattcgctgatcgttagtgatcagtttaaccacgcttcgctgatcctcggcgcccgcatgtcatccgcgacaattcgtgtcttccgccacaatgacatgcccgatcttgagcgtgtgttgcgcaatgcgattgtttacggaaacgagcggacggggcgacccttcggcaaaattgtaattgtggtcgaaggcatttactccatggaggggtccatctgcaaactgcgcgaactgatcacactgaagaagcgctacaagtgctatttgtatttggacgaggcgcacagcatcggtacacattttgaacgattcggaaatgaaattgaaaaagaaggcattttaggtgccatgggtccgaccggacgcggcgtgaccgaatattggggttgtgacccggcggat

SEQ ID NO: 25764 - DNA, 1740 bp, Heterodera glycines
  misc_feature (26)..(26): n is a, c, g, or t
  misc_feature (1693)..(1693): n is a, c, g, or t
cgatcagatgtcatctcccgtccccncaggggtggggggatttctcccgctttattagccattgggtgcagcacagagaaaaagcctttgttggtacaatgctgcaccagcggaacaaaaatgtgcggaatttgccctcagtttgattttttacgagcatccatttgggtttataaaagctggcgactttttcgccactttttggggcaattaaaataaatatttcatttaaataaaattaattttatttttaaatattttcccgactagcggtgaattttgggtcattctcagagatttccatattttgtaaaataaactaaatccagaatatcgcagtggcagagaccccctccccctaaaaacatggaaaaatgccatttaaaatatggtattctcagcgatcatttaaattttaaattatttcgaaatttcttccgcgcggcgaaaatatatttacagcagcggcggcgggtgaatttttattttttgtttgttctcccacggccaatcgtccgccggcggagagaatggcaaatattttggcagccaaaaaagcagcttggccatctcatcatcatcatccttcttttttttttttgagtatgtccaggccaaaaacattattatttttgctgttttagaactgaataaataaaaaatttaaaataaattccattaaaaaatctttcaaattttggatggataaataaaattcatatttgatggaaaaatgataaattagtcaaaaaataattataaataaattttagaatttttacaattaaaaaaaacaaaaatttccattgccttttaaaaaaattattatattttttatttttaaaaaaatttcccagcctaccaaaaaatgaataattttggcaaaaaatattaaaaaattataaataaattttaggactttcaaataaatttaatttacacacaaaaaaaacaaaagcttccactgctttttttaaaaaaatattttttatttttatttttaaataattttccgcgccccaaaaaatgaataattttcacaaaaacatcatcttttttgtaataaaagttaaaatattctcaatccctttttttgttcacaccaccaatcgcatgagaacctttgaccaaattagcaattcatcgccccgggggtgccggaatgaacgaatgaatccccccccccccggggcattctttttctcccatttttcatggcattcgccgccgtccccccgcgggtgccagtttactacggcaccaaagtcacgcaaatgcggcgcaggcgatggtggagtttcgctttcgtaaaataaaataaaaacaaaactttttcatattatttaataaatattttttggatttttaatttattaaataaattcaatgattggttgtcctttaaaaataatttacaaaattattttaaatttcaataataagataaattttttgcattattttcagactttttaaagtgttttatttattaaaaaaggcccaaaattaaagtaaatttgcttttaaactgatttctgttaattgatcataaatttaatcaaaattttttatattttcaaaattttggtttcctaaattcagccaaattaattttaaaaatgagaaaattctctttttttccattttaaatttaaaaagtgcactaaaatcccttcagaatttgtccccccanaatttcgagaggtaaaaatcgcatcattttcctcccatccgtcgccg

SEQ ID NO: 25765 - DNA, 1265 bp, Heterodera glycines
  misc_feature (1234)..(1234): n is a, c, g, or t
attttatgaaaaaatctaaaatttttggcattttgtcccattatattaattttttactaaattaacctagaaatataaaattttcagtgaacatctgtaaaaaaggtcaaaaggtctaatttttctcccggcagcgccaatggctccgtccatcctccccccaaaaaaagaactcactttttttaagaaattgtcgcaaaaattttcttattttttggtgaaaatctgttaaaaaatctcacaatcaaatcttcaaaatttttacagcggcgcctattggcaccgccgtacccctccccctcaagttcccaaaagtctttttgaaaaaccgccgcaaacattccggtgaaaaatagatttgaagttaattaaccttttttaattttttttgttcaaatttttatgtgtactttgatttcataaatttcccacgttatgtacttggaaattggtattagcactgatctgagcccggattcgtgatcagcgacctcaaaaaccccttaaacttattttcattaatttctaaaacacatttattggcatctgaaagtgtatgtgaatctgccccgtaaactaaaaaagtaccattgtttttcgttcatttctgaccattaggcaaacccctaaaatctatccctagtaatgatataaaaaataattagcttacctatatgtattggaatttgattttgaaacaaacgaagcttttgaaatagcaggctaatagaaaattataaattgattcaattcggttttttcctcgaacagattttttcaattttgcatttatataaaaatttctatcaaaaatggcgaatgttgatttggcattggatgaaattatctcgaagtctcgccctcctcctcctcctcccgcaccacaacaaagaaactttggtggcaagcgaccatttcgaatgaatgctaccaatcgtcccgggttcggtcgacgcaattctttgggtggtggccaacgttttatgcgttccggaagtgacaatgttgtttggattaacatcgccaaccttcccgacactgtgcttactcaagaccttcaggtgcatttcccatatacctaaattacatttccattctgtctcatttaaggaacttttcgaagattacaatgtttttggaattggtgtgcattacgacgaatttggcgctcatatgggaactgctgatttatttgtggatactccgtcagcggagtcaatcattcgggattttntcaacgtggcaattgacgatgcgtgaaaatt

SEQ ID NO: 25766 - DNA, 1143 bp, Heterodera glycines
ggggggaccccccggaaaacaaaaaaaaatggatttttttcaagggtccgttgggggttcttcaacaattatggggaacaaaaatcttccttcgggggaacgtgccgggtaccgcggggtaagcagtgctggttcgtttcatcacggcaccgaaccttttggctagtcagcaatcgttgcttaacttgccagatcggacgggtgcgcaaaattccattttttccaagcaccccaccaaaagcaaaacgatataaccaaaatataaggaaaaattttttaaaaaattttttctccatcttcctttttgatactaaagcatcagattcctaaaattaagttgtaaataaaatttggcgcatcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggagggactgccccgaaaacaaaaaaaaactattttttcaagcgcccggttggggtactccgacaattatgggggagcaaaaataccaacgcagaattaaagtacaggc

SEQ ID NO: 25767 - DNA, 1558 bp, Heterodera glycines
ctatttcgggatttttcttcactaaaattcacgtccctattaattaataagattagaacaacaaaatgaaaaaatagaggtcataaataatattaaaattaacaaattctggcaatttttatctgattaagaagaaagaaaataatgtgccaccgcaaagtaaatttttaaaatggacttaattcataatcgagtgatttcttgatgattttttagaaatcttaatttttaggcactgttagacccccaattctcattattgactgcgtaggcccgaagagagtcgccctggttagctgacttttgcgccgcggacatttgcgccgctcattaaaaaatttataagattgacccaacaatttttctaaattagaatcgattgatattcaatcaataatcgcaaaatagggacgaaaaattaaaatctgtgcttttttcaaaattaaaatcgatgtaaataacttttcaacaattttaatgacaaaatacatacataaatttcatctttttttgaataaaaagcaaaaaatggtttgtttttcttacagaaaagataggggcgttaaatgaagaatttttgtgttaaaaatgtgtttctcttttctcattgattaaaagccgcagaaaaaaataactaaaaacctaaaaatccacctactcatcaattccaactattttttgagccgtgggaggtcaaaaatccgtgattaggactaattcaaacagtgtcagtctgtttagttgttattcttcttcatttttcatatctttgatgaacctaatcaatgttaagatttttaatgattaaaaattaaaaaaaatattgtctatctttaagactagtgattttttgaaaattttcaattcgttatttttgtcgttggtttttagaaaatcttattgatattagtgaaattgaaatgaaaatattatttttgactgagcggcgcaaatgtccatttttgctaggcggcgcaaatatccgcggcgcaaatgacgtggcgcaagtgtcgacttagctgagcggcgcaaatgtccaattttgctgtgcggcgcaaatgtcgcatcacaagtcgccctcccgccaattagtccacagaacattccacaaaaaattccaaatcgaaattttaccaacaatttgtgtcaaaaataagcaattataaagccaaaatatacgtattattgaacaaaatcaaatataaattagaatgatttcgtcaattttaaataagttcaccattttggtattttgaatgcaactatttatagattcaatagggggagataattagagatggacagatgaatggagacagggagattattttaagggtagtactttagatggtacccccctttttggaaaaaaaaattttttcttttcaaaaatcatgaaaagatgtttccaagggttttctggtccgctgattacgaatctggcatccatttcaaccaattcctatggacccgaattcgaacaaaaagtcgaaatttcagagttgtcgaatttctcatttttagtcaaaaaaatgtttaaacattttttaattgaagc

SEQ ID NO: 25768 - DNA, 1791 bp, Heterodera glycines
  misc_feature (21)..(21): n is a, c, g, or t
aggggtttgaaaagtttattnttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaatttttcgaaaatctgagtctttcgtttttatttattttttgcaaaattaattcataaatattttttcagaaagggttctgaaacgcaccaaattttatttacaagttaataaggctctctgatgctttttctatcaaaaagggagatgaataaaattttaaaaatttttaattcctttttaaacaggccaaaaaatttaggcttaactttttagtgaaagtttgatcactcatattttttgctaattgagcagaagcataccaaactttgcagggatactccccggtaaaggactaacttacactgaaatgagcgccgagctagcttgctcaaaaaatttttcgaaaatctgagtctttcgtttttatttattttttgcaaattaaattcttaaatatttttcagaaagggttctgaaacgcacccaaattttatttacatgttagtttaggcactctgatgctttttctatcaaaaagggagatgaataaaatttttaaaaatttttaattcctttttaaacaggccaaaaagtttaggcttagctttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatattatggggagaccgaatccttccggaatagcttccctata

SEQ ID NO: 25769 - DNA, 1014 bp, Heterodera glycines
tttctttctttaacatttaaacttactttcatttaccgaaaaacattaatattatcttttaaaatattatatttttatttataattgataaatattttttaattaatttaaaaagaaatttaaatttattttaaaattcatggtcatatttcttgtgcaaaagtcaacaaaaaaaaaccacctttggggtgattttttatttgtttaaatattaaaatttgttgcaattattatcttgtaggttttatttatgtcctaatcattctacataaaaataaaatttagtttttttaataaactctttcttattaatagtatttgtttgtaattatcatgtaagaagcaataaataattgatttatttagcaattatttatttttattagaaatttgtaaatatttataaccgagactctcgaacttgcttaaaaatactcttagttaataataaatataaattttatttagtttttaataatttaaaattttttatttagtaaaatttaatccgttttttaataattcaaaaagcttttaattcttttcaattaaatcatatttctttttaataaatgaaagtttttttagacttcgctgaagtattatattttttaaatacaaaaatttgatcgaattatttaaagtattttatatttctgatttatgtaaaataattatttttgttcttgttaagcaaatcaattaatcaatacaaattatttcatttgtggaaaatgatttagtacttttattattttaatatatatttgttatttatttttttctcttatcattttttatattttaatttcatctcatgcttaggtcactcaccttgatttgtaaaatgggaggtatctatttgtttacgttttattaatatttattttcttttatttttattaaaatatctttatatgttgttaatttttcaatgataacaatggttccctgggggaatatttattctataattttcaattatttgcaataaaggttttaatttaaatttat

SEQ ID NO: 25770 - DNA, 2176 bp, Heterodera glycines
  misc_feature (802)..(802): n is a, c, g, or t
aaaaaaagcgaaagcaaaatttcaaatccaattttttttattttttattctttcagacaaacattgtatggctgttttccccgtttttcccattgtttggcattctttgcgctctttacaccatgggaaaatgtcgctttatcaaactgccattttttggtagagtccggaacccccaaaaaagtttctcggaatcagtctcaaaaaagttccggaaccgaaaccccgatcccaataaattaattttctattattttttcgaagagttgtcgcctttggccccatgcccttttgtgtgctttgctcataaattttcaacggcggctccgttgtgctgggcgaccgttccgcgcatcgggtgaatttacatttaaatgccaaattaattttaatttattttttctaaattattttttatgtattaatttttatatttggcaaagttttgttttttgctgcaagacaaaattatttttatagcgtcatttaattaaattaaaagtgggagtgaacatattttgtttatcaatttttaatttttcgcaaatacattataagaattaataaatttaaattaaattcaaaaaatggaagtgtaaattttaatttttatatttacattttaaatcattttctatagtttaatttaaattaaaaattcgagaaacttttttaaactttctacatataaaaaaagtatttttcattcacttaaaatgattattaattaattttcagtatttctcttaagtaaaattatatttttctctttttaaattatttttcatttaatttatattanataaattattaatttattttcagtgtttcccttcttcgttttgctctccctgcagcactttttgttgctttttcattgttctcaattgtccatttgttcacacttgagcacccgtatttgctggcggacaatcgccacttcactttttacatttggcaacgcctttttcaacggcattggcttgtcaagtgattggaattattttttcggcatttttgccatcatttttttcccaaaggtatgccctcgtgccggcctatgccatttgtgccctgttcatttggcacacaatggaaacagacactgtgactaaagtggagcaaattatttttaatttttaattttattcgctaattggctcaataatttatgaaaaggccagagaatttctcgagttgagagtcgagcccagaaacagagtgtgatatttagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttaggatgtatttttgaaaatttttaggtcgattcttaggggtgtatttttgaaaattttttaggtcgattcttggggtgtatttttgaaaattttttggtcgattcttaggggtgtatttttgaaaattttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaatttcgtgcatttctcgtcgagttaaagccgcagaaaaaatagttaaaaaactaagaatcagatccctatttatgagtccaacaaataaataatcctttatttttaatgccatataccagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttggtaagagggggcagg

SEQ ID NO: 25771 - DNA, 1400 bp, Heterodera glycines
ggagagccgcggaggaaataacaggagacttaaatttcatggattttcgtttgatccgagtagaattttttttctcaatagcgtccgttttattaatttttttttgtggaggacggagtttacattttttcccatgctcgtcgaatattcctctctctgttcccgtcccgtccctcattccttacccctcccccgtatttcgcgtaatctcccatattcccttacatgcccataaccctgtcaatctggcactaccggtgccaatcaatgccgcacctgtgccattagctactgcacgccttccacagctcagtcttcccattttttcgggcgaaccaatggaatggccagcattttggcagagtttcgagagtgccgtcgaccgtgccgcccttgagcccgtcgacaaactcaactatcttcacggttgcctacgcggtaaggctgctcgtgccgtaaccgcctaccgtggaggggagaattacgcccatgccgttgccgcactcaggcgactcttcggagatccacggaaaattgccgaagcacttcagtccgaactgatcaatctccggcctgtggacgatagcgttggatcactgcaacacttcctcgagactttggagcgtgtgtgccgccaacttttgaacctcaacatgccggatgacagcccattcatgtaccaaatcatccgcagcaaattgccgtcgactgttctgtccgaactcgtcaaaatggaacgtgcggcaggcattccatggggtactcctcagctcagagctggacttgccgaagttctcggagtcagagaagaggtcgaacggtgcctgcgcgaaaccaataccgacagacaaacacgatttcggcatgaagcaaggccaagtcgaccgcagcgaccagaacggcacgaaaatgcgcgtgttttttccgttgctcagtccgttgtgaattccggtgaaaagcgagtgccttcttgcctgttttgccctggtcagcactgggccgcagaatgcaacaaagtgacggatacagagaatcgaaagcgatgccttttgcaacagaaccgatgccttaattgcctacggaaggatcatcaactgaaggagtgccgatcaaaacaagggtgccgcatatgcaaggaacggcatcattcatccatctgccctagtgcaaaagggacatcttcggctcgccaaaaacaacctaagcccttgcacaagaacaaacagactttcggaaccgagcgtaactcaaggccattggtgtcatccgcggttgccaatgatgctgactcaatccctgagccgaaaattgttaacacaatcatggcaattgtctccccatccgttcctcatctcgtcatgatcatggccctccgagctcctgtgttctccgaatccgca

SEQ ID NO: 25772 - DNA, 1067 bp, Heterodera glycines
  misc_feature (48)..(48): n is a, c, g, or t
  misc_feature (74)..(74): n is a, c, g, or t
tggttcgtttcatcacggcaccgaaccttttggctcgtttaaagtcgntgcttaacttgccagatcggacgggngcccttgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagatattcccgaaggattcggtctccccataaatctcgtagaagaggttcagggggactgccccg

SEQ ID NO: 25773 - DNA, 969 bp, Heterodera glycines
  misc_feature (928)..(928): n is a, c, g, or t
aaaattcgaaatttttttcaatttttttgaccctcgggattttggggtaaattttgaaaattcatatctggcctaaggtttgaccaattttgattaaataaagcattaaaaatggagaaaaatcaggagaattttatgggttttatttggatttttagcataaatatgaaaaaagttattccagaaattctggaaaaattcgaatttccagaaaaaaattcagaactcggttctgaaaagtcattcttgaaaagtaaaatactataaaaatccgcaatttttagctctattttataaattttatttcacatttttatcacttttttgaaaaatgttataaaaataaaagtgattttggaattcgggaccaaaggggggagcacatggtttttgagtgaaaaaattttttcgacaaaaatcttccaaaaatatgtctttaggggttatttgaggctgctgatcatgaatacgtaatcagtttttacttttgacatcgtttagacctcagaatccccgtgtgattggggattctggggcatcattttgagaaggggaggggcaagttcggatccgggcggtgtacattatttttctaccatttttttcgtgtttttcaatttttattcatttaaaatattttttgagttaataataaaaaattatatttaaattaatttttttttaatgaataaattttataagtttaaatgaattatttttttaattgatagaatttcatgtattttttaaattaaatttgttaaaaaatattttcattttaatttaatgaatttactaattactgttgtacctcttccaatcactgttgtacctcttctaatcattgttgtacctcttctaatcaatgttgtacctcttctaatcactgttgtacctcttctaatcactgttgtatctcttctaatcncagtgcacctcttctaatcactggtgtaccctctttaatca

SEQ ID NO: 25774 - DNA, 1128 bp, Heterodera glycines
ttttcccagcatgggcagaggggcgcggggaccaatggccatttatttttccagggaattttattattttttctctatgccagaaaaatgtctatcttttttttgtgagaaattttgtaacacacaaatgttcccagcacgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtcccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatgcccattctattctacagggaatttttaaaattattctctatgccaaaaaatggctatctcttttttg

SEQ ID NO: 25775 - DNA, 1172 bp, Heterodera glycines
tcaaaaaatagttgctaaatggattgaaagcttttaccccatgaaaaatataacctcataaaaaaattttcaactttttgttcgaattcgggtccggggttttgaattaggtaaaaccgggttaagactcgtaatcatcaccctcgaaaaccccttaaagttggtttctagcccaaaatttagaaaaatattttttaaaaattaattagggatcacaattctttaccattgccaaagataaacatttatcagaaattctgtgagccctcaaaaatccacagagttcaagtcatccgtatttgtttgacaaaaaatccgcaaagaataacaaaacaactttttgaatgttttttttttgttgttattataaacattatgccaaaattttatttaacaataaaaatgaagtaaactgaggaacaaatttagcctgtcaaaaagttgtagcttgtagtcataagaattttctgaataacaagttatggcacaactgtaagagcccttttgtggattgtgaaatgcatgcaatagagcccaagtttttaagatattttagcccctaatattcacatattatgcaatttttgtttaagtccattttattcaatcactttttttagcaacatatttgttttaatataagcagcaatggtggggagaattaaaaatgtgtattcgaaagtctacgatgtgccaagacgtccgttcgagaaagagcggcttgaccaggtttttttttgtttcattactgccacattcaccgtttgagttttgtatcagttatccagaattgcaaggcaatggattacccttttattttcattatttgtcgggcatttctctatgacagggtgtccgccactttagattaaaattggcatcagtttgtgttagccctaatttaatacaaaactcacaaaaaaagaaaacaaatttttgttcatggttgctttttaaacgtccgttagcggacccctttttaaaattaattcaaattgccccacaaagggttcaaattctttacatttaatagacttttaaatgttttcaacgttgtttgggtttggcggactaactttagcaaaattatgaggcaaaaacccagtttacatttagtttttccgctagcagtcgggaggtattcgctaatttgatacatttttccctacaat

SEQ ID NO: 25776 - DNA, 1345 bp, Heterodera glycines
ctagtttctactctatatagaataatgttgggtttcgtttctaaaaccaaaatctcgggaacgggcgccgggaggggcgcgggagtgtgacatcacttaaccaacttttgacggcgcatctgggaaaaatacgggttttccggtccggtggccaactgagcgccagcggcgctgaaacggcccattaaaacttttgtccgagtttgccggcctgtatctttgcgggaagaagcgggagcgaaaaatgcttggagaaagggcactgcaccgaacaatttccaacatttttcgtctccaacacgttcccgtacgactaacggtattcacggtatgcttgacagaaaattgtatggtcaaaaaccggttttttgaatttcgggaataactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccacttgcaagcaaccgtttttcgagctctatcgattggtggcatttttgaaaaaatttcaaaattttccggaaatagaaaaattttccggaattgagctccccatttccgttcaaggcttataactcgtcaggcgttgattttagcgaaaatttgtcttagagcatttttgtagagaattttaagctctatctaatgtgctttatttggtctttttatctttaatataaaaaaagttataaaactaaaatgaatttttaaatgcaaaaccaaaggggggaccccatggatttgcatttcatgagaaatttttttgctcctaaaattgccaaaaaatacttttctggggtaatttgaggtgctgaacacgaatatgcactttatattgcgttttgaattttttggagggtggtaaaaaaattttgaaaaatcaataatttttggcccttgaaaattcaacctaaattttaaaaattcataactcgcctcaaaattgtccaattcagctcatttaaagcattaaaaatcgagaaaaatagggagaattttatgagatttatttgaaatttataccacaaaaacaaaaaaagttattccagaaattctggaaattttctatttttcagaaaaaaatttatatctcggttctgaaaagtcattagagaagagtaaaatactataaaaatccgcaattttttgctctattatataaattttatttgacctttttatcatcttttaaaataaagatacaaaaataaaagtgatttggcattcg

SEQ ID NO: 25777 - DNA, 2741 bp, Heterodera glycines
  misc_feature (1802)..(1802): n is a, c, g, or t
gaagaaaaaaatcgtgatagagccttaaacatggccgggattgagtccgtttttgcattatcccaaatggcacttctccaaactttgaagccctgattgggcaacgaattggagatttccttctgcgtgaactcggcaaatgtcagaaagccgatcaggccgaacagcgccttgaaaacggcagcagcgctgtgggacagtgccaacatcggcttgaactcgtcggcatccttttttgggttggggtaaggagaagtgatatccggcattaaaacatggacggacggacctgcatggagccctcgagagcgggcaaaaagatgtgtgaggtgtagccgaacacgacggtgccgatcggaaattgggggcaattaattaattagtggatagggaggggaattagagtcgatccgtttctttggcgccaccatttttaaagtggtttaatcttttttgatttacccgtccaaaaaaggggcgcgatgtaaaacagacaataatcttaactaattttccggctaatagagttagttaagcgctttcaaattttattaggtttatttaatatagttgataagggaagaaagtattcatttggcgccaaaacggccgactttctctcccccaattaataatcggtcaaagagtaaaaggaaaagccgggggtgacaagcccatgtcagattaagctataagattttacctatgaccatacaactttctctgatcattatgtgattgtgtcgaaattcaattccccttttaatcaccacagtggggaagaggcgaaagtttggcacaattggcagtgaggagaagcgccactcagaaaactgtgagaagcggacgggggggggaagtgattaaatagcagagccaccagcaaaacacctgactcagacagtagaacaccttgaacaggttgggttgacattattacatgatgatggcattatcgcaaaaaacagtgtaccatgatgccgttgatgaccaaatgggagacagcatttgccatggaaagattggacaccacgcgcaggtcgtccaaaaaggcggtggccagaagcacaacggtggtcagcatcatccaagcaggacgatctgagggaaaagcattggatgaacaaagtgatcagagcgaatgccaatgagtgaaaaaaacccagtcggtcgagagtttcgaccaaaattttaaattgttttttctttcgggtttttagagcagttttcggccttagttttgaccggacactatcaatcgggcttgtattttgtcacatgtttgatcaattctcggcataatttgtttggtatgccactaattgttagccaattaagtgcccccccccccatatttggcctgatcatttggtcacagactgtcccttacagatttgatcaacaacaaaaaatgggaaaagcaaacgcaccgacactcgggaagcagccttggagcaggtccccggccagtacaatgtacagaatgcaacttaatttgttggatacttaggttgttgcacatcggtgtggcaaaaagataggtaaaagaattggcaaattttaaaaaagtgccaaaaatggggggaagtttttttaaatgtcctattaattattcattttgcgtttcgtctgcttacgtgctcgcaagttcggtcagctgcgcgatgagtacaaatttgccaagccccggtcgcaccgcctcggccacttcccgataactgaatttttagggatttcagtgtcgtttctgggcaactctgttctcttaggtaaaaatagactctcgaacatctccagcaggnatggcattccgaggcacaaaatttttggaaaatcggaattctgtgccatcccctgatctccagtgccttctgctactgcccaacgtttcacctccgtctcacttttcgtcgcctctttattttctgctgtgatgagtgatcagtgccatcagtcgggcagtcctcgtaaaggcactcgatcagaatcagaccctggcaaaatgataagcaaatgaacggtagaatatttgggactgggaccgatggagaaaagtgccaggtttttgccttcggtaacaaaaaactaagccgataggtgtccaggtaaaagtgatcagaatcatcagacgctacccgacggcaaatcaacaaaaaagtactaacagtgcggtagcaaatccaggcaacgccggtcagcgcgagaatggcacaccatccgccaattttgacggcaaacggcagcccgacgatgaacatgcctggcatacagttcttatactgctccaccaacagcccaaaaagggcacatagaaaatgcgtcagtatttctaattaaaaatttgcctaaattttctaaaatctcaaaaaagggagatactgtaacgggttacggtagatttattttttatttattttccttttgcactgataaattttttgttggtcaagaaaaaagtgagaagatgcttttctcaaaaattaccttgaatggcatttgtcacattcctgcaaaaataaataaacaattaataaatgagataaaatgaattttccaacgcaattttctgcgttttgactcaattaatcttttaactgatttttggtctcggttctcgcattaaaacaaaaacggatctgctgatctattgcagttacagcatattgttttgattcggcgattttcacaaaaatttttccaagtctgagttccactcaaaagcttttcacaagatcaattag

SEQ ID NO: 25778 - DNA, 1570 bp, Heterodera glycines
gcaattaaacaattaaattaattattatttaaactcttttataattattaatgcacctgtagtcaaactgttgcattgccgtccatgttctgagtaagaaacgatgcgtcggtcggtgcccgctgccaaaatgccaacggcggacaacaaaagcgcctggggggcacacggatggacacaaacctgacttttcaatgattaaattttacccttttttcaaattaattaccctggcatgggagcgcgtttcgaaggagtacaaaaatatagtgccatcagaatgacccgacaaaaaactctttcgattggggctgaacatttgaagggtttttttatattttaattgtaaaatggttactgttgggccaatacagtaaccgctgtttctgcccgatacaaagttgaacatttgttggaagaagcggacgcacaacggacttttccgtccaataaacttattgcaaaattgcagatttaaaacctattaattcaccccgattgatcacccaatgatcaatttgctctcggttggccaacattgtgccattacggcgctggactgtgcaaatttgttgcagatcactttcttctcattcctggaatatgcatttttgcataaaattcaacaatttcaagttaatttgccaagtgtctccgagccgatagacaaaaacgatgtgatcagtttgaccaacggccaatttggcggagtcgggcgagaacaccgcgcatttgatcagataactcattttgccgaactgagaaaaacaaaaaacaaataaaaattcaataattgcccataaaatgttcggcttactaaatgctaacaaagaaaaagcttaacaccttcggttccattggttttgtgccgaatttgtcgcgccggcggaatttgtcgtcgaacagcaaaatgtgtctgtccggcgttccaaccgccaacttccgaccatttggtgaatagcacaaagcaccggcacacgaaatttcatcctaaaaaacaaataaaaataattttaaataatttaaaataactttttaccgatgcactgactacactgctcaaatattttaatcgcattaagcaaaaaaataaataatataaagagtaatcactttgcttttgctttagcccctttcaattcattcattggtaaccattggcaaccaaagaaaatcgaaaagctgctgctaaaggacagagaaatataaattaaaagtagagtgccacgggaccggtacctggtagcggacaactgagtacaactgagtaccaaggtcccggttttgaccgggaccggaactagtcccggttttttcccggctttcccagccaaaaattcccggattttcaacccgaaaaggtccctgtcccggctttgcccacaattcccgttgcagtggcactctaactaaaagtattaaatgaaattattgaacaattatgaagcctaatttcatattgaaagtatttgctcgaaatatctaaaattttccatataagtggttcttctatattatccaatttcagatggtacagaatacgttgtaaaagacgtagaatgtactgaaa

SEQ ID NO: 25779 - DNA, 1011 bp, Heterodera glycines
gtcatttttattggtagtccacagtcggaattatttaccgtacgtcgcctaaaatattccaatagaaaactgaagattcaataaatttgagagttcaaaaaatattttcgaatatttctccttagcggtcattttatttggtagtccacagtcggaattatttacggtacgtcgcctaaaatattccaatagaaaactgaagattcaataaatttgagagttcaaaaaatattttcgaacatttctccttagcggtcattttatttggtagtccacagtcggaattatttccgataggtcgtcgaaaatattccaatagaaaactgaagattcaataaatttgagagttcaagaaatattttcgaatatttctccttagcggtcattttatttggtagtccacagtcggaattatttacgggacgtcgcctaaaatattccaatagaaaactgaagatttaataaatttgagagttcaagaaatattttcaaatatttctccttagcggtcattttatttggtagtccacagtcggaattatttccaataggtcgtctaaaatattccaatagaaaactgaagattcataaatttgagggttcaagaaatattttcaaatatttctccttagcggtcattttatttggtagtccacagtcggaattatttacggtacgtcgcctaaaatattccaatagaaaactgaagattcaataaatttgagagttcaaaaaatattttcgaacatttctccttagcggtcgttttatttggtagtccacagtcggaattatttacgggacgtcgcctaaaatattccaatagaaaactgaagatttaataaatttgagagttcaagaaatattttcaaatatttctccttagcggtcattttatttggtagtccacagtcggaattatttccaataggtcgtctaaaatattccaatagaaaactgaagattcataaatttgagggttcaagaaatattttcaaatatttctcctta

SEQ ID NO: 25780 - DNA, 2249 bp, Heterodera glycines
gtggggtcggcaggcggacaaaaaaattttgcaaaatgatttaaaaaaagaaaatgacccttgcctggcaaaaatatttcttttccgttccaatgtttcgtccaaaaacagccttttgcgtggtgttcgggtcaaccacagtcagcgacaggttgtcaaaaaagccaatttcgacggcctttgccagtgacattggttcgcgcattccgtgcaaatgcaccgtcccgttttccgtgttcaaaatcctttcaacaatcgcctttccgacgttgtaaccatgtaatgtcacttcgatggtgccattgttttcgttgtaagcgcccatcaccgcctaaacgaaaaaaatggtataaaaactaacataacctatgcaaatttttaaatttagaccatttcaaaagtttcacatttggcctcttttaaaaaagcacccgacaaactggtaatgccatttttaatcctggccaggtttatgcaattattcctttcttaattcgggccctggctttggcaattcaagggcatcttttgttcttattattttctttacaaactttgtgtccatttcctcgctctttttgttcgtttggcgccttgccagtcgtttctcccttattttaataaaaaatgatcaaattagaaggaaaaaacgcatgtttacaaaaaattcacccgacaaaatgtaattcgatatttaaaacaaatatgtaaattgatgtttgggcaaactacgacaccggagataccctaacaaaaaaccattgtactcgtaataaaaaacattttgttggaaaactacaatttaatacttgactgtgtaaattggcatttagcattccaactcataaagcagaaaaaaatactaaaaaccaaaatgataatgtttgagaaaacccatgaatttatttatcggttcttccgaaaacaaaccatttttttctcaatcgtctccactttcgccgagagattgttaacgacgcccgatagattgttgacgacgcccgatagattgtccagtttcaccgagtgattgttgacgacgcccgatagattgtccactttcgccgagagattgttgacgatcgccgagaaactcatcaaatcggttagcagttgcttagaaaaagcggcgctagttacaagaaaaattcaaaaaggtccttcttgtaactagcgccgaaaaagcttcttctcatcaatagctttcgaatgataccaagatttcaaattttttgccagttgctaaaaacctttacaggagctctttttcgggatggtgtggtaagtgagggacccacgcgtttcggcgccagctcgtttttccacttaagcttttttctttggcatccaaatccaacaattttggtatcattcgaaagctcttaacatgctctattagccttatcaaaaacgaaaagtttttcaagcctgtaaaaattttattaagaaaaaacttcaaaaatttcgacttttcgcaattttcatgcataactgttttgataattgtctaatcgcaaagcaatagcttagaaaaagcttctaaatagattaagctttcgaacgacaccaacaatgttggatttggtttacaaagaaaaaagttatagccaaaaacatgctggcgccgaaacgggagcgccgaaacgcagtggaccccgcagaatccactttaaattcatgaacataatgccaaaaagaaaagttctggatttttcttttctcagtgcagtgtacccacagtgttctttttttgtagtttataaatccaaattttttctttactcaatcacttttgtgaatctacctaaaattgtaaagcaaattccttccagtttttcggatgagccgcttctccctgtccattcatgttccttttcaaacaaatgatttataactgaactttccctccccactttcgttgcactttttatgaaattttctttgctcttcatttgttaagttcatttctcaccccattccaatcgcaatccccagaaaagaaatattcgctccctttttccctcatttgctcccagtctctctctttctctgtctttgcgtacgcacgtccttgtgtggtgaggacatgccgagagttagcatagcatgtcgttaggtgaatgagttgagactgaacataagttccgttcgctctccgtcgcttttctatgtccctctctttttcgatttttcaatcctattttcaaatgtgtatttacattcaatccattctcctcccatttttctct

SEQ ID NO: 25781 - DNA, 1144 bp, Heterodera glycines
cattgcccttttgccgaattctgaattagattcagttctttattttagcccacagtttggacgcaatttcgaattccggcttttttgtgcccgaaattttgggttactataaatattctcaaaaaattttctggctgtcatatcaaattttaatttttaatccagattaaaaattacttactttttatttcacaccctaataaccaaagaaatctctctccattccctccctattttgcaaaccaaccaaattggcatgtgccgaacaactttggaccaggctcattgtccgtctgttcacttcctcacatttcaacaagtgtgacgagctcatgatgatccgctcaatttcgtcttcttcttcgtcggtttcccttttctgtccattttcacactcttcctcttcttcttcttcctcttccgtttcttcttccttttccttttcctctccatttccttcttccgttacctcttcttctgttttctcttcttcctctttcgtctcttcttccttttcctcttccttttccttttcctcttccttttcctcttccttttcctcttcgttttcttctttttcctttcccccgtcttttgtcagttcatccatttttaatttatcacttccattgccaaatacttcttttaaatttaaaaaatttggagctggagagtttaccatttctaaaatgaattatatgtatatacataatgtaaatattcaaaaatgcggaagaagcgcgggaggagagggagggcgggggaggtgaaggatgggatataatccgaggatgtgcttcttcagtgcatgtgccgttggtgaagccaatttttggccggtgatttattgactggcatggaatgaaagagcagaaacggaagaatgggcaaaaataatataaaaagaggaaaaagaaagggggagaaaagcattggaggaaacagtgacaaagagggaaagggggaaaaagaggaaaaagggggaaaagaggaaaaaaggggggggggggggaagggcactccccgcgggcattggccttagggaaatgagagaaatgaaaaatgggtaatgccttcagcaaagtgacggtcgacgaccgacgagcagcaacaggagaagaggaaaagcggggggggggggggg

SEQ ID NO: 25782 - DNA, 2468 bp, Heterodera glycines
tggtcgtaaatttataattatttatttatgttattttattttaattacatataattgcaaatgtgcgtgttgattccgtctttgtaactgtccaatgccgaattgccaaacgcattggaataagtgccgagaatagcctaaataaatgaaaataaactcacaattaattaaaagagtgtctccgattatgcccacatttaggcaagttatttaacatggtttagcaaaaagaattgaaagaacttatgaatttttcaccatttaggtttttggcaagttataataaagcaaaatggtaaaattgggagggaatcgaaccctcgaaatattttctataaattaaaataaattgaataaagttataccatttttcatcgcaaatttcatccaaaatttgtgaaaattttcccggcggtgccttcgatccaccggaccataattatattatcaaatgctctattaaactgaaccctaaattattaaaatccccaattctgatttagaacctgtttaagaatttgacccatataaaccgccaaatcattagggccaaattggcgaccatcaggacaagtaatcacataggccgaggttgtcgccaaaatggtggttgttgtagggggaggaggcgaaagagtcgtagttggaggaggaggaggcggaagagttgtcgttggaggcggaggaggcggaagagtcgtcgttggaggcggaggaggcggaagagttgtagttggaggaggaggaggcggaagagtcgtcgttggaggcggaggattcatcggatcgtatgggtaattgcaaaaattgcggtcgcagatgcactcctgatcatcatacggatcattcactttttggcactggatagcctttggatcttcccaggatgtggcacagaatgagcgaggatactgagactttcctaaacaaattcatttagctttaagcccccccccccctcccttccctaagtcagtttcgtttgtgcccttctcttcccccgtccttctcctcccaatcacttacgagtgacacaatatttgccagtacaatatttgcttccatcacagatcacattgaatggtgcgagtgatctgctcccatccatgttcagcacatacggagttccgcattcgaagcaagtcatattgcccggctcttccggcttcacaattttgcttagagtactgaatgttgctaattttgctcttgaacaattccaattgccctccccccactttttcaacctgttcagtgctaacagaaagcctggattattcggcgtgttgcaaaaatttgtgccacaccggcaaaaggtcggaacatttgccgaacagtacgggtcgggggaggaggggatggaaacagtcgacgagggagagttaggcgaagtacagcccgaccgccaactgttgtcagtgccaatgacttgaaaacacagtgaaacacagcccagccgtggatttattttgctaattgaactcactcagaaagcatgagccattgccaacgcaaacattctgaaaactcagcgtggacccatttgtgagggctgtgccgaagcccaagtaacagtaaacattggcactatttacgatgggaattatggccaaaagtgcaagaaatgccaaccaaaattggtttggcattttcgtttccttaaatacgataaaattgatcaatcaacgggggatttatcggtgcatttccgatcagaattacggtaaaagtgccgctagacttatttccgcattgaatgtttttttcttcgatttttgcttttgtcatgtgacctttttgcgcgcattaaccgtttcggtggaaatttcgctcgcatttcgcgctgtctcttctgctgatgagtgataatcctccacaaattggtctatttgcccccccccccctccgcccaatttgtcggattggccaattaaagggcaaaaattgcgagaaatttaatataataaaaaaaggtaaaacgaaacaaaaaaaacaaatcatttgctgcttaaacatttgtatgtgaaagaaaagtgctctctccacggctccaccatcacgcgactccatctttcggactcacagcgacagaaaatgactgtgtcgttgacgccggagaaagagtcgaattctgaaaatgccactgacaatttcagagcaaaaaggacaccgaagtgatcagactttgtctgtccaacgttccgatcactcgggccaatgacctcgcccctttgcacttcgacttgaacacctcggccaacggcctgcagaaagcgactcgaatttgaggactgaatttgacggtcctttcagtgtcgaaactacactgatcattctctgaattgaaaatgaaaggattgagcagcgaaaaagtgaaacgaacggagaatttctgatcaaatttaattttaaacgaaataaaaaggagaaacggttgccaagaagcgatcgctttttaatttcattaa

SEQ ID NO: 25783 - DNA, 1879 bp, Heterodera glycines
  misc_feature (1854)..(1854): n is a, c, g, or t
tatgcctaggctaggcttaggctttcttttgcagaatttattattgtacgagtcgcccaatgttcgagttgccattgattccaaaattataaggacacttttttaaagaaacataataaaaaatcaggtaaatgtttctttatatgaagattaaaaaaaacttatacaacaacataatcatatagttccttcagagtgtaccgactatcaaaaaattcatatacacataattttttctaaatttagggtaaaatataccaaattactccaaaaaagttaaatttaagttaaaatctcggaaatagatggtttgaaaaaacaaaacaaagctaaaataacttattttaaagaaagatgacttaaaaaattaataatttaccttgctggattatttctggtacaccaaatccacgcattaattatgcatataaatcgcgaaaaatgttccaaaatatacaaaatcatatggaatttcattctaaaataacaaaccaagcaggtaaaaggtttttttcgtgcgtttccgtccttccacagttaagattgacaaccccctccccaattatgacaattttccttaattttttttcttgactttatgatttggttacaaattgtgcatattcgttaaaacaaaatgtttctcacttttgcatttgattgacagaaattttaaagtaaaacaaaaaatggcggcggagtcattgttcaacaaaattggacggaatgcgaacttttaagaaaaaatataaaataatttattaattgacttttgttacaatttaccatcataataatattcattagcaactgtcaaatttatcagtgatttcaatgccattgttacaagctgtggcatcccaataatttcctcgcaaagttaaaagcgtctttaaatttgtttatgtaaattaatttaaaatattattttttttttaaattaaatattcttaaagattacattcaggtaatttattggcttttcgttaatagaaaaattttttgaggttttattttactttgttttaggattttttaatgttaatagttttttttttttgcttttaattaattaatttttcaatttacacatccccattatttttcacaccattttaatctgttgtttattcattttcttttccaattcagtgatttttccaaaaagttgttcttgcttctgctgatcatttttcatttgagtgaatgtgtcgacggaaacttataaaatgaatttaaataatttaaattgattttgaaaaaatcttgaattaattctaatacgcagcgactaaactttcatttattttctgttgttcattggtaaattgttcgaagtgtggtgttataaaaatcgcaagtacttgtcaaaatgcacttcgtagtcaaaagtcgttttatatattctacataaatttgacactatgccaaaaaatgatttatgaaccataaaaaaaaattgtcactgtcccaaatacagaacatcccttaatgaagatgaattggaaaatgaaatgaattctttttttattattttaaagctttcgcatgagagacattagaaaatatttctcgtttaatatactgtcgatgcccttgatcaagaatatgacattcattttgattaatttcgaattctggaggcaatttgaaaagtcaatacaggaatcaaaaattttgaaattataatagaattcaagggatgttgcgagaagaaaaatcaaaaacgaaaacgaggacgagacgccctaaaaacacgagaaaaagagatgaaaattttttttacttaataattaatcaaaaattttaacaaaagaatattttttccaaaagaaaaaacttaagcagattaantataatgattttttcaagcgaaaaa

SEQ ID NO: 25784 - DNA, 1738 bp, Heterodera glycines
ttttttggatataggcctggatgggaaatttttttaacccaaaaaatatgtaaggatagtttctattctattaaaaaataagcgtttttggaaaagactaattccaaaaattcgggggaatttaatcggtgggtggccccatgtcacctatttggtcattaccacccctttttagaaaagttgacaactccgagtcctttttaagttgttgactcgatttgttggcacagaatggcaaaaattaaaatgtcatagttttgggccccttaccaatcgttccaacggtgaccgcctgcaaaattgtccatccgctgagcagaaaataattgagggggacagaacgagcatagacaaacatagcgaaaagaagggcaattgagccgaagaaagaagcgaacggaaaccatggcctaaaagtggagaagcatttgacaaaaggacgaggaaagcgtaagaaaaaagaaaaagtgagtgaccaattagagagatttcggaaacccacaaaaccaaaaaatggggaaaaccaatcaaaatttgagaaaactttaattcaagagtaaaacactaaaaatcgtaaaaataaacccgtttaaaatgcgtattttttgaccgattcaaaatacctatgagtttttttaaatgtttaatttttgtatttttcccatttgttcggtgtaacaattggaagctcttacaattccattataataaagtgtttttatacgaactgttgttggatgaacactttgactccgtccgttatgtaaaaggcgactccgagtccaattgtggccagaaattggaaggccaaaatgccaaggactttgcgcagaaaagcttaaattacttcatttcattatgttttaatattctattaattattagattgtttaaaaagaaaatgagtgacgaaaaattaaaaaaaaagggaaggaattgtaccaagacgaatgtgcagctgtgccatggccaccgaattgttttggtcaatatttcgcaaatgcttggacaatattccatcgatcattcctcccccttcgccgttcgttcgccccttccccaaatcactccaaaaatggtcgacgcctccacggacatcgattcgggatttattggaagccgaattttgaccaatggacggtttttgttgatcattgacgacttcttcatagctgggcaagttctgttctgcctcattgtcctggtcagacaaaagagggacggcgtgggaaggatgggacattcagtccgactctaacaaataatataaaggtgaaagtaatgttttattttgaatttctaaattatcttcctatatactaaagtttggtgtttgtgtgtacatatgtgcactatgggtacgccccagtgtcagacaaaattgctcataacgccaaatagcgcatttggcgtaaatttttgcccgctatttcaaaatttacactgaaaaatgccttttttgtattttttatttgatctgctataactcgtttcattcccacctaaactgaacaaatttggtatctaaaaaaagtttttgaaaaggagaatctgagaatctttttctaagcgaatgctaagcaatttgacatcccagaaaaaagttgtgatattttcaaatttttatcccgttataactcaagtcctaaactgctgttttcagcaaaaatgctaaaactattaatttctctatgattgagaaggtccaaagtgattttttatccatatacctaaaatt

SEQ ID NO: 25785 - DNA, 1312 bp, Heterodera glycines
ttgcggattttttgagtatattatttttataaatacttttcagaagggagttaggatttttttctgaaaaatcgaaaaatttccagaaattctggaataacttttttatttggaagatagaaattccaaataaatctcataaaattctcctaattttttgctatttttcaaactttattccactaaatttgatcaaaaacgaagagatttatgaattttcgaaatttcacaggattttccggggctcaaattttgacgatttttcaaaaaattttaaccaccttccaaaaagtctgaaacacaaaataaagcgtatatacgtattcagcacctcaaattatgccataaaaatgcattttggctaatttaggagcaaaaaattttttcatgaaatgcaaaaccatggggtcccccctatggttttgagttttaaaatcacaattaattttataactttttttatactcatgttaaaaatatgggataaaacacattggatagagcttaaaattctctacaaaaatgctcttgcaagatttttggctaaaatcaactcccgacgagttataggcccgggactgaaatgtcccggtcagagcaaaaaatttttctatttccggaaaaaaaccaaaatttttctgaaaatgtcaccaatcgatagagctcgaaaaactatgttttggaagtggtctccgtttttcctggaaaattcgttaaaaaatcagaaaattaaaaaaccaaaaaaccgttttttaggcctagctcgaaaatttctgaaaattttaaaaatccaaaaacacggttggatagagctcaaaaaattacacataatcattttctatgtgcactggatataagcaaatcccgcagagttattcccgaaaaacgaaattccggttttcgagttggcaatttttgctcacttgtacacggaatacggttagtcgtagcaaaaaatgatcaacaccaattttgtagaggacacttgtgcggagtgccctcccagcggacatttttcgatcagaccaaaacccatagttttacaggctcttgaaaaaagcaaaaagccatttcagcgccgctggcgctcagttggccgccggaccggaatgcctatagttttcctgaatgcgccgtcaaaagttacccctgcatgccaaatttcagctccccccgattagcggttccggagatttttgttttagcaacgaaacacgatttgattttatagtatataaactagcgggtgcgtgaaccgtcggctatttagctgggaaaaagcgcttcgcgctttgggagcttcgctacctag

SEQ ID NO: 25786 - DNA, 1542 bp, Heterodera glycines
ttcagaaccattttcccctttttttcaataatcgtaggaaaaaacggctttttttttttttcggacacttttttgaaaattttttccgaaaagagattttgtgacacgcaatacaactaacattcgagggttctgtcatttcctttttataatgcgtatataatttaggctatttgattttatcagcaaattccgaaattagcttgggaatgggcccttttgaggccaacctttttttatgaatgttgtcccattttactttgtggtctgcggcctatggacgcttcagaggcatttacgccttcttttcaatattcgtatgtaaaaacgactatctctttttttcggaacacttttttgaaaattgtttccggaagagattttgtgacacgcaatataactaacattcgaggcttctgtcatttcctttttataatgcgtatataatttaggctatttgattttatcagcaaattccgaaattagcttgggaatgtcccttttgaggccaacctttttttatgaatgttgtcccattttacgttgtggtctgcggcctatggatgattcagagccatttacgccttcttttcaatattagtatgtaaaaacgactatctctttttttcggaacacttttttgaaaattttttcaggaagagattttgtgacacgcaatataactaacattcgaggcttctgtcatttcctttttataatgcgtatatagttgtggtctccggactatggacgcttcagagccatttacgccttcttttcaataatcgatgtaaaaacgactatctctttttttcggaacacttttttgaaaattttttccgaaagagattttgtgacacgcaatacaactaacattcgaggcttctgtcatttcctttttataatgcgtatataatttaggctatttgattttatcagcaaattccgaaattagcttgggaatggcccttttgaggccaaccttttttttatgaatgttgtcccattttacgttgtggtctccggcctatggacgcttcagagccatttacgccttcttttcaataatcgtatgtaaaaacgattcagagccatttacgccttcttttcaataatcgtatgtaaaaacgactatctctttttttcggaacacttttttgaaaatttttttaggaaagagattttgtgacacgcaatataactaacattcgaggcttctgtcatttcctttttataatgcgtatataatttaggctatttgattttatcagcaaattccgaaattagcttgggaatgggcccttttgaggccaacctttttttatgaatgttgtcccattttactttgtggtctgcggcctatggacgcttcagagccatttacgccttcttttcaatattcgtatgtaaaaacgattcagagccatttcttcttttcaatatgtaaaaacgaatctctttttttcggaacacttttttgaaaattttttccgaaagagattttgtgacacgcaataactaacattcgaggcttctgtcatt

SEQ ID NO: 25787 - DNA, 2230 bp, Heterodera glycines
gaatgaatgaatgatttgtcatttgtaaaattaaaatgtcggacaacaaaaaaatcgaaaggaaccaattaattacaaaatgaagtaattaataacacagagagagagaaagaccaacgctaattaaggcgtctttcttccaccgattagtttatctctccgattccaattaaatgcctttcctcttccgctgaaatttatttaaaaattgaacttcctaattatttaatgccttccctaagtttaattaacaactgaaagattttcaacaaaatctttttgcacagtatgtgcccttacagtactcacctccattttgtacggtcgctccacaaattgtttgttgtcgttttccaacaatttcttcagttttctcattttggccttcactttgtcgctttttcccgtgtttttctccaattctttggtcactttttcaatttcttccaccgttttgcaaatttcctctttttttggcgtgtcaattgtcagcacaattcccatcgctttgcatccaatttctttgattttgtccactcttttctccaattgttcactcagttcctctgagttttcttggtcgtcaattaggctaatgagtttgctaatttcgggttccaaccgtttaatcagttcttccatttgttggcctgcgattttcttcaacggttttatcaattcatttgctaaccgaaacaattcttccgctttttgcagatagtccttctgtaaaaaatttaaaaaattattacgtagatttatttcctaattgcgcttatgcttaccatagtttggtccgattcatttgcccaatatgaatttgtttgccccgcctggcttaattcggcatggaaatcgagcataaatgtggccaattcgatgtctccaattttggcattttcgaacatttcccttttggtgggcaattccttggccaaaatgctcaattttgtgtccattatgcgatttttcaaaatctgcttgattcttatcaccgccccgtcttttcctttttcacggcttccaattctttttttgccatttccaaatatttcacctcacaaaatgtttcatttttctttataaattcgatgagattgcccaatgtttgctcaatttcatttttatttttcacggacatttgatcaaccaaatacgcctcaacttcaaccaccaaagtgtcaaattgccttccaaactcattaatgattgcccgcatggacgacagcaattcggcgttactaaagacgggaaaaggtcaaatttggcatcgctttccgccggcgttaggccgtggaaaattttaacgcagaaatcctacaaaataagaatgccaacattaggaaaaaagaaaaaactatgccagtttttgatttattccttttttgttgtcttaaagtaggatgggtccagcagcagtattacgtttagttttatacgttactaagcccctttaactgaactgtttgccaaaatggatggcatttgctcgcttcgctggcccccacaagcggcggttgcattttgccttcagttcgtttatcggaaatttggcaacaattcccggtaatttgctcactttgatattcattcttagaaggtatttctggtccaattgcactttttgaatttcttcgattatttcttggctttgtgttttccattcttcccatttttcccattcttcgtcccttgtcgaaacggaaaatttgaacgatgaaaatgaaaaaattaaaatgttaaaaaaggtaaataaaaactgtttcatatttatttttatgcttaagaataggtaaaatgtaactttgttttgctcattcgttcaaaaaatgagcaatgattattctttgaattcgtaattgtaattttatagaatggatttaagtaaaatcaatttaagcgagaaaaaaaggcttttcatttatgacgtccataattttttcattttgcttaatatgaatgcctaattttattaatcatatgcatcagggatgttgcaagtttaccccaggctcaaaatatcccaaaagttaaaaaaacaaaacgacccaattctcaattcttaaacttaaaaataaatttttattagatgagctgagaaagaaaagaagaaaacataaacattgaaatgaacaaattccaaagggaataatgctcgaatgatctcaatggtgctgggacgttagtcaaaaaccaacaaaatgggcgttagtcaaaaaaccatcaaatg

SEQ ID NO: 25788 - DNA, 2251 bp, Heterodera glycines
tgtaaaggaatttattcaaatcagccttctcccgacaattggtaaaaaataataatttgcgcaaaaattattttgttaatttaattatgaaaagctggaaaggaagacgtcaaatacgccaaaaagtgaaaaactgcgtgttgtgtttaatgctttcaaaatccagtaaataacattttcattgaataaataaatcatttaatttaaaatacataattttttcaaaagctgcaatgaatcattataacgtttggacttttaattatgaagaatattttcgttttctaaaactccttaaaaaaggtaattgaaattttgaagtctttttttaaattttgatgattttagcttttatgcataacattttcccaaatcgtttaacaaattgcaaaataagccaaaattgttgtcctcgaatcgccggacaataaatttaatcaattcaaaaattggcatttttgaaaaaaaacataataaattatgtaaacattcaatatctttcggcattgtttaaaccctttgaaaatgaaattgaagatttaaaaaaaaaagttattcacgttttaaatcccactttaataataaatttcaagctaatttataaaaatagcacaccattaatttaaagttattacaatttttttaaaaacgaaaaaatcaatgaaaattgaaaataaaatcacattttttgacaaataagcgatgcggcacatttttcggagaatggtcaaaagttggcacgttttatcagcgacatgggcttctacagtttggtggaggacaaactgatgaaagaaatcaatgggttgccaacattatgccaaaattttttcaaaaattttttggaaaaaattgatttcaaacaaatgatggacgatttgatgcactatcagcagattagagcgtcacttaaacacccaaaaatgaataaaattggcgacacagtaaacatcaaagtgaccgtagtccaacaactggcctctctactatattatggactactgtatcaggtaagaacggtacttagtagttggtataaaacggaatgaaattttcttaaaatttcaatcattgtgggttcagggtgactgatcataaagttaaaatttatttcagcattctgggacccaaatgaattaagtcataaagttgggatttttcgatttgccggtttcacttgttgtattgtcaagacatcaacaaaaatatgggtttcaagccatttttaagtggatttttcatcccaaaaatatatttttaactaagaaaattttgcaaaattcgggggaatttttcgttgatttaatgaaaaaaaaaaaagttcaaaaaggaatttttcggttgaatttttactaactgttcctaaaaattttatgaaaaaccccaagaaaaatttgaatattataatacaattttaatgcaatttattggtgattttagaaagttttcgaaatatttttgtaaataaaaaaaactattatttctccaggcactgcttgacgagcttaacaagccaaaaaatttgtcaaaaagggatgccgcaaaattttggatcaaaaatttcctgattttttcactggctgccattagagcagagttcaacatggccaaatacgagatggagaatgggttggatgatgacagaattaatttgctgccaaaattttcgattggacggcattacaatgaaaaattggcaaaaaaattggcggaatggaccgacagaatgcaaaaaagacaccaaacatagtgcaaaaaaaagctttgttattttatatttttgttattttaggaatttgaaaacacaaagattgctgaaacttctgttactttaaacctttaaaaatgataaaatttgtttttatacaatttaaaatatgcaaaaaaaaaatctttttatatttttttaatttataaggcaagcaattaatatagaatttataaaaaaattcattattcagaaaatgattattattttttgcaaaaaatgcaaaaaaatttgcaatttaagttgttttaaattaaaaatattaattattttattgcgtcatttgttaaacttttcattttgtcatattctaacaaatctaattaaccattttcagcctctttcgttttggaaaaatttaatttggattcaaaatttcaattcccatctttaatcccatcaatttcaatagttccatatttaacttcgttgcattttcgttttgttttcattctttggtattgcaaaaacttatttataaat

SEQ ID NO: 25789 - DNA, 1467 bp, Heterodera glycines
tttgggtataatttcctttaagcagcccagggtggggttcgggaacttttagtacatactctctgaatgagctgagaaataatatatattttttcaaggtcatgaaaatttcaagaatttttatatgggcacgagtgtatgatatggtactttgggtataatttcctctaagcagcactagcttaacttcggaacttttagtacatactctctgaatgagctgagaaataatatatattttttcaaggtcatgaaaaattcaagaattttcatatgtgcacgacagtatgatatggtactttgggtataatttcctctaagcagcactagcttaacttcggaacttttagtacatactctctgaatgagctgagaaataatatatattttttcaaggtcatgaaaaattcaagaatttttatatgtgcacgacagtatgatatggtactttgggtataatttcctctaagcagcactagcttaacttcggaacttttagtacatactctctgaatgagctgagaaataatatatattttttcaaggtcatgaaaatttcaagaatttttatatgggcacgacagtatgatatggtactttgggtataatttcctctaagcagcactagcttaacttcggaacttttagtacatactctctgaatgagctgagaaataatatatattttttcaaggtcatgaaaatttcaagaatttttatatgtgcacgacagtatgatatggtactttgggtataatttcctctaagcagcacaagcttaacttcggaacttttagtacatactctctgaatgagctgagaaataatatatattttttcaaggtcatgaaaaattcaagaaggggtgggacaactctcgcctctcgtctctcgcctctcgccaactctcgccatttttggtactctcgcctctcgttttttgggacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaaaccttctgcctttcattatttttctcttgggttcaattccccaacggtacagaatttttttaataatttctttaaattattttcaattgaaattttaattaataaaaaatatttcaatttaaaaattattattttttctttttttaaacagcctaaaactgcaaatttaaccaaaactttgatcattttttgacaagttctgttaatatattacactcaaaattttggaatttttccggcggcgcctatcggcggtgccgattcggcaccgccggaccccgcacccaatgttccaataaattttttttggaaaaacgagcgccacgaaaaaagagcgacttaaaaccgaaaaaattaa

SEQ ID NO: 25790 - DNA, 1687 bp, Heterodera glycines
  misc_feature (1425)..(1425): n is a, c, g, or t
attaaaataaacatttttacttttttcatggtctgtaaacatcaaattttccgccgataagacgcaagagtgccttcatcctctcatacgctttttgagtcccgagctgtgacagcaaaaacagcccatcttcttcgtggattgtttgttgttgtcggagttgttccttcttcatcggtgtgtagtgtccaaatttgtgacgtacttcacgatgcagagattgcagcgaacatcggctcactgaccgcgaccgatctcgatcgatcacatcagcgattttcttggccagatttcgccgcgaggtctgctccaatgtagcagcattctttttgcgccgtgtggaagctaaaaacaatttggatgataaatggctttaaaaattctgcagaattttacgtgttggctggtccttctgcgcctgctgttccaattgacggcgcagatcagcgatcattgcgtctctgttgcggacctgcagtcgtagaaagctgatcgtttgttcctgctccttcagctgtttgtccaactgctcggtttgtgtcgcggcgtcctcatatgccaagtccacgtcagttgccttgtccatcgttgtcaaatccatgtgtgttgcattgtcggtagttgtaaagtccatgtttgttgctttgtcggtagttttaaagtccatatttgttgctttgtcggtagtttttggacggacacgcacatggtgcctgaccggagtcgctgacaatggccttgtgcttgaacgcgggccttaatttaatttttgcttctaaaatagtgacttttttgacttacgaaggtccaaagttgacgttgatggtccactttcggcggcttgggtcgatgtctcctctccatctgctgttggcacggctaaggtctgctttagacctaaaaaatgcagtgtttttaaaataaaattaattttggtcaattttcgtcactttttggcgtcgagccgcctttttgagcccgatcctggcgccattccttccgctttcgtcttgcttttgcagataagctgttcatttgctttgccaatccagatttgtctcgggaaaagaccatttttttgtgtaaacaattataaatatttgctatgctaaaaaatttttccttatgcaacgatttttttgaaattttgcataggccaatattttgacctcctctatcgattctaagtttattttgtgaaagttaagtttttaactcgagatcggctcttctatttttacaagggaaaatccccaataaattttaagttttgcaaagttttggcgttctgattactaaataaataataaacttatttgtacttggagcccaaaattgactcgccgtgtatagagaaatttggtctttttttgggaaatttttggtaagaaacagagtaaaattttcaaaaattccccccggcgnccgcctattcggcaccgccggcccaatctctattccggaaactttttgagcaaagtcaaaaaacatattgtgcgaaaacaaaataaaaagcaaagtttcaagtacatatgagcccattttaattaaaaaaatcattaagtttattaaaaaattcgctcgaaataaagtaattttgggaaaatcagtaaataatcacattttctaaaatttcactaaaacccatatttttctaaaattgtggaaatatgtctcaaaaaccatt

SEQ ID NO: 25791 - DNA, 841 bp, Heterodera glycines
tttggagttttgaaaaaattttttttttttttatttttgatttttttttttgtttcccagaacataattttgtaaatgaaagaaaacataaatttctaatgaaaatgaacataaatacaaaaattgacggggaaattgagtttaaaatttggagtttttgaaaaaatttttttgttttttatttttgatttttttttgtctgccagaacataatttcgtaaatgaaagaaaacataaattactaatgaaaatgaacataaatacaaaaattgacggggaaattgagtttaaaatttggagtttttgaaaaaaattttttgttttttatttttgatttttttttgtctgccagaatataatttcgtaaatgaaagaaaacataaattactaatgaaaatgaacataaatacaaaaattgacggggaaattgagtttaaaatttggagtttttgaaaaaatttttttgtttcttatttttgatttttttttgtctgccagaacataatttcgtaaatgaaagaaagcataaattactaatgaaaatgaacataaatacaaaaattgacggggaaattgagtgaaaaatttggagtttttaaaaaaatttttttttttttatttttgatttttttttgtctgccagaacataatttcgtaaatgaaagaaagcataaattactaatgaaaatgaacataaatacaaaaattgacggggaaattgagtttaaaatttggagtttttgaaaaattttttttgttttttatttttgattttttttttgtctgccaggaacataatttcgtaaatgaaagaaaacataaattactaatgaaaatgaac

SEQ ID NO: 25792 - DNA, 1327 bp, Heterodera glycines
ttttcacacctgagtcaaaaaacgagacatgtgtcaataaagagagagtgcagaggaaaaaacatctctctttttggcgtactatttctttatctctgctaatagagaaaaaccgaatttacttcgtgatgtttaactttttttcctgatgttaaatccacacccaattttgcatgccgatagagaaaaaaattctgcattattctatgctcaattattattttctgtgctcaaactcaaaagttgtaagaaaaacaaaatttcaaagcatcatatcttttttctaacccatcaaattgcttaatgtttgctgagaaaaagcttctactcatcaagagctttcgaaagataccaagattatccaatttggttggcaaaaaccttcaaaaataattcccaaaattcgtcattttttaatattttggacaaaataaataaaaatattcatgttgcacaacggactcgaaccaccaccctttgtccctttactatcttacaaaaaccacttcgccacatatgcatttactttttgaactaggggctcaaaattgactcggtgtgagcaagtaagcaacaaaaaaaagcatatgcctcaaaagcgccgcaaaaaatggaagaacattcaatcaaacgaagcgacaacagaggcaaaggcaacagcagaaaaatgtgagaaaggagaaggagagaaacggcaccaaagggaagaacagcgaaatgtgccgaattgtcagcagttgtgctcgtgggaggaattcgaagaacgagtgcaagcggtcagactgaggccgaggggacggcggacgagcggcacaaactgttggggggcaacggggggagcgaccggcaacggatgccctggggccatcgaacggaagcgacagcacgaaatggcacatggggaagacggaaggaccacaaatggaagaaaaatgggagacagagaagggagggaagcgcaaaacgaagtgctaaaacagcaaaaatgttggaagtgccaccagatggggcggaaatgtgtgaattccattctgacgattggcaccggcgatcagcagcagcgactaaagcttgcaggttgttgtcttgccgtatgtattttgccttccgtcggtcgtgtggacctcttatgccatccgctggagcggcctgaaaatctgcaattcttctttagtaaaaatttgcccatgggttgatttggtccgatctggcgaaaacaatcaccggcgaattcacttactggcgaaatcaaatacagacgccgagaaaaagagaaatatcactcactggcgaaatcactcactggcgaaatcactcactggcgaaa

SEQ ID NO: 25793 - DNA, 1152 bp, Heterodera glycines
  misc_feature (1097)..(1097): n is a, c, g, or t
cgacaaaaagtcaacccagcaggtcattttagaaatgcaaatataagaataagaatctgcaaatttcttatatcacaacttttttaaatttcatcttcaattttttaatttttttagtttcgcttaagtcagacgcggttcctaacgtgggttatccaaacgcaacaccaacgccattggacaaaaaagcaaaaaaacaaaaacggcgtaatgatgggaattcggctattcatcaaacggtgaagcaaatgattgttggggaagtcgcgaagggaaatggcgtaagtaaagcgagaatttttttattatagtaaaacagcttctaattgagctaattagtcgttttctgtttctttcgttttgcacagattgccgccagcaattgctaaagaaacaatttccatattttaaaaatagcgattcgtaaataattataaataaattgatttgttgatttcaagaaagcaaatcgtcataaaggaaaacgaaaagttactttctcatctgaaagcagtgggaacgaatattatgcggacaattccgaacaaaagtcagaagttgtaagaaagggtgagttgaattttttgaaaaaataagagttcaatttaattgaagaatcgaataaacgcatgaaaatgaccattgaaacggattctgacgcgacttcgaccgctgagggtcttacaaaaaacgactaattattcacatagcaaattgtgtttaagatttgattgctacaaatggacagttttctgaagacagcatggaaaacgaggaagaaagccttgacgatgatttggaggaagaggaagaagaaataggggaagacttggaggacgaagaactcgaagaagcagacgacgatgaactgagaaatggcaatttggaggacgaagaggaagcgaactcttcttttttcacgtcagacgacgaatcgcttgaagacgaaattggagaggaatcgggagaaggtccaaccaacccaaccattttaatcggattgaattactctaatgtttagaaccttttgaattggaatttgttggatatcaatcgacaacaaaatcgggctaaatgtttgcttttggaagcattgnaggactacacaattgcaacttcgcccctttgtctctttcaattttcggatggcat

SEQ ID NO: 25794 - DNA, 1643 bp, Heterodera glycines
tcgcagaacttagccgaccatgaggaggactcactggttttggggacatagcaatattgggtatgacaatgagtcgtagggctttatgagcgaccccccccccaaaaaaaataataaattgggctcaaatggacattggtcagaaagcaaggcccattaaaaccagttcggtttgaaattctcttaattaaagcgcctgttttcacaaagcaacagatgtgaaagcaatgagagagagaatcaatggccaaaagcggcggacggatttattcagaaaacattaattgatcactaatgttttttatggtcaccatttccatttgatcagatttgtctgtaataggttcaaagatatctgtctgattgtacttacttagggtgtaacataagtttccgcacaattttttttttcaaattcaaaaattcataactccgtaatttctgcagttattttaataattctttttttattttgttcgtcagaaagtcttctttcatttcattttttatttgcttattcaattttttagtattttttcccgaccatgcaaaaattgaaaattggcccactaatttttctcgattttttatggtcaaaaaagtaacctgatataaaaaaaaggttttctatacaaattagaccagtagaatccgaatatggccttaaatctgacctatcttttaaccctgagcttgtactgctccaactccatgcatgaagttggagctgtacaggtttgttgagaacccagagaccaaatctaaagccatattcggactcagcgtggtcaatttatttagtttaattaaattcggaatttccaaaaccacttttaaaacattttgttatttgatggtcttgaaaaatgccgtttttggagacatttttagactcggccctccaataattcatttttgaagtaataaaatttttttcttataatttttatagtcctaactttgctctatttactcacgttttctctgcctctgtatctcttttcattttctttaaatcagccatcaaaaatacatacctcgaaaatgaccatttttacattatcaactctaactccttaaatacttttctaatgggatttatcccttgcccaataaatagcaaactcattctcaataataatgtcagatatttcggatcatgattgtggttttttaaatttatattcataaaaaaattctttaaaaaaagtgtgcggaaacttatgttacaccctaagtaaaattattataaaaactttatttactttcttaactttttatttaatttttatgtccttattattttaggtttttgaatttttctttgctgttaaaatttaaaaaaagattttaactttattgaattatcacttttttatatcattaatttattttttaaattggaaataattacttgttttttttaataaatcttgacgaattgttcgtatcagtagttgacgcacagcttaggaattaatgttcgattgctaatttatttatctccttttttcgctgtctaatttgtaaatttagaggtctaatagcaatagttccggtcttccaaattcagcgtcttatgagaattaaattttctaaaaaaatagttaaatataatattttttttctattcttaatttttt

SEQ ID NO: 25795 - DNA, 1699 bp, Heterodera glycines
gcattcagtacgcggtcttcatttggtggaattcggggcctttttattggcttttgcaggctctcaagtatttccagtacagttggcatttcttactaaaatctgaattacctttttgtttggttagaaaagaacttataaaaatgaaaggaatacttaagctttgattgatgcaattctttcgtctttttacttttttttctttacttttttttggactacttggcaaaatgtcagttggcgaaatgtcagattttggttaagttggcgaaatgaatgtttttgggttagttggcgaaatatatgtacaccttcaggtgaataaaaataaaaataatctttaagtagtgtaaagtaaaattcaaaaatgaaatatttatttattaaaaaacataaaatttttttgaaaaaaaatctcataccatctaaacggggcggagtcattatgtaaaaaaccatcaatatgatttgatgactgcgtccttggcgttgtaacgtggattaaaaatgtttgatatgtgttgcataggttaatgtttatttcctattaaaataaatattgctcatttttaatcaagcatattttttttaaattataagaataaatttatattttacgaaatattaaaaataaatattatatttagttattaatttatatttaaaataaaagtatttttatttaaatttatgattagttttaaagggtattttctttgtacgaatatttgcactatattttattatataattttaatttcatatttatatgtgattaaaatgattaattgatttgaataaaataatttttaaccttttatttaaataattattagttttttaatttactaaaacaatcaatatcctgcttactaaaatatatattttaccaattttttttatgtttaaataattaatattatatcattatgccatttactcaataattttattttataaaactatttttaaaacaatattataaatcataagaggtttactgatttataataattgaaaaatatatacggttttagtgaatatttgctatttttgtattcattttgttttttttgcaaattggtttatcattttgaaatattccgtttttatttttaaatttggctattataaaattagcttgactattaaaatttttttattatatattaaatattttatagttcttttttaatttatagagatttttttgtattttttattcttttgcacatgttttccttgaattaattaatcaataaatgcctcatattaattttttactaaaattcatattctagcttaagaataatttttcaattatttaataagttctttagtgaattaaagctttaaaaacaattaattattttgtgttaataattaataaatctttttaatccaagtaagaaattaattactccattcaattcattctttattttttttgtaaaaattaaaaaaaaaaagtatttttcagttatttgactaacaccggatgcaattattatgattttaaacaattttattaaaaaaaattaacccaaaatttaaataaatgcaattatgttttatatacaggcttattattaaataaacaaaaaatttaatataagtttattaaaactaaaattcattcttttttttgttcattatcggatgataccaagaatgtttaatttgactgacattgacaaaa

SEQ ID NO: 25796 - DNA, 977 bp, Heterodera glycines
tttttcttttcgcaaatcggtgctaggagaaatcgggagtttcggttttcgaatcactttttcaaagaattgcaacaagtgcaatttatcattttttaaacaaatctggttaacataccataattacgaatcctgggaatcaagagtctcgggttttcgaatcatattgacactaaaaattctttaacatatcaactaaataaaaaaccaatacataatcaataaaccaaattttttttatttgtatgtcatgaaattcctgtctagcttaaacaaaattttattatttttttgttataattaatattaataataatattaaactgttttcgctgtttattatttaaatatgtgaagaattttaatttctgaatatttttctcatgctgaattatttcattgcttataaaattaaaattaaatttaaattaactttttcccattttaataagagaataaagcatgttcactaatttcccattgcttttctccgctttttcaatttttctgctccttttgaccctgcaattccctccaaaagtgctgggaatgttttctaattacaatgttttgcctttgtatcagaagaataacggtaaataaattatctatttaatatattaatattttttaatttatttaaagcattaatagctgggatttttaggctttaacggatagtgtttgatgatagaagaatgatttagagcgactttttatcacataaaacacctaaaacgggggtatgcaccaggggtgtgccttgtccccaaaaagacgagagcgagagtttggcgagaggcgagagtccccaaaaagacgagagttggcgagaggacgagaggcgagagtttttcaattttctgtagccttattttttactccaaaaaatcacaatgatcgttcgaattttagcacctattttagcctttttcagaaatttcatagcaaaagtgcaataaaacgtaaaatacaat

SEQ ID NO: 25797 - DNA, 511 bp, Heterodera glycines
agaggggggggggggacgaacaactcaagccgagcggaaggcacaactcactccttcggtattttcacagtgcccgccgcttcggccggttgcttcagcggcgatgacaccggcgagtcgctcaatgcgtacgttctctgccgactcgcacaatctgttgcccctacaaaatgaccatcgaaatcatttggacgttcactttgtttggtcgtctgctgagattggcactgcgagagaagagaacctttggaaattgctgccgccattgaaataacacttgcgttggccatggaactgccatttgtgcatattatgctgttactgaggtcgaacaaatgctgaagctaacgagttggataaaccccaatgaattaattctctccaattccctcccctaattagagaccggcgcgggattttgggggattaatcgcgcgggatcccgtcccgcaaaaattttgagtttaaataccacagcgggatccgcaaatttgtaatttccggtctctac

SEQ ID NO: 25798 - DNA, 1191 bp, Heterodera glycines
tacaccaacttaatcagatcactccttcctagggaccgggaaaccccaaaatacactgaaaatcggggcaattttcgaaaaaaatccttaatgggttggaaaattttttcagaagaaaatgggcaagaccactgacaagagcacaaaatttgctaccgaattgcttttggaatggtaggtctatgatttgtatatagaaagttatacttggttgaataattgatctccataatgataatttttgatagtgccataactttttgtagaagcatccaaattaaacaatcttggtatcttttgatagccctaagtgtcctctatttgcttttaagatttcaaaaaatttggttgtgtttcaaaaaagttgtggcttgtaaatttcaaaaattgatgtggtaaacctttttgaccacaacttctttgtaactcaacgaaattttttgaaattttacagaaaaatagaggaccctataagctatcaaaagttaccaagaatgtttaatttgggtgcttctataaaaagttatggtgtatgaaacttatcaaaatattacatggtcatgtcttttttcgtggtcgtgtaaactgaaatagagccaaatatatttattattattagcttattattcaattataaatttaaacaattaattaatcattagaacaactcttccgtactgaaatgacccgcctcttctgatcaccactcattcgcacttttgtcacttcgacacagcaccggctaacttacccctctgacatttctgcttagaagccatcccggcaccgtttgagaaactaacggagttggagaaattggcgaagcttcaaattggccattggggccaaatcggaggtttccttcgatgaacggatttatgaaaccgaggggagatgggacgaaagaaatcccattcagctgaacgacgaaaggggaaagaagcaaaagcagtgggagaagaaaaggagcagcgatgggtgaagcgggacaatgaatcgccatttgagctaacgtaggacgaaccctaagaagtaattaactaattgtattttttaaaggagggggggggggcgaaattcaaatgaaaaggtcgaaaagccaaataggaggaaacgaagtgccgaacacattaagagcagtagcaaaaaagactaattcattagagagagagcaccacccggccatcaaag

SEQ ID NO: 25799 - DNA, 1339 bp, Heterodera glycines
ccggggactctagagtcttaacatgaatattttgaataaattttgaattcgcttttttcttttttttctacttaatttttttgtttttgtcatattaaatcacacagcttatatacatagtgtcattatcattatttttctaatgtttttagtatttcttcggttaatttcaattcttgctttgttgcttcactgaaccctttccacgacgatggttgtacggcataaccatctacatattcttataagtacatctttttagattaaaaatggttttataaaaaatagacttttaatatatacttaaaaatttcaatttcttttaattttgttttaaacccttttcaaaatctccaaatttgtttatgctctcatttttatttaagcatttttacattgaattttctcttttatttatgtttaaatctgattctaaatattaattttgcggaatgattttaatttatcttatacatttttgatttaaaaagataaattataaattttattactttttaattgtccactaattaattgtccagcaactcatttgtctggtgaattgttctggccggttttagttactatttaaatttcttattttaatttaatcaatttatcttgcgccaagaaaattgtttgcgtcattttttcatgccttggagttattttatttaaaaaaaatatttatgttattattttttctttatttattatataaattttttttgttcattgaattagtttatatcaaaatacattaaaaattaataattttattattaaatgtaatttttagtgttgttacattttaagaatttgtttttaagcaatttatttcgagagtaaaatttaaaaattatgttaattttttttttcatatatttattctcaatataatcaaaaaatttatttgatctgcttaaaaatgttttttttattataacaatgtttcataattaatttttatttgttttaggttatagatttttatttagtattactttagatcaattttttgcattgccctaaaaatcttgaacattatccagtgtgcatagcgacgcacactggcctttgaatttaaaatataatttgtaaattttattttttttttaaatatttatgttattaaattttttatttattatataactttttatttttggatgaatatctgcagaaatgttgaatgtaattattattgttgttcaataaaatgcttaaatttgaaaaattgctattttacaaaattcaattatatttaattatgttttgattttttttaattttttttgtcttaatgtaaatgtaacatataattattaatgcaaattga

SEQ ID NO: 25800 - DNA, 2032 bp, Heterodera glycines
ttgattatacatacatcatccatccattcacaacagtccctatcaaaatccctgctcatttcttttcccttttttctttagtggaaaaagcggcatttgtttccggcatttgttttgaattttctttatccgacgaaaaaaaattaaaattaaaatgcttttatttaattttttcaattttttaaatcccacaattcataaatattcattcattcgttgtttaatttgttttttttctgttgatgttttgctctgcgctatgtgtcagcttttaatcaaaaagcaggcagcacacaaaagcacgatttgtgctttcattgcattaagcaaatgcataccaaaaatataaataaataaacaattagtaattctaaaaaaattaaattaaaaaacaagcttttccctgttggagggggcttacataaaatccccggagaaggcttaaaatgcccacaataatcatgggaataaaaaggacacatctgcgagagattaaatgccaaaaaagtagcagaaaatgcaaaatagtcatgctttctaaattataatatcctttatatagcgaaattgtgccgtaccttcgggtcatgccatttttggctcaactatatttttatttgccaacaaaattgccatattcaaagcgcttaacagtctctattagtatgcaaactttcaaaaattcattggactacacaaaaaaaattatggccaaaaacctcaaaaagtgattttttttttttttcttgcagtttggcgccgcgcgccatttatttttttaaatttaattttttgaaattttacaaaacaatagacatatataaaatttagttcccttatgtatgacgcgttgaaagcttttgaggttctatattcccttgcaaaatttcaaaaaaaaaattgatcttttttattaaaaaatttttaaaatttttgttcatacttttttcaaatttgaaattttttttttcttaattttgcatttttatagagaaccttaaagtctatcgaggaatatcaaaacgggttttttttttatcgaaaaacacaacgagacggggcagtatgggttggcctagtttacgatatttttacgatcctaattttgtccaattgatttgccctccttttccaaaactttttcttatcacaaccaacacacacagcttttatatcacttggatgcatttgtgctgactttgtgaacttccttctcccattttgcaggaatgttaatttcccattcgggtgccattccgccgggcacacaaatgctaaatgcgcagctaaacggacacaatgtgaggagaacacacaacagacagacacaaacaccacaaaaaatggaccaagggatagcagaaaacgcaaaattaggcttttaaaaacgatttgaatttttgtgtttgagacaaaatgaaattaaaaagtgaaaggtagagagagagagacagagagagagagagagacacagagagagagacacagagagagagagagacacagagagagagagagagagagagatatagagagacacagagagagagcgagagatagagagagtttagggaataagtacaattcgaaaatataaatattaattcttctccagggacagggaatttgaggtgtttcacacattctggccccttcccttttgggtggtcccagcaggacttaggcttgttggcttcgtgtttttttaacacccccccccccatcccccgcttttttcactcctcgccctaacggaaaaaattaccgaaattaaaaaaagcattgaaattgaatatgaaaattgtttttccatcagcagaatgcctcctcactgctccaccgggcacagcacaaattccaccaccagcagcagcaaacatttgcctctgaggatactaccacaatcattgaccacaacaacaccaaatcgcatcagcaacacaaccacaatcaccacaacacccaggcgcaacaaattgcgcggtctgcggtacacacaaccaccacaaccaacaacaacagtgcacctcct

SEQ ID NO: 25801 - DNA, 1967 bp, Heterodera glycines
aaataactgcccgattatgtgcagtttttattaatcgcccctctttgtgtgccaatttcatgaaactcttctcagactaatttaatttgttcggcgtcattttcggaaactttccattttcttttttggcttctcatctttagccaaacggtgcacagtttgactgtaccgacatttaattcatttccaaatgccatcggcgtaagcgatgccatttttgaattattaaagtgagctttttcggcgaattgttaaaatgtctgttaattaaatgcctttggccgactgaacagacttttgagtgaaagctgtttagtgatgaaagttcagagattggcacaaaaatatcacatttcgtaaaataaacgaaattggaaaaggaagggacaaattggggagacaaatggacgaaaaagtcacgtgcggattaaaatggcttatgaaagtgttcgcttttcaaaagaatgccgacggacgaaattgacgaaattcgcataattttgtaaataccaacgacagaatcattaattattcgactgagtgaaaattgaaaaaagaattgtgtggccaaaaatgcctttcagcctttcattgtgccattctctttacatcaatcgcctcggcagatcagttgagacagtcgcgcgtttcgcctttgaacgacccggccaaattaagggtgcccagcggaaacactttttcggccacgggtccatcagtgatataactggcgggaagctgaacaattaaatgaagagaaagtgccaattgtgaaggcaattaaaaagaaaagtgccaaagaaattaaaagggaaagtgccaattaattcggcggaaaacacacgtcgatggaaatttttttgtagcacactttcttcagcgggttaagactttcgtcgtcgttgcaattcttaaaatgcgtttttcttcctttcttcgtccgcttttcctttgctcctcacgtgataaatgttcacttttggctctatcggagtgatttcgctctcttttccgctcagatggaaaaatccctcctcgtcggtcactccttcgtccattaggtcgtccatgtccgtgtcttcgggaatatcaacattttaggagttatatggagggaattggccaaattggtttcacataattgagttgagtgtatgccaatgccattttggtttgaatgccatcacttagtttcccttttccccctttttaccatcctcgtcgtacagtttcactttggcatgcgttggctttccattgcatgtcaaagtgccattgacagccgccgattggacataaccaatggaggggaaagtgagcgcggcatcggccaatggcacagcgaatgcgaaagccaacagaagcgaaaatttcatttccaacggatgccaaaaacgagattttattctctgcgaaaagagtaaatttgcaaattcggcatttttaaacccgaaaaagccaccaaatttcaaatccatcataaataaaattaaaataatttttagtgtcaaaatggacgggtaaaatattgacaatgaatgagaaacaattcacaacgaacgaatcgcgcggaaaatggacgacgacggcggacggacgaccgcccccccctccaccgcctccccttccctttgccccccaattcgccaatccccccaagggattactacgattttctcctcctccccccccccaccccttcacacaatcgacggggagtgtccctataatcgtcaattgtcatcataataatgacggccgccgatcgccaccactcaatcgactcaaaacggcgcaaaagaaggggaaaaagtgatgaaggcgacgtgaaaaagcaacaaaaaaaaacaaacgaacgaatcaatgcattttaagaagagaattaaattaatttattaaacgagtgaaagataaaaaagagctaaaaagtaaaaataaatacaaaccaataatattaaaaaagcgac

SEQ ID NO: 25802 - DNA, 1261 bp, Heterodera glycines
  misc_feature (13)..(13): n is a, c, g, or t
  misc_feature (24)..(24): n is a, c, g, or t
  misc_feature (97)..(97): n is a, c, g, or t
gtcgggttgttgnggatcgcagcncaaatcaggtgtaactttcatctaagactaaatacggccacgagtccgatagcgaacaagtaccgtgaggganagtgccaaagcactttgaagagagagttaaagaggacgtgaaaccgatgaggtggaaacggacagagctggcgtatctggtctgcattcacccgtttgttgctgtacgttggcctgctagcctccagactggggtttgctgtccttctgttcagtggcgaatggggcatttgcaggcggagtgcgctgagatgctcggagtagctgcgtgagctcggtcttgaggccagcctttcggggtctggtacccggatcgggggagtgctgtttactctgggtgaattgtgcaatggtttcgggtccgtgttgactcgagctgggggtcggtggcggtcgcgtgcgacacgtaccagcaaccagttcggtccagctcgggctctcagttgtgcgttctcggtgtaaaagccggtcatctgttcgacccgtcttgaaacacggaccaaggagtttagcgtatgcgcaagtcattgggtgttcaaaacccaaaggcgcaatgaaagtgaaggcttcttacggagctgatgtgtgatccctggcactgcggtgttggggcgcaacatagtcccgtctcgatcgcatgcgatggggcggagacagagcgtatgcgctgagacccgaaagatggtgaactattcctgagcaggatgaagccagaggaaactctggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagacctcataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggct

SEQ ID NO: 25803 - DNA, 1793 bp, Heterodera glycines
aaaattaaaaaacgggcgcgaagcggccgaatgttatcaactaaattaaaaaacgggcgcgaagcgcccatcctgaggccgcgaagcggcccaatgtccccccaaaaaattaaaaaacgggcgcgaagcgcccgtcctgaggccgcgaagcggtcaaattcccacaaaaaattaaaaaacgggcgcgaagcgcccgtcctgaggccgcgaagcggccggactccccccaaaaattaaaaaacgggcgcgaagcgcccgttctgaggccgcgaagcggccgaatgagtccacaatatttagaagcgcaaagcgcccgtctgaggccgcgaagcggccaaatgagtccacaatatttagaagcgcaaagcgcccgtctgaggccgcgatgcggccgaatgccgcctcaaaattaagaaacggacgcaaggcgccgtctgaggccgcaaagcggccgaatgtacaaaagggcgcggagcgccctttgagtccgcgaagcggccgaattaaaccttaaatataaaaagggtgcgtagcgccctttgaggccgcgaagcggccgatgtacaaaagggcgcggagcgcccttttgaggccgcgaagcggccgaaagtcctccacaaaattatgaatgcgtcctcgcgatgcctgtagaccaaaatcccttatcacatccataaattcatttcaaaatcgcgcatgcactagcaacgaagtcctttgcgcgaagcgctcatgtcagcgcccgcccatatataccaaaagtatactgtctacaccgtgcaatcactgcgcgtgcaagtcaactgcctgcaccgcgcccccgtcaattcccacacgctagtttatatatatatagagaaaaagggggactcgtcttaaaaaacaaaatctcccggccgaaggccgggagcgccctgaaagtagtggaagggtcttacaactttttgaggcgcatctgggaaaaatacgggtttttctctccggtggccaactgagtcccggcggctaatttctcacttttgtttttatttcaaggcccgtaactttttttctaaaactcgaatcaaaaaatgcccgctgcgagggcaccccgccaaagtgtcctctacatgctggtattttttatttttttaatagagccaccccctggcctgcagaaaatggcaactgaagcgtgctcaaaaagtacacttcagtaccaggcgaataccgcgtcggggttttatctgagggaaaggtgcccagcagacttattgtagagttttggaagctcgattttctgaaatttaaaaatttcgaaaattttcaaaatttttcgagctaggcctaaaaaacggtttttgggtttttgaattttaagaatttttaacgaattttcctggcaaaacgaagaccacttccaaaacatagtttttcgagctctatcgactggtatttttttcggaaaattttcgattttttcccggaaatagaaaaaatttttggcctgagcgggacatttgagtcctgggcccataactcgtcagtagttggttttagccaaaaaatgccttagagcaaaattgtagagctttttaagctctatcgaaaggtgtgctatatgcccggaaaatttcaaaaattttcgagctaggccccctagaaattttcaaaaattttttcgggggcgaaaacgggtgtgacaaatattttttctgcggtaaattaaggtgttgagttccaatttgacctttggttttccgtttcctgaattttggatttttttaaaaatcctttattttttgcaatttttt

SEQ ID NO: 25804 - DNA, 1402 bp, Heterodera glycines
atcatttgctccagtgaggcccaattgcgctgcttgtgtacattggaatgagttcggccagcactttcagtgcgcgctctttcagcactacgtcagcggtggcaaaaccattgatcagcaaagcctgtagcaatttgatcaccggccgccagcccaactcagtgccgatcagtccgatcacttccgattgggttttgcttaattaaatatatcgtcgattggcccattaattgatcagagaaatttcctttggacaaactcacaaaggctcaatgacactttcaagcgaaaggaaaagctgctttagggctgaatgatctgcagaatgtgcgttgatttgatcatttaaacgaaaagaggccgattcagctttgccagctgagactaaatattgcagcaaatcttccttgaatttgtcttccatttttgtgattttctaaattaaattaaaaaattattaaatataattgtttttaattaaacaatttaagcattaatttaataatatgtctgattgtttacagatattaaaaaggattattttaatttactctctccgtcttaacaagaattttgccttttcaaaagtcttaaatccatcgcaatcaattttggttctttgttttatgactttattttatttttatggaggagcggaagaaaaggcagagaaatgggcaaggaaaatgggaaaattttattgaaaacaaaatgagacagaagaaagaagagtttcacaaaaacatatcatttttcaaaaattagtaatacaaataaaataataaataaaaataattaaaaatttattttaaaaaatcgatgagagtgcgtaaaatttttagaaaatgcactagaaagattgattttcatgctaagtatagaaattccaataagcaaaatttgatttgattttattcaatcattgaagaatttaattttttccttatttcggattgttttggcgctaatagaaaataaaattatattattttagtctaatgaatagggatcggatttttagtgataaaaaatctcaaaataattaactaaatagtgaccaaaaaatgccaaaatagtggtaaaaatagtggcaaaaaagttccaaatttaggggtgtaattttttaaatagctgttttttaatttgaaaataatttaaaattaaggaaaaagattttattcactgattgcagttacaaactattttcttagaaaatattgaacaagaaaaaaaaaatttgggggaagaatttttgtgaaatttttccaattcttagggatgtatttttgaaaatttttaggtcgattcttaggggtatatttttgaaaattttttaggtcgattcttgggatgtatttttcatgtttattgcattttttgggaaattttccaaaaaatgcca

SEQ ID NO: 25805 - DNA, 1451 bp, Heterodera glycines
attggctggcggattttgttggggctgacgaggcgtctttaaaccggcggcggctgttcgacttgaggtgcctctttttctggcttcgtcttccaaaagatgtcgtcgcctgagctgattcgcgtgccgatgaacaagccgacgcagaacaggcacataaacacgatatgtgggcgaattgtgaagcctttcaacaatttttccctggagccactccgtcttattgttgcggtaattgatcagtaggacatgatcatttggggaaaaattgatcacttttgatccatgcttccgatcaaaattttgagccattttgtcggtgtattttgattgtccctttttgaatgagttttgatcaaaattttcggctttttctccattcggatgaacgagcgacaatttcgtgcgcaattttctgccgaaaaataattgatcgggtgaaaagccatttaaggcaacgtggggagtggttctgtaggagaacagcatcttttcgatccaatcctttccacctttggacattttcttcatcgatcgcttgaaggtgtcaacgaatcgttccacttggccattcgattgtgggtgaaatggcggtatgaaaatgtgcttgattccaaattctttacagaatgtggcgaattcggcggatcgaaattgggtcccgttgtcggaaacaatttcctctgggattccgagccgataaatgattgatcggagaacaaatacggtggcataagcagaaattgtattcatacgatagacttctggccactttgaaaatgagtcgatcaaaatcaaatattggtgaccgtctgagcaggggccagcaaaatcgatgtggactcgctgaaacactttgtccgtcgttggccatggcgaaagaggcgctttggtcgggtttttctggcccagttggcactcttcgcaagtgctcacaactttttcgatcgctgagtccattcccggccaatacacgtgacgtcgagcaagtgctttcatgcgcacaatgcctgggtgagcgatgtgcaatgccttaaggatgcgactgcgaagcgaagttgggacgatcacacggtcctcatacagtaggcaattgtccacttcaaaaattttgtcccgttttggaaaatatggactaatttcagaatcagcgacttttgctggccatccatttctcaaaaattgaagaaccgtttgaagtggttgatcattggccatttctgctgtaatttcgactgttgtcacggggagctgatccattctgttttcgaaaacagaattaatgtagcaatctgtatcggcacagatgtttgctatcaggatgtcttcctctggacgcgaataattggcaataagccgtgacagaacgtcggcttggccaaatgatgtggtgtttacgtagcgaatttcaaaatcgtaattcgccaaaaccatggaccagcgctggaggc

SEQ ID NO: 25806 - DNA, 1544 bp, Heterodera glycines
ttttccggtggtctaggcccgactctttgcttttttttcactaaacgagtcgggattgtgtctttttttccggtggtctaggcccgactctttgcttttttttcactaaacgagtcgggattgtgtctttttttccggtggtctaggcccgactctttgcttttttttcactaaacgagtcgggattgtgtctttttttccggtggtctaggcccgactctttgttttttttcactaaacgagtcgggattgtgtctttttttccggtggtctaggcccgactctttgctttttttttcactaaacgagtcgggattgtgtctttttttccggtggtctaggcccgactctttgcttttttttcactaaacgagtcgggattgtgtctttttttccggtggtctaggcccgactctttgttttttttcactaaacgagtcgggattgtgtcttgttttccggtggtctaggcccgactctgcttttttttcactaaacgagtcgggattggtctttttttccggtggtctaggcccgactctttgcttttttttcactaaacgagtcgggattgtgtctttttttcgctgggcgggcccgactctttgtttttttttcactaaacgagtcgggattgtgtctttttcgctgggcgggcccgattcgttcatttccaaaaaaccttggttgccagctccggccattccaagctgtcaaagccatctccgacgcaacgcgtgaagaagacctcttccgccgcacggccacctagcgacaattgaagcttcgccttcaattgcgcccgggtgtatctgtgctgggccggtggttggaaatggaccgcgcctgcactgccatctctcgggtcagcggctgccgtgatctgaacccaacaaattttgggattttttacgcttttttcacgcttaacattttttttttgatctccatttatacaaaataagacacttagagctatcgaatgatttgatagggtaactctggagggtgaatgtgtttttttgtgttgttgaaaaaattagtgaaatgggccaagaccaatgggccctgttacaatttttctttccggttgtttgctttttatttaaaaaaaaaaataataaccttgcgaaactcgtcaacacaatccacttcgtcccagaggaacttcagatggcccacctcgtgtaggcaaattcggcccggcgtcaattcatccaactgttcgccctcgtcaatgctatgcaaaaattccgcctcttcggcgcgtcttttcctttgtgccagttcccgattcgttggcatttccattattaacaaaagaaaatatgatgaaaataacggagctaaactgaagtgtttaattggctacaacaacctaggggaacggtgcagatacgtagaaacgggtacaagaatttgtcaatttaaaagatataggcgatgaattcatttaagaaaatgcttaagacgcaagagtgaaaaagagttagctgtcatcagattcattttcgaatgttgtatctagctctctaagagctttc

SEQ ID NO: 25807 - DNA, 1437 bp, Heterodera glycines
aaattcccggttggttccagtcccggacgaaaatcaaggtcccggttccgacttttctggtcccgataagtcccggtcccggtttttgtcaaaattcccggtcccttgcaactctaatattagcttttttgctaacttgctatagcctaatatgcacgaaaacgagtttttaacttggtttgaagcttttatcttgaactttttggtgcatttttttgccttttttgcgatttatttttttgaaaaaacggtaaatttttagaaaattttgcaactttttctaccatattttattacaatttccaaaaaattttccggcggcgcctatcggcaccgccggaccttcattttaccttaatttttgaaattttaattacaaaatgggtagaatttgtcattttttatctgagaaaaagatcgaaccggaaaatgcagattttttttttgcatcacaacctcaaaagctattggtaaaattaaaaaaaaatttcgcttttcgcattttcgcatattttggcttttcgcatttcgctttttatttttcaatttggcccatctctgctaccaacccctacctggagacgggaacatggaaacggcagatgaatccgccgagtttggcccaaatggaaagtaatggccaaggattggagatggtgccattgttggtggtgggctgtgccgcagagcatggttctgcgcaacaacgatggactgatttggctgacaatgagcaatggcacgagagggccccggcaccagcggagtggactgtgcaattggaagaccctggaaaatgaagaaaaaattcataaaaagccttctataaaactttcgaggtgtttgttcccccgcctcccgctccccaggccgcggaaaattttaaaaaataataaaatttttcgttttctaacttttttttcaagtgctttacgatagtttactccccaagtgaacattaaaattaaaataatttttttgaaatttttctgaacccttccatttatcgaaactctttaaaaaaaaatcaaaataatttttgaaaactcgaaattatttattttttaattaaattattgcttttaccaaattttctttctcctcaatcctacgctttttgcactttgtctgttcttcattggtctgctgatgctgatcacttttggctttatcgtctgccgcttctgttgtctggatcggttcttgttgatcagttgggcttgtcattttagaaaattataagtcagacttttttaaaccgtcaaaaaatgtttttattaaaaaaataaataactaaattatgcaaattttatccttttccccagggttcatcaatttcatccttcccatttaacaaaaagtttctttaattattttttaaaattcagttgatggaaaatatttgaaattttcatttctgtcccctcctctacccat

SEQ ID NO: 25808 - DNA, 1923 bp, Heterodera glycines
  misc_feature (1818)..(1818): n is a, c, g, or t
  misc_feature (1866)..(1866): n is a, c, g, or t
acaatagacaggaacccggacgaacgggactaattgtcccattttgtcaggattcatttgtcctgacattttacccaaagagaaatctcggcaaacgcaaagcggaatcccgcaaatttgaaattcccgggctctagaaaattttgtacaaaaaacataggtttattgcaggctaattaggattgaattataagtaacttcaaaatttcacagattcatttcagcaattactttttttttacataatgccaagcctattttacattgccaaaatgccatcggattgattttcttttgtaaaataaatgccaaattctattaaggcaagaattattctcttcatgcctattcacattaatgcccttttacacgtgttggacaatgcacataaattcccagcagatcctccaaaatggcattcattcatttgttttttttaatttctaaaaatgcgtcggattccttttgcccaactgttcattctgctgaacattataattgaaattgtcatttttgtggatgggatggaccagtcccaatttgaaatgattgactattatggcacaacggagaagaaagacattgaaaaagcaaaacaaattcgcaacacatttgtcaccattggcattgtgaaattggaaaaatgaaaaatccagaagaaattggtgaggaagaatccgctgaagaattggttaaattgtgtgaaaaatggaaaatgatggcattggcagtcgatgcatttgtggggggagatttaaatgtgaaaccacaatttgaactggtggtaaaacagcagctggacagaacccatcatcaactcctaatgagctcagcaatggaagcgatcaaaacagttaaccgggacttattcacatggggcaaagggaatggattaaaagtcgagctaatttttgatttttttttaattttatagttatttttttagattattttggtaaatgagaaggattgcgaccttgatcaattgttatggactgatacgagaaaaaatttggatgggttaagtgcaacattaaagtgttgtagaaggtttcggtgcaactcgggctcggtaattgaaaattataataaaatcttttttttaaagctaagatttattattaaattttgaaaaattttaaaacctgaaaattggtcaacaatttgcaatgctggaaaggatcacgagaaaaaagttactaatgaaccggattattctttgaaaaaagactttgtattattgcgccaattcgaccaaggaaattctctgaaacttgaaagatatattggcgttttgttaatggaatacaaaactcaaaaacaaatggtagcaacggacccatgtgaggaggccaaactgaaagtgatcaaactgatgaaagatgtacagaaatcattggacaaaaaggaaaaagatggagtgaccaaaactgacaaaggcggactgaacgaactgatcaaaatggagaaactgaagtcgaaaaccggtacacgcaatgacaaagcaaagtgatcggagatgaaaaaagactgatcacaagtcaaaatggtgatcagagtgaggaaacgaagtgaagagtttttagatcattagtctgttttgtgcactatcatcatcacttttcttttgggtggcttttctttctagcataaatttttccatttccttgaccaaatgctttaatccgattggatcaatgaaaacttttaaattttgctaagcaataggatggaatgtaaggacatgtaaatgcgccgtaaatggtttagatcatgtggttgtttatgtaaaggaatgtttaattaagtgtcatttangcattttgtcaaagtttatcctttacaaaattcgacaatttatatagnacgttttcgccacccgtataaaaccggtacaaattttttccttataaaaaatgcctt

SEQ ID NO: 25809 - DNA, 1164 bp, Heterodera glycines
tttgaaaaaaaaataaaataataggagactcagaattttgaaaattttttataaaaactgatgacaagctaatgtgataaaacaggttaattcttttcctttcagtatccctgcaaagtttggggcgcttctgataagtttatgaaaaaaaagttaagcctaaactttttggcctgtttaaaaaggaattaaaaatttttaaaaatttattcatctccctttttgatagaaaaagcatcagagtgcctaaactagcatgtaaataaaatttggtgcgtttcagagcattttctgaaaaaaatatttatgaattaattatgcaaaaataaaaaaaaatttctaaaaatttgatcgtccataaataatttgtaattgatcaggggctcaccaaaataaattttcttagaattttttgcctggtggtacgcttctgctcaattagcaaaaaatatgagtgattgaattttcactaaaaaagttaagcctacattttttggcatatttaaaaagcaattaaaaaatttttaaaatttaatatctgggcgcatcggttcggggggactgccccgaaaacaaaaaaatcgattttttcaagtgtccgtttggggtactcaaacaattatggggagcaaaaatccaaggtaaaaataaagtagaggtatatcgaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaaaaaagttaagcctaaactttttggcctgtttaaaaaggaattaaaaattttttaaaatttattcatctccctttttgatagaaaaagcatcagagtacctaaactaacatgtaaataaaatttggtgcgttccagag

SEQ ID NO: 25810 - DNA, 1353 bp, Heterodera glycines
  misc_feature (1316)..(1316): n is a, c, g, or t
tcccgaatgcacaaaatcactttttatttatgtatttttaatttaacagatgataaaaaggtcggataaattttattataatagagcaaaaaattgcggattttttaagtatttaaaatttcaaaaacacctttacagaccgagcttctgaatttttttctgaaaaatcgcaaatttccagaatttctggaataactttttttgtttttgtggtataaatttcaaataaatctcataaaattctcccgattttttactattttttatgctgtaaaagagctgaattggaccattttgaggcgagttatgaattttcaaagaatcactttaattctcaaatccaaaaaattgacgatttttcaaaatttttttaccaccctccaaaaaatccaaaacgcaatataaagtgcatattcgtgttcagcacctcaaattagcccagaaaagtattttttggcaattttaggagcaaaaaagtttctcatgaaatgcaaatccatggggtcccccctttggttttgcatttaaatattcatttttattttatatctttttttatattaaagataaaaataccggataaagcacattagatagagcttaaaattctctacaaaaatgctctaagacaatttttcgttaaaatcaacccctgacgagttataggcccgggactgaaatgtcccgctcaagccaaaaaaaatttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatactcaagcggcgccaacccgctccgcttaacccccagcgagttattcccgaaaaacggaaaatgccgaaattgggtaccaaattttgccattttctgcagcattggcatttaaagatagccccgccaaataagcgccaagttttcccaaacattccaacttaaaatcctacctccaagcattttccgctcccgcttcttcccgcaaagttacaggccaccaaagacggacacaaaaaatttcacgccgtttcagcgccgccggcgctgaaccgtccaccggagcggaaaacccatatttttcccagatgcgcctcaaaaagttgtaagacccttccaccactttcagacccctcccgacggccgttcgactcaaattagtttttaagacgnagtccccctttttctctatggtaatataaacgagcgt

SEQ ID NO: 25811 - DNA, 1236 bp, Heterodera glycines
tattcgtattacttttcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccttattgtttaattctgcctttcctataagcacaatgtgtttgatgggctctacaaaatattgcttctgcaaagcaattattttcttggaggctgtaattttctgtagtcatttgatatgcatctgctatttttctagtcacaaacaacaatatttttcggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgccttctatacttaattcatccataatgggccaaaaatcataagttaagaccaaaagagggattttagtttcagccggaatttctataaaaatgttcgtgtgtaacctatctttgtctattctgataagtaagaaattgaaatattcgtattactttgcctcccttaaagctttataatgaaagcgtcgttgtctattttggatttgccgttgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattcggcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggagacacccaaaatttgaaaaacgtctgtaatttagcctcttttaaatattaattttctgaaacccgaattgagaaaatatgaatgaaggagagcgacgccttctatacttaattcggccataa

SEQ ID NO: 25812 - DNA, 1429 bp, Heterodera glycines
ccccccccccccccactccgtcaattcattttgccaccccccctaattctttttgatttcacataatttataaataatattttcatctttaattagcatcatgccattttcattctctgttcaataatatgttttgtattcatgttgtattattttccccattttgatattaaatatgacaatagttcagttggatgcttttttacgtttcatctttcgacgatagtccaaaaaataacaaatttaaaaatagtaaaaaataattacgccttttccagtgaaaataataaatggaaagttgaggataagggaagaagaaaaataataggaaataaaggatgagttgagaaggagtaaagcttaccggaaaagggcaattgaaaggaaatgagggaaaggtgagcagaagagggaaaacagagagaaaagcaacaaaatgaaatgggggaaaagggggactggcagagaaagagagaggggagagagagaggcaggagagagggacaacggaagggagagaagagggacggaacaaattaacaaacaaataaaagtgttgttcggttggcctttttgttgccatttgcaaatgcttataattagcaaattggccactgattggtccggcgttccttgcgttctgttccgatcgcttttggctgtttatcgcttccttctcttcccttcagaacattttctgctgatttgtgtcgccgacttcggccattgtcgccgtttgcgtcgcgttttgctgcgcggcgggcggtgagccgagcagcgcggaggccaacttttgctgggcggcgatcagctgggcgatcagttgctgttgctgatcagcaacaatggccgactgagcgaagaacggagacggcacagtgccgaaaagaagggacgacggaaaggcgggcggaaatagtccgccgccgacggaggacggcgaaagcggcgagtcgggcagagaagcggcggacaaaacgccagatagaagagacagaccgttgagcggtctgaacaaacaaaccattgcaaatggaagggggcagaggaaaagcattgaggggaaaaggcagtgatggctttgagatcattggatgaaaggaaagataaggcagcgaaagtcagtttcagtccctacattttcagtccgggaagttattacgacccccttttcaccgtaatttatcccgttctattcaatttaatgatggttcatccgctctccgactccgcttaccttcctccgttctgttgagggatcatcggttcaaaatgcgcagtcagacccgacatttttggcgttatgtttgggaaagtgcccggtccgtgcccgctgagagtgttctgcactttgcgctgctcccatgccaccaatgtgcgtcgcctaaagtaagattgtcttgatttcccagaggagtcattttctttt

SEQ ID NO: 25813 - DNA, 1828 bp, Heterodera glycines
  misc_feature (1820)..(1820): n is a, c, g, or t
ttttggtctcgagtctcgggttttcatctcggtctttgagactcaaaaccaagacttttttatacccctatgttttgcttttggtaaacattaatttaataaatttttagtgacgtatactcatattcgtggtccagtggtttgtgattttgttgttttctttgctttggatcagtgccactccatgtagttgttttacgtttaattttctaaattattcctttttacgaaggaaattaaataattttctacaattaaaatcgcaaaattttgtcttttttggactaaatctattaacaaagtgcaataagaattcaaaattttccccggcggcgcctatcggcaccgccgtacccctaaaaagtgaatggatacggtatttggcagatttatttttatccttttttttttgtcgaaccattctaaattttatctaatttttgatataataaagcaataaattctatttattttaagttggcaaattcactatatgtggccatttgtaatgatatgttgtccttgattttgatttgagattcgtctaaagacaaacggaaactccgattgaaatgtttgacgcactaaaataattttaaaaattctttaaaaaacacctcgtaaattgcgtaaaattgtcttttttgatgacacaaattaaaaaaaaaggggaaccataaacccttattagtcaagaaaaaaccttaataccagttggaatagcaataattatagtagctgcactaaaataggcacgactggtttttttttttgaataaaaaaaattttttttagttatttttttctctttctttctacacaccaatgtgcaaagaaaggtattgcagcaatcaattaacaaacccaagcagtgattggagattaaattggtgacttgaccagcagaagtatgtagattaaataattgaaacagcgatggtgcaaaaagtgatcgaaacgtacgatgattgaaatgattaaatgatgacaaacttataaaaacaaacaaacaaataaataacaattgtcattaaaatgaagaaaagccatattattcggtgatgagaagggccctgaatttgaatatcgattatacagccagcgattatctagccatcatacaaatttataatatgataaaatgtaatacaaaatcctaaaccaattctatgaaaattaatgttgtgtagttaaagaaaatcggatattgcttttactatagaaaaacccaaaataaaatcagattttaattttctaatatttctcagaaattattctaatcagccgatcaaagccgttgaaaacacgtcggagaaattgccgcgaaatttgataatctaaaacattattttgtgttgttaccaattgcaaaccgtggaataaaagcgcttttcactgctaaacgaaatgtaattctgtcaaaaatgcagtgtaaacaaacagaaatggccagctttgtgaagcaattcaaaatggagcaaagtgccaaaagataggtaaataatggtggcacgtaatgacattaattagcaaggattcgtaaaaaaataattttatagcctaataattcattccacatttggcggttacatcaattagagcagaactatttaaaataattcgaaataagcaattaatgcaaaatagaagcacatccaatgagcgcgatcagcttggatttgcattttgaatttcaaataaaacgaaaaaaattaattggaaaaaattattatttaatattaaataactgtattgtgtttaaatcagggttctcatctgtgatttgtacagaaatgttctgatttttggggggcgaccanaaatttgt

SEQ ID NO: 25814 - DNA, 1418 bp, Heterodera glycines
gcaaaaaacatagcatgttcaatgctttatcacttctataatacttaaattaaaaattttagaaaatcatattgtgatagagaacaattaaggctattaaatgatatcacgaaatattaatttggtatgaatttgaaccaggctatgaatttatatatattacccattatttgttttcaaacccattgacggatttaagaaacgcgctggcggatttaagaaacgcaccagcacctttaaatgcattagtggcagaaggatgcgatctcaaatctcaaaaagcgggcacagagtcaaatttagcaaattgttttttgccccattttacaagtacttaaccactggaatagtaaacagccggcgggaaattccgaaggtaccatcagaaagaaagcgccgcaagaaactaaggttgagccccgacccctcgggggcaaaatgtcgggggtcggggaccccgatcgggtagtgagtgatcaacaaaattttttaacgaaaaagcctttttctttttaaagctaatcttcctttttcactttaatcatctgattcaaattcattcgttggcgccagtaaaagcgtccaaattggcattttataaccgggcattccgatgctccaaaaattgtcagaattcgaaaatcggaattccgagattaaaaagtttttgcggtgcgcttttcaaaattttttttagaacatggggggaggtccgggcgtaccgttaggaaccgccataaaaaattttaaaaatttgagcaatttgtttaacagattttgcccaaaaaattggcaatatttgcgatttcggaacaatttctaggaaaaattaggtgttttggagagccgacggtgccgataggcgtcgctggaaaaatctttcggaatttttaatgaatatcttaaagaaaatcttttcaactttcaaattccccccttcgtcgttgaattaacttttaaattttacaacgcttggagtccttgattccggggggggggcacatgtcgggtcgggaaataggcccaaaaatgtcgggggccgggcggctcggggtcggggcttaaccctagaagaaacctctaacttttgtcaaattcttaaagtaagtatttttcttacctttgtcctaggattttatcaacgaatagtactgtaataataaataattaaattaataataataaaacttcaaaacccaaagtatttcattaaaaattctgttaaaattagcatggatttgttaaattggcttttatcactccctaagcttgatattttacctttttttaatttcaatgccggaaggaacttccaaacttcccactttccgtgtacaaagatgtcaaaattgttttcccttttctcgaaattgccccctttccggtccgttgctttcttccaaaaccgttttaaataa

SEQ ID NO: 25815 - DNA, 2780 bp, Heterodera glycines
gccgcggtgagctgttgaattgtagcgtcacccatctaaccacagctcgtagactttcttctcagctcgagagtactcgttttaaaaagtagtgtcgttcaccactacaagtgggtgcgcgtggaagagctataaacagcagcgcaaaaaaggctctgatttgaaaaaatggcagtccactgaattgttagctgcccaaagttcgattgttgtcgagacgttgccaattgttacgccccaaagtccaaaggggaataaaacaatatttattcaaaagagaaaaggacaagggcgaacggggtcagagatatcgattgggaataataacgccaaaatataattaaacaaattatcggtccaatcaaacaatatcatatctctactcattacagtgtatgccatgcgacagtgtccattttgggcattaatcttggcaaaagataatggctttaagtcctttttttctcctcatttggcaggattaattaagtgtcattgtccttatttccaaaaattgtccttggtcttgttattcgactaattttttggagaatttggtaatcttttaattgttataattttcctgttgtgccaacaagcgacccaccaaatgccttggcatttttgaaccatttgtaaaatttattatttaataggcaataaagaccaaacactaataataaatacaggtcagaaacacgccttttgcgcgtcaatttctgctcgactgggccaagttggaattttcacagccaaaattttcgagcgcagacaatggcgcattgcaagtgaaaaatgagaacgaaaatgaatataaattttaaaatatttaaaatgaatttaaattttaaaatatttaatctaatttagctgcatattctgaagacagttttgccaaatggccaaaatcaaaattgaggtgagaaaggggaaaaatgccgaaaaagttgagcataaaataggccaaggaaaatgtgccaatgatacagtacctaattgagcctgacatcgcaggaacagcttaaaaaactttcattacaaaatcacgttttacatcaataagagtactgtgtgtaggcttctttccctacaaaacctattttctaggtttttatttttagagccaaaaaagccttaaaattaaaaaaaacctattatggtttttttcccaatattaacaaaatgcaataaaaacgaaaacacactcttaagaatcgacccaaaattttttttcaaaaatacacccctaaaatccacgaaaattttctgaaaatacaccacctaataaataaaaaattttctcaaatattgatcgccaaatctaatcagtgaaactacaccaaatttgaaaaaaattaataatattttggcgacatgtccttagtccaaagtttgaagatactatgggtcaagcccagtgttagacaaaattgctcataacgccaaatagcgtaattggcgtaaattatttcgcgctaattcaaatttacgctgatcactgccattatgattgtttattttgatcagtcataaccttcttcatttccaactaaattgaacaaaatttgtatctaaaaattgtttttgaaaaggagagtcttttttaagcgaatgttaagcaatttaactcatttcaaatcactcaaattttttgaaatgaaaaagtgaaaaaaatatttataagtgaggtgaaaatttggtcaaaaatctgggtagttgtcattttcttggttgttctctacgcctcggtcctgcagtgcattcaacatcgtcgtgtgcttcaccagtttttcaacgatcttctcttgtgtgccgagatgagagtaacgaccaacctaaaattaaactttcaatgatcaaaaaaagttgaagcaccaaattgttgcacattctgtgcatctgttccattccttgttcgctgatcaaaccccaccaaagatgagagcgggcagaagggacgacatgggcagtgagaaggtgcagcttcggtcggacggggtaacgggcgatgtcaattgatcggagttgctgccagtgcgcgtagaacaacttcgtccaatgttcaagcgaatttagatcctctggatgaagaatttaggcacgcgataggcggcaaatgtggcggaggtcattcatggcgtcgaccagcaaaaatttcaacggtccagcaggaattggtgccgtgaataaagcgaagttttcgtggtcgaggattttgcagatgtcgccacctgtcaaaagttgggctcaacaacccccaccctatccccatcattctacccgtgaattgttttgtccgagggtgccgtcgcacgccgacatcagacagtcgtttccgaacaacgtcccccttagcgtccgcttccgaacaaatggcgtcaattattcgctggtcattgcctgtaaattctgaatcttttttaaattcgttttcttcaccatgcaaaagatggaaactcggcggtacaacattggccaaagcaatgttgacgagtggagagccggtgtacgaattatggggtgggggatgcgacgggcgggcatccacaattttgtccgacaattggtcccgccgagctgtacaaagcggacaagggaaggtcgccgcagatccctggtgccccatcagcgccgaagtgaatttgaggtcggcatagagaagcctgaaaataaaaattagcatttctgatttttatttctttacatttggactggaatggtccgcttcctcccggcgatttcgaatgcaacggttttccggctggttcaattgcgcaaaa

SEQ ID NO: 25816 - DNA, 1514 bp, Heterodera glycines
attgttgacgacttttgacacttttcaccattaacgtggaaaaaatgaataaactaattagtttgtttagttgttatattacccgctttatatcgtcatggaccaatataaaagcggtggaaatattcacaaaaaagcactttcgatttattcgactattcaattaaacaatttcaattgaaaatgaattgccaaatatggttcggccaattgatgtgcattatgttgctgatggtgtccacggattatgttgtatcccaagacgattcatctacatcctcaagctcgtcaacgagtacgtcaacttcgaccagtactagcacgagcacatcgaccacgaccccaagcacaactttgaccagcacgtcgaccagcactgcaaccacgcccacttcgacttcgaccagtacctcgaccacaccgacttcaacttcaaccagtacgtcgcccagcacttcgaccatcccaacttctacttcgaccagtacctcgaccacgccgacttcaacttcaaccagtacgtcgaccagcactttgaccaccccaacttcaacctcgaccagtacatcgaccacaccgacttcaacttcaaccggtacatcgaccagcacttcaaccacgcccacttctacttcgaccagtacctcgaccacgccgacttcaacttcaaccagtacgtcgaccagcacttcgaccaccccaacttcaacctcgaccagtacatcgacatcaacgagttcttcgacatcaacttctacgagcacctcaactacaacacccacttcaacttcgaccagtacatcgaccacaccgacttcaacttcaaccagtacatcgaccacaccaacttcgacttcaaccagtacatcgaccagcacttcaaccagtacttcgaccacaccgacttcgaccagttcttcgacttcaacgagtacttcaacgactacaccaactacgaccagcagttcgtcaaccacaactaatccgtcgtccagcagctgtaccaacgcggctggtgacagagcgtgcaacttttacaagaataggtgcaaccgattttcggcatggcttaaacagcattgtgccaaagcatgcaacatgtgcccatcaacgaccaccagcacttcaactacaacctcgacttcaacaagcacctcatctaccacgaccaaatcgtcaggtggttcatccggtagctgcattgaccgtattggtgcccgactgtgcagccgttacagtaggatgtgcaaccgttttggcatttggatgagactgttctgtgccaacacttgcaaaatgtgttgaaaaaacaatgaaaacagatggatgtgaggaggaatttgtgaagaaaaagataaaaattaaacaaattgaaaagatatttatttgttaattgaatttatacacaatatatatttgttatttaaattttatgttttgtttaaatgggataaaattatgaaaaaattgttttctaagaaatgcttcgtttttgaacaatttatgtgaaaatt

SEQ ID NO: 25817 - DNA, 1486 bp, Heterodera glycines
atgccattcccattccccccccaaaaatgccattcatactctcattaactttttcttcattcagttgactttttttgccgctttcatggccatcatgggcaatgttgagcagcagggcaagcactgcttgttgctccgccagcaacaaccgcctcgggggaaagaagcgcaagtttcttccgactcattaacatccattaatcctccgagcggcacatcatcatcaccatcatccacatcattatcaaccgccgctgatgtgccgtcccaatgcaacgcaaggcattgccaacatccggcaacgccgacaacggcacagattactgatcaggaagaggtggcagcagaagcatcgtcggcaagagctgctgatcatctgcagctggatatcgatcagaccagcatgaatgcctcctttgacagcgatcagaccggcaaggatgaatatgatcagagcactgatcagagatgggtgcttgatcaaactgtaggcagcgatcggatcagtgatcaatatttgagggctgctggtcaaaatcgaagggctgcccggaaatgggagattgatcacgatcagagcgctgatcagaactggaacagtgatcagagccaaattcctgtgcagcagatatggaagagagatcgaaatcggagcccatatagaaatgatcagagtcggagcactgcgcagaatcgagcgactgatcagaatttgagaaatgatcggaattgggcgattgatcagtctgagaatgctgatcataaatgtggtgccgatcagcgatgggtcaagattgatcagaatgggctggacaataatcggctgtcgtcttctgatcacacatttgtctccccttctccaccttccactgatcatcatcatcatcatctccatgcttccaatttttcccatcgctttttcggccactattttggccctctgctcctccatccgatcgttcgtgcactgatcactgttggctacatggcttacattggcattgcgatcgctggctgtatgaattttcgcgaggggttggagccaagccacttggtcacctctgatcattacattgcccgctactttgatgacatgaaaacattttggaagatgggcccacagcttcatattgcggtgatttggggcaaaagcatgggactctgatcactttgttgattacaattagtgttaagccatgttggtctcggttccttttggtttgcatttatccgatccccgaaatattccgcctcgaaaattccggaaattgtgaccattttgtttcgagataaccctaaacggttactttattaattagtagtcaatgataatcagagggagaaaagaccaaccgatcaaaataaaacgggctcatcaaatcatccgggagcgaccatctctgatcactttttttggagggggtgccaaaattgaatttgattggtcactgtggcataataaccaactgatgattggtgattggtc

SEQ ID NO: 25818 - DNA, 1452 bp, Heterodera glycines
atttttaatatatttacattctgaacagcttacaaaaacaaatgcatttaaaaccaattgacaaataaatgaaaaaatttgggacaaacatgttcgaaccattcaaataatcttggtattttacgatagctcttgtaattttctattatgaagaaaatttaagaaattttatttggtttcaaaaagttatgacatttttgtttgaacatgttttgctacaagttattaccttttttttaattcccttttgcttttaggaaaaaaatattaatttctctttttctttgaatttccagatttttggaggatattaatcctaattagaaaaataatcaatatgaaataaaactaattatttaataacaaataaaaaatacttttgaattatattttcagaaatttttcttgtaattagagcaatctgacaggctatttatgatatgtacctttattatttaatttggttttttttaagaaaaaacataaattgaattgttattatgtttatatccatgaagaaagtgcattcatccctttcatggatcatttaataaaaaatttttgcttgttcttgaaatagagcggataattcacataaaatatttataaagctgaaaatgtaagttatgttatggaaaaaaaaggtttttaaatttggcaaaatgttcagaaagggttaattttacttcttctatgaaccaacaacaatttttctgacaatcaaaaaaaaaccacaaatttctcattctgctggtgctttctgatgatcttcactcccaaaattgtccagcaaatccaaagtctcatttatggcgcggtccctctgaatatttacaaattgaatattaaatgtatttaaaatgattttaatatttattatttttttacctcattctcttgctgattctgatcattttgtttaccggtaaaatttgccaacaaatcctgcgttatttttggcactcgcttttcatttggcaattctctttgttcacttggtcctgccccatcggttccatcattaattcggcgtcctaattttttttagtaaattaaaaataaaataatttattccaaaaatatttttgatactttttgaatcggaatatttttttgttctaaagcatttccattttaattctgtcgatgatccattgttatgaatgaccaggttataattgatgtcaggctcaaaaatattgctctgcttaggattggggcattttgtttcgcgatatagttcactcttaattaataatgtattttaattatattttatttttaattaataatttatacttaaactttatcattatatttaaaaagaatttgttttttcattccaatgaacaaaagattttatttgggctttttatataataaaagattttggtactttcctgctttgaaaggcacaccccctttttaaaaaaattgcaacaaagagccgtt

SEQ ID NO: 25819 - DNA, 1527 bp, Heterodera glycines
  misc_feature (65)..(65): n is a, c, g, or t
  misc_feature (87)..(87): n is a, c, g, or t
  misc_feature (102)..(102): n is a, c, g, or t
gtcagttcatttaaatatttttatccaaaaaattttttttgggtttcgggggcagtccccctganccgatgcgcccagattatgggngagacgaaatccttncggaatagcttcactatagcctgtacttaatttctgcgtgggatttttgctccccataattgttggagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttgttttttgcataattaattcataaatatttttttcagaaaatgctctgaaacacacccaaattttatttacatgctagtttaggcactctgatg

SEQ ID NO: 25820 - DNA, 1323 bp, Heterodera glycines
cgttgcacctgactgaccaacgtgggagtaataagagtcatgttttgaaaagtcattcttaaaactgcttatttaaaattctggcattttttataaacagtatgagaatatcaattacaaaagtgaaggtttgccataattatgggcaattgtaactgttccaaaattctatgcagaaaaaagcaaaatattcaattataaaatgctcatcctagaaatcaatgctctgattatgaaaaaatgtgcttaaacaactcaatagttggagccgccttttgtatgacatggaaattttggcagctttgcaaaaaagaggagcataaaagattttccatgataaaaagcaaaaaattaaatgtacgcccaaaggtctaatcgagaaactttgaaaagtttgggctatttaagcaagcatatgattagcctatgagctatgatgaacgacgttgcacctgaatgaccaacgtggagtaataagagtcatgttttgaaaagtcattcttaaaactgcttatttaaaattctggcattttttataaacagtatgagaatatcaattacaaaagtgaaggtttgccataattatgggcaattgtaacagttcaaaaattctatgcataaaaaaagcaaaatattcaattataaaatgctcatcctagaaatcaatgctctgattatgaaaaaatgtgcttataacaattcaatagttggagccgccttttgtatgacatggaaattttggcagctttgcaaaaaagaggagcataaaagattttccatgataaaaagcaaaaaattaaatgtacgcccaaaggtctaattgagaaactttgaaaagtttgggctatttaagcaaacatatgattagcctatgagatatgatgaacgacgttgcacctgaatgaccaacgtggagtaataagagtcatgttttgaaagtcattcttaaaactgcttatttaaaattctggcattttttataaacagtatgagaatatcaattacaaaagtgaagctttgccataattatgggcaattgtaactgttcaaaaattctatgcagaaaaaagcaaaatattcaattataaaatgctcatcctagaaatcaatgctctgattatgaaaaaatgtgcttataacaactcaatagttggagccgccttttgtatgacatggaaattttggcagctttgcaaaaaagaggagcataaaagattttccatgctaaaagcaaaaaaataaatgtacgcccaaaggtctaatcgagaaactttgaaaagtttgggctatttaagcaagcatatgattagcctatgagctatg

SEQ ID NO: 25821 - DNA, 1173 bp, Heterodera glycines
cacaagtcaggagagggagatggaagtgaccaaactgacgggggcaaaagtcaaagtgtggtcccgagtttggaatgagacggtgtcccaacttcaccactgatggcatggggtgggcattgggtcggattcgttcaccgccctttcctccaaaggatcttccgcgcccgaaattctgctctcggtgattgaaatcttcgccaacaatttcgaggcgggtgaccttgggcccaggtaaacggagctccgttgtccattcattcattcattcactgctccgccgtccctttggcagcacaatcgtcggcagtgccgccttcaacttgttcatcatcgtcggcatttgcatcatggccagtccatcccatcccatcccccgcttattcctccctccttctgctgtttaggtgattccctccaatgaaatccgccgcattgaccgtgtcgacgtcttttgggtcaccgtcctttggtcgtccttcgcttacgtttggctttttctcattctttgtgtgttctctccgaatgtcgtcgatgtgcgtttaattccttgatgcttctcaatttgccatttttctaaggtatgggaaggcattctgacgttgattttctttcccctcaccgtcgtctccgctttcgtcgccaataaacacgcaaaatcatttggcaaacgcattctcaccaccaaagcaatcacttcttttcgccacacgccccggctgagcaaacaaaagcggagagacagtgccaagtcgaatggcaacggagtgagcagcgacacggagtaagaaaaaaagaagaggggggggggaagattggcaatggcacgggaaatcattgccaatggcactgaaattgggcaaccaatgccattgaattgtcgcttatattctccaaattgaccaatttgtagagttgcgcttttggaccaattgaatggcgattcgaatgcacttgtgaaacagaaacatttcttggaaataatcaaaagacttcgaaatgaaaatccgaatttatccgttgcggagttgcagcaattggcctcttcgttaattttcaccgaagtgccaaagagtcgcgccttttaccgaattcaggggattcggagaatgaccggcaacggggacatctcgtcgaagaaattccgggagcaagcgcaagaggagcaggcgg

SEQ ID NO: 25822 - DNA, 1144 bp, Heterodera glycines
  misc_feature (53)..(53): n is a, c, g, or t
aaatgacagaagcctcgaatgttagttatattggcgtgtcacaaaatctcttntcggaaaaaattttcaaaaaagggttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagggttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggccaatccccagctaaatttcggaaattgctgataaaatcaaatagccctaaatatatacgcattataaaaaggaaatgac

SEQ ID NO: 25823 - DNA, 1384 bp, Heterodera glycines
aaaaaaacacgaaaaatcatgaatacagagattcctaggcaggaggttgacaaaaaaaaacttgtaaaattggataatcaaaatttgcaaaattttatgcatttaaaaaacgggtgactcattcccccccccccttttcccccgtcgtttctccccgaaaaaaacaagaaattttttaataagaaaattttaagaaaaatttttgaaaattttcttactaaaaaatttactaagatttttttttacttaggaaaacttctgttttaaaatttttcgggggatgctcgcttaaaaaacaacaacaaacgcacagctgctggtccttgcacgactcgtcaaagctgcgctggcccagcacctgcttcaggtcgggcggtggcaaattctccgccactttttgcatggcccactggacaatgtcggaactgtggaaaaaggggaaggaaaaatgaatggcaaatatttaaaaaacatacaaacaaacaaaaaaagagaggaaacaaacaaaaaaaactcttcgggtgccactcccaaatgggggcaccccaaaacgtcgccggccgaaacgtcgccggaagactttttggaccataactttgttcattgtaaatcaaattaagcattcttggtgttgttcgatagctttatgtgtttactattaataggctaaatttaaaaaattttcgttaagtttcaaaaaagttatggccagaaggaactcaaaaacctagtatttcgaactttttttgctctgattttttttgtacattaataaaaaattttgaaaaatttgtagattaatagagtttttcataagctttggaacaataccaagaatgtttaatatggttgagtaggaaaaaagttatggtccaaaaattcgcccggcgacgtttcggctggcgacgttttttcctggtccgctatttttcttacaccaaaactcattcaaaacttaatttatttataaacctcatatattactctttccggtcacaataataaaatttctcgatagtatttaaagttatagaatggaattgaattattttacttatttctttttttaattttttaaaataattttattttgaaattaaatattaatggattaataagttatttttatcttgctaaatatttttgggttttataaatgcaattattttttttagttttgttttttcaatatttcttcttaaatgaaatgttttgctagtttttttaattaattaattttggaaataattttcttatgatagctattgttttttaacttttacttttaaataatatagaatttattttaataagctaatagttctgggtttacagcacagcatattatgttatttttcatagctttttggtattattggatatg

SEQ ID NO: 25824 - DNA, 1408 bp, Heterodera glycines
attcaatcccttagtgccgggaggaccgacgacgaagaaacgttctgtgaaaatagtcaaaatcgaaatatgtcataaataaaaacgaacacgaactagtgaagagcaacgatcggtttgcgaacagattgtactgaggcattgcgaatgaaaggaaatgaaacaacgaaaacaaatttgaatctaaaaggtttaggatgatacctatgtacacaccgtttcaaaaaacgagacatgttagagaaaaaaaacatctctctttttggcgtactatttctttattttattaacaagaatgcaaatgaaaaatatgccactacgaatcgaccaaaaaaaaatttcggacccctaagaatcgtcctaaaaattttcaaaaaaacacccataagaatcgaaccttggcgttattttttctgcgttaattcaaaaacgacactgatcaatgatcattgcctttctctgcactatttattagagcccggacgggaccgggatcccgccgggattttgccgggactcccggtcccggttttttggacaaaccaacgaaccgggagtcccggaaaaacgggagtcccggtaccgggatcccgtcccggtccattttccaagtcccggtcccggtcccggccattagggccgaaaaaacgggactaaattatacacccctaagaatggtatattcgtggattaaaaggcaaaaatttatacaattttgaatttttttaaacattttgacaaacttttatgtaataaaaaggaaattttgttttcttaaataaaattttgtggattagtggttagtgcttcaaaactagctgtactttttgtatcagttcgatacccgttgacgttttcttttaaatttatttatttttctgataatagacaaaaacaccagggatggactttcgcgtttcgctttctcattttttttgtttaaaaatggtcaaaatttccaaattttccccctacggcgcctatcggcaccgccgaccccccccccctccccccattttgctgcctacatttttttttttgaaaaaagcgtgccctaaaaaagtgctttgaaaacaatccaagctaaaatagaagatgacaatttttttaaaaattttattatcaaaatttcacaaattttgaaaaagtcccggtcccggccatttcaaaattccgggctctaattttcacatctctaacacaaaaaacatcaaattcgtaaatgctaacaattttggttataaggatacaaaatcactttggacatttagaattaataaagaaattaatagttttagcatttttggtgaaaacagcagtttaggacttgagttataccgtgaataaaatttgaaagaatcccaactttcttctgaaaagtcaaattgctttaccaaaaaattttttt

SEQ ID NO: 25825 - DNA, 2122 bp, Heterodera glycines
  misc_feature (21)..(22): n is a, c, g, or t
cagacggaggaaaatgtcganngggaagagggaggaggagcagcgaaagggaaagaatcaacgacgacgaccggcaccaccaccacttgtcgacgacattttggacgaggaggaggagcgaattgaaatttgagggagcaaagagagggggtggggaatgaatgcttttgagtgaattgattgaatgattgtttggtgatcgaagggaacagccccgccgcttgtgaggggaggggatgactttgagtgattgtgatttgatcgcaaaaacatcggatgatcaatttaggggaggggtgggggaattgtgcggaacattctatgtgcttggaatgtggcgtgacatttccatttcataaaaacaaagtttggaattttcaaatttatattacaaacgaattcccttttctcaccattgagcggcgctgtcatgcaaaatctttttattgttgttgtttttttttgttgattttttccataaaattattttgtttcctttgtttttcttacgaaataattggcatcgattttaattatattctatttttaaatgccatttgctgtgctcagaatattcattaagctgtaaatacaataataataatagcaattttccatcaaactcacagcggcgatgaaccctcgagggaatgttctggtcgttcatggtacgttttgactgtctgaattgtgacgcgggtttagattttgtgaaagttcagtttccccggaacagtccttaattttactatattagagtgcctaaatcattattagtccaatgttgtcggattatcgcttactaattccattcagttttgttcgtccgcaatttgtacatccgcgcgcaaaaggccgtggacgtgtacatgtcacttgcaacctctgggaaggggccatggaagagcaaagtgaccaccaatacagtgcgagtggaggtggacagcaatgcccggggcgagccaagccgatgggacgaacattgtgaattgtgaggaccaaatggggttagggaggaagcatcagcagttttattgttggaaaccccttccagtaaactgaacgacacggacacaaagctggtggtgcgcgtgaatcacaagacgatgctgggcaccaccgaaacactaggcgaactcactttggcgctggaggggatggcacgttttcagacgcccgtttggtttgcgctcgccaagccgggcaccagcggcggtaaacacaaacgcactcgtgcacataaattagtccatgtcaaaatattaccaatttttgcccgagggttggacttttttcattgaaatttcattttgcctgcccactttttacccttgttcgggattctactatttactcgatgtatttttttttgttaattgtccaaatccatcaatttcgtttagtcagtggaaacggcgagcgtggacacattcagcttggctatcagttcacaatgtccagccgggcaacaacatcatccgctttggaagtgccggctatgtccgtgtcgaacatgtcactgaacaaaattgagaaaggtctttttatttgggctcgttaattccatgaactttcgcttttttaataatcctattttggaatttttattttggagtatttttgtacaatttaatatttttcttttcgtgctttcattttggcaaatatttccactttttattttaaatcaatcccaaaaatcaatactctaatttgtcatgtgcatttttcattaaatgccaaattttccattccatttattttattttacaaatttctaatgcctcaagaaaagaaattcgaccgtctccgtcgcaaaatgcaacagttcggccgccgtggcagcaccagcagcaaacggacttctgtaatggacgactcgcagtcgctggcgtcgctttccatcgccgccggcgcaatgggcgagggcagcagtcggcgcagttcgtccatgtcgtccacgaaaaattctgccgcgttggccttctcgtcgccaactccgagcgaaaggcagcagcaacaactgcaacaccaccagcaccaacaacagtatcagcagcagcacaaccatcaccagattcagcaaaatggcgacagaaatgtcactctcttcgaaagccca

SEQ ID NO: 25826 - DNA, 1629 bp, Heterodera glycines
ttcgagaattgcgattttttttattgatcaatttcttttctggcttaatgaataattatgagaaaagattgattgactcttttgggaagacaacggaagtccctaattaagttgtcgagtccggggaaaacaacatattatttgatcattaaggaaaaaagaaaaaaataaaattatgtatagacgaacagtgtggaaaatattaaaaaaaaaataaattttttaaattatttttttagctattttcattcgacggacttttgcctgcaaattggttcgcctttcgcattgaatatcgcctcattttccgagttgggcccgaaaaaagagcaaaacattttgacgatcaattgatggtggacaacaacggcaacaacgatttgaccacaaaacaggcagataaaaaaaataaaaaatagaaaattaatttttacggaaaatttttttcccaaaaaaagtttcaaatttcacaacttttcctttattcattcacttctatctgatgggagcaccttctttcttctttttgcctgctttgactcttttgatcaaaaatggcatcccttttgtgtgccaaaaatgtgcccaaaaatcacagtgtgttgttgtaccggcggtggcggtggcggcggcggtggcggtggcggtggcggcggcggcaatgattatgatgacccccgtgggggctgtttgtgtctgtgaccttggcggaaaacgtcccaattttgaggggaggaaaccccgaggggttgggctggggggctctacctgaaaacttcctccccaaggcggccattgtttgggctactcaggcaccactacctaccaccactagcaacacaattcggagcaccaccaccacacaatttgggagtggctggtatttggatgagcattaattgcccatccgccgcccccaatgaattttgaaaatggtgttgaaataggcgaaagtggggggggggggaggtgtgaaaaattagcatagaaatttggaaaatccgctacgaatagaatggcaaatttacagacaaacacattaaataaaggatggcattagaagagaagaaagaagggggggggggagaattggaaatttatttaaaatcaaaaattggtaaaatgaaatttttgggagatttattaaagaaaataaaaattgattaaatcaatttaaaaaaataatttattacaaataaagtttaaggaattgaaaagttattttaaaattcaaaaatttaaatgaagagaaatttatgggagatttaatgaaagaaaatcattataatgcaattgattaattttcaaataatactttaattaataagacaatttaattagtttaaaggaattttcaaaattgtaaaacatttaaggaattgaaaagttattttaaaattcaaaaatttaaatgaagagaaatttatgggagatttaatgaaagaaaatcattataatgcaattgattaattttcaaataatactttaattaataagacaatttaattagtttaaaggaattttcaaaattgtaaaacatttaaggaattaattgtgcgaacccgaacagagcttcaaagtgactcagtcggccgagaacaaattttaaatgaagtgaaatttaattaa

SEQ ID NO: 25827 - DNA, 1326 bp, Heterodera glycines
aaaatttttttgtaatttcgttctgatttgttaacagactttcaccaaaaaaggccaattttttcaattaaattaagtcaagcgacgacttttttgctttaaaacactttttttacggcgtgtttttcaaaaaattttggaggatggacggagggtccggcggtgccgataggcgccgcgggaaaaatttttgcgattttaatgcgatttgttaacagatttttgtcaaaaaataaccaaatgttgccacaaatcttatattttcttaataaaatagtgacattatgccatcaaatttcaaaaatgtgagtttatttaagaaatcaggacaaaatttgatcgctacctccaaatcaggacaaatctgataaatcaggacagatcgcatccctggttttaacgtcaatattcataataataataataataaaatattttgggattattaaagaaaatatttcttaaataattcgactttttttagtaatttttactaaatacattcacattttcaaaaaatggagcacaaaatgctataaaacaaaaaaagtgctatttttcaataattataagtaaattttttttgattaaatttttacttttttttgaaaaagcattcaaacctaaaatggatgtgccttgttgcaactgtaatcaataaagaaatttttagtcctgttataagggtgaccgatcgatcatttcatcaacgagaaatcatttttaaaaaatttgttttattattagggatgtcaattttatgtaaatacatatttttttcctggattctccatgctctaaatagtaggaaaaacactttcttttttgtgtttgcgaacaaaaatcgggacttttaattacatatttttacatatttcgggattttatacaaatttggtacatattttggactttttcttacatattttgatttttttttacatattttgcgagttttttatggaaatttttggaaatcctcaaaaaaaatccaaaattttggcaaattttttattttttatacatattttgagaaatttttgaaaatttttagaaattctagtgaaaaaattttaaaaaactttttaaatgtacccctccaaaataattttttaaatgttaaaaggtgattctaaacatatttaggttatttttatgccattttacgcctatttaacactttacgaaggttttttcccaaaaaataaccatttaaaaaaattttatttacatattttcgtacatattttgggtttttatacatatttcttacatatttggggattttttttacatatttatgtacatattttgaccaatttttgt

SEQ ID NO: 25828 - DNA, 1565 bp, Heterodera glycines
  misc_feature (67)..(67): n is a, c, g, or t
agaaaaatagcagatgcatatcaaatgactacagaaaattacagcctccaagaaaataattgcttancacaagcaatatttggtagagcccatcaaacacattgtgcttataggaaaggcagaattgaacaataggggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatactttctaaattcgggtttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatctacaaatttcggcactgtctattttgtaaaagcgaatcaaattccttcggattccaaagtggaattacagaattgcgacggcaaatcctaaatagacaacgacgctttcattataaagctttaagggagacaaagtaatacgaatatttcaatttcttacttatccgaatagacaaagataggttacacacgaacatttttatagaaattccggctgaaactaaaatccctcttttggtcttaacctatgatttttggcccattatggatgaattaagtatagaaggcgtcgcagaaatacattcatattttctaaattcgggttcagaaaattaagatttaaaagaggctgaattacagatgcttttcaaattttgggtgtatccgaatagaaagaagttggaaatcagtacttttcacgcctataaaattcgggccgaaaaatattggtgtttgtgactagaaaaatagcagatgcatatcaaatgactacagaaaattacagcctacaagaaaataattgctttgcacaagcaatattttgtagagcccatcaaacacattgtgcttataggaaaggcagaattaaacaataggggcctttttattatgattacaacaaatcagcatggcgtctcgctgatatggtatgtttcagttaaggtttagccgatc

SEQ ID NO: 25829 - DNA, 1424 bp, Heterodera glycines
  misc_feature (53)..(53): n is a, c, g, or t
  misc_feature (78)..(78): n is a, c, g, or t
  misc_feature (138)..(138): n is a, c, g, or t
agtttccgcagctccttaaagtccaaaaccattcccaaactcatcaaattgcncaatttgtcttctcccaccgattgnctgagttgggcgttgtattcctccaaatatttgttctgcacgtccaaatggcgtacactntggtattctccgccgcatttggccaaacagcgcaacaatctgtcacggccaattttgagttggtccgaccgcgacattttggcaaatccatcggacattttgaagttggaaaagaaagaaaatgttgaaaattgataaatggaaatgattagttgcactgaattggaaattcatggagagaaaaagttgaaaatgaaaataacacacaatttggcattttgttgcaaaaattagtgtgccaaccatcaatcattagatcattagaagtagcgttgggcggactaaaactttggggaaaaccgggactggatttaccgggatcagaaaatccgtgacctgggagacccgggaattccggctggtcccggtcaactctaaccagaattgaccagtgtactaccatatatgtataatggctgcatttaaaagggttttaaaaatgccatatttagtgcctgcgcatatttttgccgtaattttatgtctgcgcgccatttttctcacaaaagagatggtcaccctggggccaattaaccgatttattcaaatatttcatcgtcggccatcgctaattcaattaatttattctgagaatttattttaaatggatgctgctgacctttaacatcaaattaaataatattattattgattctaagtattagttaaaaagtaaagaacaaaatgttaatagatggatgagaagagaagatgaaagattgctcaagggaatggaaaaagttgggtaaatgaaaatgaaagaaaatgaaaaagaaaatggaagggaaagggacgaaaaaagggagaaatgtaacagaacacaaagaatgaccgatggttgatgagaatgacaatttgcaaaggttgtcataaatatgtaaattatgagtaaaaacgaaaacccaaaagaaaattctgaaaaaaagaagttaagttaaatccttaaaaataaagtataaattgctttgttgctataagaaattgcagtagaaccattggtttattaaaaatgtttaacatttaaaaaaattaaatcgtccggcggtgccgataggctccgtcggggaaatttttttgcaaattttcaccaaattcgttaaaaaatggcagagaagttgcttatttttcctcaagaattttttaattttcatttttttggggggggggggggtgggcacacccccaggctgaaaaaacgggcatagccatgaatcagtttaattatttaattaaataataattagttgtctgtaattttttctcacttaatttgaccacttaatttg

SEQ ID NO: 25830 - DNA, 1099 bp, Heterodera glycines
  misc_feature (1022)..(1022): n is a, c, g, or t
tatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattctttagtatggagccattttccanccgaccatttgtagggctcaaccgtatatagtaatgcgttttcggggaaaacctcatgttggaaggctgtagaaaaa

SEQ ID NO: 25831 - DNA, 1806 bp, Heterodera glycines
ttccttccataatttctgtgtcaatctcttttccaattgtccattgtacgtcttttgttttgtctttgtccttccattggtttctttttttgctttgtttgtccaattttccatttgtttcgtcccttcttctaaacctcgtacatattctgctgtgcttcagcacctcctattaatggacgttgagttgatgaatgaatttgcgatgggacggattggccacgcgatgggcggtgggggggggtgagaaaatgggaaaatgcgaagggattgtcgccccccacccctttttatccctttgtctttgcccttctctcaatggcctaaaaagcttcgagaaatttaatggaaaatattaacagaattctttcccaataaatcaattttcacaaatattcttcatccaattactcattttaatctcttttttctttttgcctattttctgatgacgtcatttaaattttttttcatgctaatttcatttttagcaaatgcgtaacggcagaaaaaggacagccaaagagacggcagcgtcgcctcacaatcagcaggggacgagcgacgaattcggcacagaacgaagcgaagggaacggcggagggattggccaaggaattggccaacttcggaacggactcagttggccagtggaggtcataaattcaaaaaattgacttttgttctccagtacttttacattattttcagtggttcggcacttttcccattcgaaaagttacgtcagaaaatgtggcaaaacgattggacgcactgctcgaatttgaggagggaagcaatgcggacggagcatcgggcgggagaacagcacggcacgggagaagggcatttttgcggatcagggaaacggggattgaagtggcaggggaaacggaggacggaatggaaaaggtgggacaaaaggatggggagaagggggaaatgaacggacgaaatcaaaattagagggggaggaaaaaaaaggggggaaaggggcaaaataagaggggggggggggggggtgaaaaaaggggagggataaaatggaaagcaattagcaaattaatcagcatcatttatttccaaatttggcataattctctccgtttccattgcttccgccccatttgtctgcctttctctcctccctttgcttctcaatttaattttgggttcccttttctttctccccccccccttttttcccaacctttggccgaatcattcgcctaatccttcccccccccacccttcacattttctttaaaaagcatataattaattatctctggaagaagagaaaagagaatatttttcaattaattttcattttcaaaaaaagacggaaaataaataaataatttttccattgtaaaaattggaatgtctgccggaaatttgttaatgagagaatttaaaatgttttgtcccttctccgatatttaaattaaattttccaaaacattgtttgcccattttctcgaatattaaaatggcatttagcttatgggaaagtgccgttttggcttttatttacgcaactaatcggattaattcctcacactttacccaatttctgcaaaaatgcgataaaatgaggacagttcggctgatggattaagtgagtgagtgatgggaggatgatgatgaccttaatctcgcccacaaattaaggcgagagacgagaaaatgtgcaaaatcggcgagaaatgcgtttttttgggggtggggcgggcactcagccaaaagagccaacggacgaaaaacttaaaaattactgtaaccaaaaatgggatacgataccaa

SEQ ID NO: 25832 - DNA, 1577 bp, Heterodera glycines
cacacctccttgaaattgttgacccaatcgaagtccgtttgttcgttgtgatcttcgcaacacaatcgcttgggttggccatcttttatcggtgtgtgcaaccatttggacaatgcttggccagcagaaattgatgcattcgaactcatcaaaaccatcaccaaatgcaaagggcaacaaaccacaggaatcgattgaattcaattaatagattagagatcggaccggtcggttttttttcggtttttttcggtatttttcgattttcggtttcggtttccgaccgagaaatttttgagtttttcggtttttttcgaccgttcgaccgaaatatttaaaaaaccgaaacaatcgaccgacttttttgacaaatcagttggccatttttttaaaaaattcattaaaaattcttaaaattttcctccggcggcgcctatcggcaccgccgaccctccaaaaagctatcttttcttaaaaaattagcccaaaatctcaaaatttggtatttttagacaaaatctgctaacaaatagcattaaaataacaaaaaaatttcccggcggcgcttatcagcaccgccggccctaaagttatgactagagctggcaattaaggcaccaaaaagcgcaaaataccgaaaaaggcatgaaaaaaggcatttaaattttttattaatatttttagggagcaaaacacgtaaaaaccaaccaaaaaactaaattttgctataattcaatattttataatctttttcaataaggaaatttttaaacctaaaatttttatcaagaaaaaaaatgaattttggcgaacaagttttgtgaaaatttttcatttcataaggtagattctctgaatttttttagatcatttcttaggggtgtatttttccgatttttttgaatttttaatggaatttttcgggaaaaaacgccaaaaaaggcaccaaatcgctaaaactaatatttgtgggttttttagaatcaaggagcaaacacatttttttggctgccttttctaacattttccatacctttagtacaccattcaatagagtttcaatagctctacaatttactcagaggagatttttgctttttatattaatagaatagtttattgctttttttggaaaaaatataaaaattcaaaaaaaaccgaaaccgaaacgatataccgaaaatttttcttcggtttttttcggttcggttttttttcggtttttaaccgaaaccgttcgaccgagaatttttgagtttttcggtttcggttttttttttcggtttttaaccgaaaccgttcgaccgaccctcttgtccggtctctagttgaaatcagtgagaattgtcggtgaaatgagacgacgcaaattgtccaactgatcaccatcaggggtgtgcgaaatttcgtgtcgttttcgtgtcgtccccttttttcgtcactttttgagtttcgttttcgtgttttcgttttcgtccttcaagaaattttcgtttcgttttcgctttcgaatttaaaaattttaaatttttgttttcgttttcgtcagacggaattttgacgaaaaaagacgaaaa

SEQ ID NO: 25833 - DNA, 1309 bp, Heterodera glycines
  misc_feature (795)..(795): n is a, c, g, or t
  misc_feature (840)..(840): n is a, c, g, or t
  misc_feature (855)..(857): n is a, c, g, or t
  misc_feature (867)..(869): n is a, c, g, or t
atgaataatttattttatcgtgccatagtcattatttttcttaaatgtgaagcaattttgtgtataaaatgtaattttttgaaaaatgaattttgacttttttgttcgaatccgggtttggggctcggaattgaccaaaatggatttcagaatcgggtttctcgaccctgaaaacctctaaaacaagtttattttcaaaaaaaattttttgaaaatctgtacacagataacccacaagtaccaaactttctccatttttaacactctcgaactgggaaactttctcgatttttaagacgttcgagttggaaaattttcgattttgagtcttagttttataatttgaaaaaacgaaaactttcaaccgtattaaatagattgatcattttcatctctgaatcaactaattttcccccgatcaaccgacatccaaaggtatcaacaaaatactgatcgaatcacattcatattcccaacaattttgtacattgataccaggggtgggacaactctcgcctctcgtctctcgcctctcgccaactctcgctatttttggtactctcgcctctcgtctctcgcctctcgttttttgcgacgagaggcgagagttgaaaatacacccctaaagattgaacttttgagcagccagaaaaattttcaaatttacgcgaaaaaaaaatcttaaatctctttctttccttccttaatgttttctctatttttggatagctccaattcaaatatggtctgctggctaacaaataagccttctgcctttcattatttttctcttgngttcattccccaacggtatacagaatttttttaataatttcttanactgcaatttaacannnacttgatcannntgtgacagtctgtaataatactcattaaaatttttatatttttttttttggtgggggccccccccggcccgcccacccccctttcccccccccaaattttaaaaacccaccgcaaaaaaagggggaaaaatgaaaaaaaaaaaaaaggtttttttaaaaaaaaaaatttctggaaaaaatttttttatttctgaaaaatttaaaaaatttttttttgggatttttttggagttgggacccggttaaaaaaaaaagacctggcccgcgtttttttaccccggcaaaacccccgacccccggaatttccccacaaacccggccccaccccccaactattattataataaaatatttttaaaatttttttaataaaaaaaaaaaggaataaaaaaaaaaaaaaaaaaaaaaacccccccctcccccccccccctccccccccc

SEQ ID NO: 25834 - DNA, 1480 bp, Heterodera glycines
atgcatttccgcatctaaactaaccccaaaccctctttttgagttttctctggcatttccgtgccacacatttcattaacaacattcaggatttctgtcacgaatggcattccctcatttttctctccttcttccgtctccatgatcattcgatcatttggcccaacactctttccactttattcgccatttttctcaggatttttcgtcacgaatgacggtccttcgagctcaagaaccttggcaccaagcgtggccattgggtcatcgcttgtctccaaaatcatcgcctctagggcatgcacctcctcttgttgtcgtccactttcgatcgacattacggggaaatttatttttattatttttttgaaacaattaaagaattgattggaattgaaattgataaaataattaatttaagtattttaaataattttgaaaatggttcgtccaacgaaaagcacaattcaaaagcgcaatgccgcagcggcgggttgcgccgtcattgaggcacaaaaggcaaggatggccgctttaaaagcgattttggataggagcgtgccggcggagagcggtgatccggcatttttcgagatttgccagcaaatctgggcaattcttggccaattcctgggtaagttttgccttatttggatggggaaggcgggagatggaggggtgggggggggggaaaggaaaacgccaaatgcaaaaatgaatgattgtaaggatggaaaagggaaaaaaaatgggaaagaaaaattgcgagatgactatcagtggatcggtgtaatggccgagaaagccattaggggaggggcataaatgtgtgcaattaatgtgtttgtatttaaaatgattaaaaatgattttaaatatatatatttatttatttgagggaaagtttcgaaattataattaaattaaattaattgtttgggtttaaatagtacttgaattgtccacaaataattggctaaaggaaaagttgaaaaaaatggaggttactgtaggtcactttaccggtccggctttaaggggaattgtggccagtgactttcggctatttgaccaagccagaggaactcgcaacggcatgggcaagcagtctgccggcgcaagtcggcctgcacccgctgcaccattcgctgccaatgaagcgactcgtgtcatctgtcgcgcacgagggtcttcacctcctggaatgccaacagggaagacagtggccgcgtgctggcagcagcacaaagcatgatcatggcccattttttcgtgcaaaatgtgcagaattgattgagatgtccggtggactgatccagccggaattcaaagagtttgaccatttgtgaattttgttattttataattaaaaatttgttaactgtgactttattatttatcagggtttaattagaaaataattacctctcataattttatagaaaattttaaaatttacaaagattaataattattattt

SEQ ID NO: 25835 - DNA, 1295 bp, Heterodera glycines
ttaattaattaaaattgaaatcccatttttaaaaggggtaggaactgtttttgatggagaacggctggagaaaagtgagaaaagttgcgtttgaagctgcctttctgttagccaaacgtatgaaaaatttcaccagaggaaaattttttattcaaaaaataaaattgaaaataaaattgaaattttaaacaaattgatgaaaaatggggaccaaaataattgtaattggaatgaaagtgataaaaatgatgaggaaaatgaacaaaaatcgcaccaagaacagcgcgaacgactgagactgattttggcgggcattggcgacggaagcattgggccaatgaaaattttgtcaaaaagtaaatttaatttgtttttaatttcaatttaatttttcctaatagtcattggatgaaaaacttagttttttaagtattttttctgcagccttttttcttaccgaagtcccttttatggctaactatgaacaggttgtaagctttctaattgtggctaaattgggttattcaggtaatcttttttttgggtatttgaggttacacgtttctaattatgtttaaatttggttatttgatgacctaaatttggctattagagtgcatgtcataatattttaattatttatataattgaagtattaattgttcataattaatcacagattccaaaagtgacggttcgtctcgcaaccgacgaagacgcaaaaaaagaaatgacatgctaattgcgataatagtcgtgttggttgtcgtcattgtggctctgatttcatgctatttcggccgagcgtgtgatgggagcagttcggcaccggctggcaccagtgccaacaaatcggccagcaaaagtgccatttcaagcaaaacggaaggagcaagaaaatgatgatcaacactctgggatatagaagctaaatttaggggtacattaatgtaattatggggcactattttctctcccattttggcataatagggaaatcaataagattaattgtgcaatttattcgaccagaaaaaagagcaattttgtaatgctaaaatgtggaaaaaagagaatattcaattgaattttattctattttatttcttttttttttgggataaattttataaattcttcaattgtaatttaaacaaaaaatttttgtttaattgtctaaaaaacatgccggtttttcataaagttttaattccacatgacaatctttgtaaaatatttaaaaagaacaaagcacaaaaatgtggaggatgatagtccgaaaatgaaggatttat

SEQ ID NO: 25836 - DNA, 1489 bp, Heterodera glycines
aataaggaacgcaaaaaaggaacggtccggccaaaaattagggtcacagaaacgcgtcctatggacttttaagtgtcccatcaaaattttgcgagtccatgcgattttagctaattgtatgtaagaacatcagatccaatacaatttcctgggttttttttggactgttgtaaattcatttgtcaaaagacagagtctgtaaagagaaaaatatcacaaatttttctgcaatttgaaaaaaatgccgacaaatttttcattttttttcgcttaattttttattcaaatgatagtcaaaattattttgttcattgaaacttatgaaatgttatggtccaggaaacccaaaggaatgccaattttattgggttttttcaacaaaattgccatttgagcgaaaacaaaattaaaattgtgaaaaattaattttttttttcaatttttaccctccgttttttaaggcgactttcgcttgtccaccagcttcgcaaggacgacaacggaggctattccaaacacattctcaaggtttcatcaaaaaaaaagaagcaatttctgtagattttctaacttttgcgggtccaaactgaaaaaatgcccggcctttgtatatgaaaaactgccccccccctttgaagttggcactgcactcggactatcgcaaggacgtcgcatggcgtgccgatgtgtccggcactttgacgatgaaaaaatgggtggacaaaatgccggagggcaccgacccgaggaaattggacgaacattcgatgggggaacagaagttctacgcgaacaaagaggtgaaaaaacaacaaccacaattattccgtatttttcccttaattattcccatgccattttggtagattttcgcccaaaattaccaatttgtcggtgattggcaattttaacagcgcattaagggcaacaaaaaatttgtttgaccgctttaaatatttggcctaaaaaattgcaaaataatttgattttttccaccccacgcaatacaaaatatggggggggggaggttcaactaaaagttttgcgaaatggtctacccatgtaaactgctaacgacctttttttaaaggcattttttgggcgcgcttttttcaaaaaaaatattaaatgagattttgggctaattttttaagaaatatatgtttctggcgggccgctggtgccgataggcgccgccggggaaaattttaagaattattaataattttgttaataaaatagccaaaattttcagaagttttcccttcgccggcgacccccctcccccacctcttttgggtgcaccccaaaatcacgccgggacaaaatcacgccgccaaaaatttaaaaaaaatttttcaaacttaaatttttcaagaaaaaaatcttagaaaatttttttatacgaaaatttcaagaaaaataagaaagatttcgaaaaaacttagtaattaatcataaagttcccaaaaaattgctgaaaattttt

SEQ ID NO: 25837 - DNA, 973 bp, Heterodera glycines
cttgcattattatgttattgaaaatgtccctaaatgttctgtgatcctcgctttttgaggccaccaaaattgaaaaaaatttttattattataatctgcgggttgttgtcatttgtccttgaatggtaagtccttgaaaaccaaaaagaactggaaataaaagtccttggttttggtatctgtcgctatatttttcaaataaaagcgttggagatttaattttaaaaaaactttcaagaactttgcttgaaagttaaaggactatgacaacgtttcacttaaatttgcattttttttcatggcaaccaaacatttaaaaccaaaataaaacgacggcattaccaccagcagcaccacgtcgaggtgttagtgatcgagtgatcacaccattagcaacaggaatgataatggaaaaaaagaaaatgaaggaaataaggggcaaatttcccattttgttttcctaaataaataataattgaattattattttatatattataatgttaatataaaaaaataatatgaataataaaaaaattcagcttttaactataatggaaaattcactcaattaatattttaaataaaaaaatatgcattgacggctaagatattatagcgggaaatcataggattgagtgtattgttggcaaacatttaaaaaataattaaaaaataagagtaaatatcacccgttaatgaaaacatttaactaaatagaagcagtgcaattccggcgaaaaaaatgattgatttattttaaagttgaatatttttgttaaaaatcttttaaatgattcatatgaatgtaattgatttaaatgttgggtaaatctgttcactttttcttagttatacatacatatgtacattgttgaatttattaaaaattaaaaaaaaataataataataaatagaaatctaaaactattgagaaaaaaaattatgcctaaatcatcctactatgtaaaac

SEQ ID NO: 25838 - DNA, 883 bp, Heterodera glycines
ggacaaaatctgttaaatagcacaagcaaaaaaattagtttgaccatccacaagagaaaagccatttgttagaaaaagcctcaaaattattatttttttaaattatagtaagtctggatttttaagtacatataaaaaattttgagaaaaagtctcatctcgaatcgaggaaagtctcggattttttttaggtctcggcccctgtctcgagtctcaaggtcaagttttgggtctcgagtttgtcacctcgtccacacaacagtacaagttgggcactactacaatttggtctaatatggcgtcattcattggaaatttggaaatagcaagatggagaaaaatatcatagtgcgtgaattcatgatttgaaattctttccaaaaattttgggccgagattcgtaatgagaaaatattttcgtctttttaaaaactttaattttataatcattaaaatttttaataatagaaatgatttgaagacctaactttctaataatgtattctattgcttagcaactgcttagaaatgcttcatctttcaaaagttgccgaaaacgcaaacctaaattgcgttgtttagaaaaaattttgaaaaaattaatatttaaaaaattatttaatacacagttttttaacaaatttttagctttcaaaataatctttgaaaatttgtttttttagcatttaaattttaaatgggagtcaaatcctatgtttaatttaattttttatttatgcaaagccacattgatcgcaacaatttaagagcatttatttaaacatattttttatttacttttggattacagtatgcgcgaataattaattgggggagatagtataaggtgtcttgaattgcattcttctattttgaaaatttg

SEQ ID NO: 25839 - DNA, 1796 bp, Heterodera glycines
tttttgggaccccaaaattgggaaactctttctgactctcgcctttgtgtttggtgcatgcgattttgaccccaactccgaatgcgttcgtatcgtacggcgaaatgctcagccgagtgattgtgccacgccaaagcacaaagtcacactcgtggacagtctgcacacagaaaagcacccattcaggctttatacgattggaataatttggaagtttcaaagattttcctggcaacaccgccgaaacgccaagatttcctcaaggtttttatatttttcaaaaattggggaggaatttacaaaaaatcgcataaaatttgcaaaatttctacggcttgaactagttaaacatgttggtgtggtggtgctgctgctgctcaccttcctcagcaagctgtttggtgccgacatggccattatccattggagaagctgttcaatgccttgccaaaagaatggtaaggcattaccaaagaaaacgaaaacaacggatggaaatcaaaatttcatttttatagtttttttgcaccttcggcttcgccccccttcggcacaaatgtgtgaaagttttccgccaaattggcaccgcgcaatttgcggcccaacgtccgctcgttgaaatagcgcacccgcgaccggcccagctgttgtcgacgcgtgcggtccaacgaaaactcgccgatacagccttaatccgaagggggtacggtagggctaggtctcaagagcgaaggtgtacggtagaattttggcatttggggaaaacggtggcaatggcggagtttcacaaatcccggccgcaaccgcccgtcctaaggccacgaagctgccgaaaattcccaacaatccacaatatttagaagcgcaaagcgcccgtctgaggccgcgaagcggccaaatgagtccacaatatttagaagcgcaaagcgcccgtctgaggccgcgaagcggccgaatgcacttgcctataacttatcaaacgcgcatgcactagcaacgaagtcctttgcgcgaagcgctcatgtcagcgcccgcccatatataccaaaagtatactgtctacaccgagcaattactgtgcaaagcatactgtctacaccgagcaattactgcgcgacacgctagtttatattaccatagagaaaaagggggactcgtcttaaaaactaatttgagtcgaacggctgtcgggaggggtctgaaagtggtggaagggtcttacaactttttgaggcgcattcaggaaaaatatgggttttccgctccggtggacggttcagcgccggcggctaatttctcacttttgcttgcgtttgatggcccgtaactttttttaaaggacagggagcggaaaattcttgctggtaggattttaagttgaagtcttttctaattttcaaaaaaaattccaggcctctacctatacttggaagggctgcagaaattggcaacttttcagtaccaactttgcccagttcagtccccgttgaataactcattaggctttgacctgagcgcagggtggccagcggacttattgtagagctcggtgagctcgatttttccaaatttaaaaatttcgaaaattttcaaaatttttcgagctaggcctaaaaaacggtttttgggtttttgaattttagtattttttaacgaattttcccagaaaaacgaagaccacttccaaaacatagtttttcgagctctatcgactggtatttttttcggaaaatttcgatttttttccggaaatagaaaaaaattttggcctcagcgggacatttgagtcctgggac

SEQ ID NO: 25840 - DNA, 2088 bp, Heterodera glycines
  misc_feature (19)..(19): n is a, c, g, or t
  misc_feature (43)..(43): n is a, c, g, or t
ttttggttgcaaaaaattncctgagaataaatgaaaaacatgncctttcagtgagtttattgcagttttgtttcatcgaacatttttgtgaaaatcccaaaaatcttaacaaattgtgaaatataactcacaatatcccatccggtcttaatgatcacaaaagtattataaagattccggccaccccaattagttcctcaatgaacatttttcggtttttttttaattaataaagaaaatattttccttggtttttcttcaataatttatcggcgaattaaacatcggcgagttcggttgtctgtttgcccgtattgatgtaactgatcaatttcacgcacttcattaaggtcaatcatatccatgtttatatcttccaagtcaatcaaatcaaaattaataacattttcttgttcagtgtcttgcaattttcttttttttattcaaatgttcgttttcaaaagtttttaaccgctttttttctccggagctttgaaccggttcatccgcttttttgaacgggagctttgaacccgtttgatcatttgagggtcgtgaatcattatcatgcaatgatgatgaagaacactgatcctcggaaggaaaagattgcttaattcgtaccattataaatctaaataaagatacaaaataaaacaaaaaatttacactcaaaaaacaatatcaataaaataggacgattattatgtaagagaaatttctaatatggacaaaaaatggttcaatttcactttgtgcgtcgaatcatttttatgcgtccgatcggaattttttcgctgatcaatgattacgaatataacgatttattaatccaaatccattcaaaccaaattaaattttatatttatttttttcagcttagtttccaataataacgaagttaagtcagatttagcaacaaacggcatttattcgtgatcagcgacctgaaatcccattcgatatgttttatttgattttttaaaaattaataaattaacgtaattaggtgcataagaaattgatctggactctaaagtaaaactgaaaccaaaaaacatcaaaatacggacctaaaattcacaattagaacttaaaattttttgaatacccaaaaaggaaaaccaaaaaaaaagagtaaaagaatgcataaggaaaaaatatcgatattttcggaaagaaactaatgaaaaaatatgtaaacaacggaggaccaaaatgatgaaacaaactaatctttgatgtgtaagagagacacaaccacaattttactgaaaacaacccaccgacacaatctttcttgttttttgtttctttttcctattatgtacaacaaagcaccatttacccgctaattcaaaaaaagaggcggagcttcggctgacagtatatagttaagggattttccagacaaatagagaaaaagcttggctattttatggtactaagaatgttaaaaatgacaggtttgctccaccttagtaccacaccttttttgaaattttttttcaacatttataaagccgtaaaaaatgtttattgtatttgacaattaaaacacatggcataactccgtgcatcatttaataaacaattatgtaatgatacaattttcaaacggatgacccccttctttttttttctgaatttcgctaatatttattctgcgtaaaaatccggttttttttaatttgcacttttcgcgaaatgacgcggcacctgcctttctcgaaaaattctccaatttttggaagggggccaaataaataattacaaaaatatgtacacacaacaacatttatttatccgcaaaaaatgctgaagaattatttttcgcattctgaccattaaaatatgtgctgttgttgttgcttccactggacagttctttgcctttggtctgcaaaatattattacattagttttatataaatcaaggataaattaattatgaaggaagatttttaagttttgaaaaacgattaagaaataatttagagaagtaaaaggcaggaccataaccagcataaaattcgggagggacaagccaagagcttctttctttttgctcttcggaccaaaaatttt

SEQ ID NO: 25841 - DNA, 1340 bp, Heterodera glycines
  misc_feature (20)..(20): n is a, c, g, or t
ctaaaatgccccgtcttttntggtttccatcacccctccaccggtcaatcttcggcagcaattagcgctgtcagcaatgaaattttaattccttttctaaacaaccaatttaattttccaaaaaattcatattttattgccaaaaaatttacccaaaaattcatattttatgccaaaatctccttttttaattgagaagaaactatttttctaaaatgcagccccacgacgaagcacacgtcgcgagcgacagcgcgcagcgggaatgcgcagatggccatcctccctattcttggccgacgaacagcatttccacattctgggatcaccggcaatcaatcggggcgattttacagtggaggtgagtgatgggaggggagaggaaaggagaggagagtggcaaagcggagaagggacaagaggtgagaagagagtggcaaataaatgtcaaggagaggagaggggagaagagatgagaagagagtgtggctaataatgtgaaggataagagagggaagaagagagtgtggcaaataaatgtgaacgagtggagaagggagaagaggtgagaagagagtgtgacaaatgtgcacgagaggagagcggagaagagaatgtggtaaataaatgtgaaggagaggggagaagagatgagaagagagtgtggtaaataaatgtgaagatgaggagaggaaaggagaaagacggcaaaagggggaggagaaaaagatggaaatgtgaggaagagagaagtggcaaatgggagagggaggtgaggagaagaaaggagaaagacggcaaaagggggaggagaaaaagatggaaagtgtgaagaagagagaagtggaaagtgggagagagagaggtgaaggtagagagacggcaaaaggtggaggataaagtgatggaaagtgtgaagaagagagaagtggcaaatgggagagagagagctgaaggtagagagacggcaaaaggtggaggagaaagtgatggaaaatgggaggatgagagatgtaccaaatgggagagggatgcggagaagaaatgagagagacggcaaaagggagaggagaaagtgatgtaaaggtgtctaaaatcgggttaaaatctcagttttttcaattcctgatcgcctaaacagcattatatatgtgatagaagtgattgtacctgataatttgattgtctgtaactttttgaaaaaaccattaattattcaaaaaacataagtaatgtcctaatatactagtagattactatttcttaattttaatgctgtttaggctaacagggctttaaaaaattcaacttaaaatccgatttttaacataggcgcattt

SEQ ID NO: 25842 - DNA, 1285 bp, Heterodera glycines
tcaaacggcacaaagttctcgccgtctgtctttagccgattcgaaaagatggtcacccccctcgggctggatgatgtagtccagctcaacagttccgcttctacagctcgagcaccgcccgggctggtcccatggcacaaaccgaggcgtttgcaggtgccgcgggcagtacaccgtgacgccccttgtgttgacggcgaactcaatctccgggaattcgcccaacttttccgattgccgcacacgcttcattgatcagtagagtgttgattgccacccactgcgaaagttcaagtagtccaggtagtccgtttcagcggcaggtctttcgacgggttgactctccccgccttcctcaacggccaacaactctgaaaatgattattgattttttccggacaaaattgtatacccaatgggtagtatttgcagtggcccttgttgtggtactcaacaacgcacttcagctgtgggtacagtaggcggatccggtgctttatgtagaaatactggtggactttaacctctgaacgcatatgtgttagaccgaaactgaatttttggaaacttgccaagaaatccctcaaaggcgtaggtttccgcagcgggtttcaccgaaaatgtgccgaacttgacctctttggtcttggaatcacgaccctggtaggttgttttgagttttttgccggccaagtaagcgttcgctttgttcactgcctcggggttgttcaaatattctgctaaattttcgggtttacagcttagcagtttggatagggcagcagtcagagggagtaccataatctgtaaaaaaaatcaataaatcggcttggggattcactgtgtgtttgaattggcgcccttttgtatctttctctaaccactactctctcgtctatgtgtttgtggatgggcgtggcctatcgattaagaagggacagcccgtctggaggtcgctgcgcgctaacacccctctcactatcaatcaataattacgtgtttttttcgcaggttcattttatgcttttaacaattataatcataaactatttcttaatcgtaatggccccgagaaaaatcaatgatcaattggtgtttgagaacaaaagtaatcattttttgagttttttataataattttaaattttttttaaatttaaagaaatggatgagtcgaaacgggaaaatttttcccctcaaaatgatgatgacgtcatcacaattggagacaacacaagaacacctaaacactgcttgacctggcaaccgggccctcaaaaggggg

SEQ ID NO: 25843 - DNA, 2342 bp, Heterodera glycines
ccccccccctatttaatgcatgttgacgtctgcctctgcccaaatcgtttattattaatcatttttgatttatttgcctaatttgtcaggcaatggacacgggcggcggcaacatcaaaaaggcggccgtccagcggacatcaccgacgcccaaattgggcttaacccaaaggcacaaatcgctggaggaaatggccaactgccgattgggcaccggcaccggcagcagtaacggcggcacaaagttgggcggcaaactgttcagggcgttggccggcaccggcaatggtggccatggggacagtctgcagcaaaagctgtcattggcaccgccggcggcggttaacgatggggccactaatactgtagctgcggctactgtaaatgatcgtaattataacaaccgctatcaccaccactatctgcagcagcaacagcatggcggcaataatgaccggaacatggtgctgtccggtgaagtgactgtacagctgaaaaaggtgatgggctgaccatccccggccgagtgatcgctgatcagaagagatcactcgagcgatgactgatccgaaattttattaattctcggtcagacagtggagaggatactgatcattagtgctactagagattattctcacctttcagtctcgggatcaagctgcccggggtcttgtgccgtgttttggggtcaaacctcaactctctcttgttttttgggctctcgggcccttgtcgagcgcgttttttccgtctagagcttcgggacccgtggaaaattttcggtctctggcagcctggtgattgctgtgtgtttgtaatggtgaaaatttggcaaaatgccataaaacggttgtccgtccgacactttcgtccgcccttaaatttttttaaattcttttcacgggcctatgacaaaacaccaaattaaaagccattcaaacaatttttgagattagggccaacaaatgccaatgtttaaaacccatttaaaacccaattttttggattaggaccagcactttttggccaacgaggaaaggcggcagcaacggcatccatcgtgctttaagtccgcctttttgggcaccaatgacaacgacgtcagctatgtttaagcagcatcaaaagcggatctaatttgaaagcggaggatgaggagatatatatttgatcagtgccgccttttctttttctaataattttatatgttccgatcagtgcggcagaacaaattggcaattttccctttccgatcactgataatgattgctaataattatgatgataaccatcgccgaagtcatccaaatattccatcacacaacaatcacatgccatatacataacatacatatataatttgaaataaataaactcgtttattggtgttgcaattatgctaatgagatggggttgccagattataattccaagaaaattaatcaatttagatgccaaaaacgagttaaatttgccataagaatatatcccataaagctttaaattaaattttgtcaaatttaaatgaaattactgaggtcggtcggcacttttcaaaaaatttaaaaatttgaatttttaattcataaaaaattcatcttttataaatacaatacacaaaaaaaattttgcaaaagtttcttcataaaaaaagtatgtcttttatcaaattgtcataacagaaatcaacccgcttttgaaactaaatgaaggcttaaaaaatgagaaaaaattaaaattaacgaaaaaaaataaataattaaaacccgatataatagagacaaatcaacaaatgccaaaaacaacttacctaattagacaaaaaaaatttaaaaaattttttttctcgtaacgccaaattgtcgtttgtctgctcgaattttgtcgttttgcccatcagcgaactcttcccatttatcagttatcactccgtcccataattcattatcattattatatttatcaattgttttttcgttttgtttttcggtgtctcctgactctgatcaatcactccgttgtatcattatgaattaattttcatttgctttgactacacatccaaaaatttctgtaaactttaaataataatatatttttattaattataataaataatagttggttgtttaattgcagtttaaatgaccaataaagaatttaaaacttttgtatcaatttttgtgtgactgtaaaatttttggcaaattataactttttatcaagttaatcaatctttttattaaatattttaataacgctaaaattgctctaccattgtaccattgcaattcatttttagacattaatttttttttagtaatttaaaattaatatag

SEQ ID NO: 25844 - DNA, 628 bp, Heterodera glycines
aaaattaggcatatttgtggacaaaattctcttaacaaatcatactcatgtttgaaaaaatttcccggcggcgcctatcggcaccgccggaacacatccccccacctcaagtttccaaaaagttgccgtcggggaaaatttggaaatttaatgcaatttgttaacagattttgtctaaaaattgccccaattttggtgatttttgagctaattttaatgaaaataaaatggttttagcgtccggcggtgccgatggcgccgccgagggaaattttgacagattttcaacaaaaaaggctggtttttgagattactaggctcaatttgtatggattttctttaaaaaatgatacaatttgtgtcaattaaaaaaatatgagggaaaaataaaaagaatttttttaaaatcattcaaaaaaatattttgtcgataggaaaccaatgaatatacaaaaagaaaattcaaaacattttaatttctgtatagggattgaacaatgggaaagaagtagaaaatctagaagactagcctctagaccactttcataattgtgtgctttacttttaaagtatatattaattattattttttaattttttcctataattcccaatttcttccctaatt

SEQ ID NO: 25845 - DNA, 1217 bp, Heterodera glycines
tttttccccccccccttttttacccggggggttttttttttttaaatttttttttttcccccaaataaacttttcaaaccccccttttttgccaccgtgaatgtttatttttattgaatttttggaccgttttgagtagatagactagaaaaaaatgaaaaattttgaaatcatgtttcccactccctttttcccaggggtattattttgtaaagtctttttttccccaataaacttttcaaaccccatttttcgcaccgtgaatgctatttttatcgaattctgaaccgttttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgagccgttttgagtagattagactagaaaaaattgaaaattttgaaatcatgtttcccactcccttctcccaggggtattattttgtaaagtctttttttccccaataaacttttcataccccatttttcgcaccgtgaatgttatttttattgaattctgaaccggtttgagtagattagactagaaaaaattgaaaattttgaaattctgtttccccctcccttctcccaaggggaatattttagtaaagcttttttttccccaaaaaattttcaaaccccatttttcccccc

SEQ ID NO: 25846 - DNA, 1468 bp, Heterodera glycines
caaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccgttaaaatttgcattcacaaaactccattttttcattggcaaacgtgtaaagcaaacccgaaattgataggaaatatatatttctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatatttttttgttactgacaattcatttccattcaataacggcaacagatgcgtttcaaacaactgacaatataattatgattgaagtcaaaaagcctctttagaaaatgcttaaaaactttttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttactgactatctttttccagaaggctataaaatgcaataaacaattcgtatgcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccattaaaatttgcattcacaaaactttatttttttattggcaaacgtataaagtaaaaatgaaattgataggaaatatatattgttagtaataaaagtataatttttatttgtcccacgccattttctgggaaaactttttcgcgaaaagccgaaaaattttccatcggc

SEQ ID NO: 25847 - DNA, 1204 bp, Heterodera glycines
aattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggccagatcagatgagatggctttttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctg

SEQ ID NO: 25848 - DNA, 2061 bp, Heterodera glycines
  misc_feature (111)..(111): n is a, c, g, or t
atcgaacctggtcttttctaatctctttcaaatcgccccaaattttttttacagcttaactaggcccaattaagcttatttccagaaaatctcgcatgaattctcattttnaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcaccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagccacgaggccgcgaagcggccgagtgagtacattgggcgcaggaaaattattaaggaggagggttcattatttatttatttttgcaaaattaattcataaatttttttcagaaactgctctgaaacgcaccaaaatttatttacaagttgaataaggcactctgactcttatattatcaaaaagggagatgaataaatattttaaaaatttctaattctttttaaacaggccgaaaaagtttaggcttaactttttcagcgggtttaaaaaatctagaaaaattagtaagcttttgtagtgctccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggtgggtgtttgcaaaaaattttcaccgggtttaataaatctaggaaaattagtaagcttttgtagtgttccgatacgtatctctgcaaaatttggtgagcccctgatcaattacaaattatttatggacgatcaaattttttgaaattttttaagtgcaaaagtggtgggtgtctgcaaaaaattttcaccgggtttaataaatctaggaaaattagtaagcatttgtagtgttccgatacgtatccctgcaaaatttggtgagccgctgatcaattacaaattatttatggacgatcaaattttttgaaatttttttaagtgaaaaagtggtgggtgtctgcaaaaaattttcaccgggtttaataaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtataggtgcaaaatttggtgagccgctgatcaattacaaat

SEQ ID NO: 25849 - DNA, 1252 bp, Heterodera glycines
  misc_feature (523)..(523): n is a, c, g, or t
accccaaaagcatggatcgtgagggagctgccccttaatgttgggcagcgtccacaagtcatctcgaacgacctgtgcccatcagcggacgggggcatttggtggtgccaacgctagcccaacaggacagcaggtaggtgggtgaataggaatcacttgggtaatgatccagcatcaggttcacctacagctaccttgttacgacttttgcccggttcaagccactgcgattaaatcggttccggtctgcataccgaccgaagccggaacactaaccggccccgaatttctcgaaatggctcagtcccgggcagcgacgggcggagtgtacaaagggcagggacgtattcagagcgagttgatgactcgcccctacaaggaattcctcgttcacggacaataattgcaatgtccgatcccaatcacggcaaattttcaccggtttaccaacccctttcgggcaaggacaagcacgctgattttgccagtgggatcagtcagcttcaggcggtcaggtcaacgnttcaaacatcatcaatcgaatacatccccaatggttccattacccaccacgttcggtcaatctttgggccccaaattcactcttccttttgtccaaaaatccccccaaacaggtgggaaaagggggtttaaaaaaaataaaaaaaaaaaaaattttaaaaaggggggaaaaaccccggttttttgggaaaaaaaaaaaaaaaaaaacccaaaaaaggtttttttttccaaagggggggggtttttttaaaccccgggggtttttttccccccccccccccccccggggggaaaaaaaaaaaaaaacaaaaaaaaaaaaaaaaaggggggggcccccccccggccccccccctccccccccccccacaaaaaaagggggggggggggggggggggggggaaggaaaggaagagaaaaaaaaacaacaaaacacaaacaaaccccgggggggtgtataaaaaaaagaaaatttttttttataatagggggggggggggccccccccccccccccccccccccccccccctccccccccccccccacaaaaaaaataagaggggggggggggggggggggggggggggggggggggggccccccccccccccccccccccccccccccccccccccaaaaaaaaaaaaaaaaaaaaaaaaaccccccccccccccccctccttttttttttttttttttttttttttttttgtggggcggaaaaaaaaaaaa

SEQ ID NO: 25850 - DNA, 1854 bp, Heterodera glycines
tcggttccctttctttcttttttttctcaaaaatattcaccttccattccggttttgatttaaaagtaactaatggtaatttcttattttgccatattacaaattgagggcatactttttaaatgatcacattgattaaaatgcttaatggaaaaagaaattgtgcacttatttaaattatttgctgaaatgcaaaattatgcaatgcaaattgcgaagcccaaaaatattcactgactcaattaacgggcgcattgacctcccccggccccgcccaattttcgaatttcccttaattattgtatatctcacacaatgacacaaccaaaattgcctcgctcggcggaggagagaataggcgcccaaaattggaggacgaattagttggacaaaagagagaagtgaagagggagagagagagagagagagagagaagtcgggggagggagatggtaaggtgggaagggaaagtgagacgagagggagaagaggagagcgagggaaagaggtgaaagagagtgggacgagatagagaaaggagagagaaagtagggaaaagagatattggggcgaaggaaagagaggggagagagagaggagaaaatggaagagcaggagatacgtacacatatagggagaggagagggagagagaaaaagagagggagagagagagagagagagggagagagagagggggatgggaaagagagtgaggaagagagtgaggaagagggtgagagagagggagagagggaagaggtggagggagagagagggatagatcggaaagaaggagagaagcgagagggtgaagtagagagagagagaggggagcgggtcgcgaggaaaggaggtaatagaaaatgggcgaggagagagatggagaggctgagagaaagagagagggagagggatagcgatagtattggggagaagaagagggagagggaaagagaataaaaaagggaaaagagaaattggtcggaagggaggggtagagagaggaaacggctgtaattacggattaggcattccgtaatcgaaatccagttacgtcagagaaggagagatgggcgagatgtaactctaatcctccgcttctgctgctggttcggcctcattcaatcggccgtccatccgtagccaatttccaatttaatccccgacggcgatgaatgggcgcccatttcacccatttttgctcatttgtcggtcgtttggcgtggcgctaccacacacagcacaaaaagaataaaaatgaattgtattattattaaattgcacaaatcattgtacattaagtgacagacacccaaaataagacatttttcgttatttaaaaattgtccaattctcaaaagtcccgcggtttgagccccggaaaatttccattcctgacagcacactgaagcaaaaatgattaaaaccatcgagaaaaggaatcatttgaatttatttatttgtcaaaaaataaaattgccaccgcaaaaattatttttattcgggagaatttcctttaacagaaaagaaaagaaatttaattaagaaaaagggcgaatgagaagaagccgcttttcatttgcacgcacattgggccagatgctgggggggggcatttgtgctgcaccgcaagcggcgcataagtagtgcctccccacacaagaatattgctatcttgcctaggcgggattctgacttacatatgaacatttcgaactgtgagtgttcaaatcactttaaaaccacttctatcgtgtagagcatggtcgatttactattgccaattttcggcttttttggctttgacccccaaactgatcagaaaaagtgatcaaagttctgaaaaatcgat

SEQ ID NO: 25851 - DNA, 2415 bp, Heterodera glycines
tgggtacgggcaagacgatttgcgggattcacaagattttgtgaatggttacggtccaatgaacatagttttgcgtagagttgagcgggaccgggaaatttgacaaaaaccgggaccggcaaaaatttttttttgcacttgtatgttacgatattatgtcaagctaaaacaattaaaacgaatacaatatgcatatgaatttatcgcttatttcgaatacaacaaaagcgacaggagctgatcaaatcgaaccatgcgcgatttaatcattgttgcggtcactccttccgcagagatcgtgtggatgacaacgccccatccagtggatgcgtcgcgttcgaccaccgcaagcatcgcctgaccgaccgccaccgtcatttcttcggaggtcatatcgggtcgccagagagctaacaaaaatagaaatattcgttttgctgtattatgaaccagatatgcaataaataccttcacacagagacatcgacaagtcgccaccagtgccaccgaccgtgtagtcttcgggctcacttacgctaccgaccacgtccatgtgggaaatgaacggctcattttgttgattcagccccacaatgatggggttcgatcaggaacgggccgaacctgcgcttatagagcatccaagcgagataggaagtcaacgcctgaaaaatgaacggttagcaatagcttgaacttatgtgtctcgagaccaatttttcatatgaaggaccaaatttttctgagggtggcgcgctttttccaaaaacatttttgggaacaggggagggtccggcggtgccgataggcgacgctggggaaaatttgtaatttttaaagctttttcaaattaaaaaaaaattccacttcacccttcgtcacgacccaatcccccgcccccttagaaggggcggggtgtctcgagacatcccttgcacatatatgataatttggtgatcttcggggattctaaaaaatgccttggggtctttcagaattaaaaaaatctgtcgctaacaaataagtggcattaaaattcttgaatttcatttcaagaagaggaggacaaactaacaaacgatgacttaacgtgatctctcaattttgacgtctgataaatgcccaaaaacaccaaatattttaacgcaaaaatattggtttgcgccaaaacatgtccctagaagtatattgtgttttagctgaaaagcaaccaaatttttatttcttgatatgattcgatagccctaagtgttctctatcagtctacaaaattcaaaaaatttcaccaagtttaaaaagagttagggccaaagatgctcgaaaatcaaggttttttgagttcctctagccataacttttttgaaacttaacgaatttttttgaaattttgtagacttttagagaacactaagggctatagaatgatatcaagaattaaaaattcagttgcttttcagctaagttataaataatttttcatcaaatcataatgatggttttttaagtaacgactccgccccggttacaataccttgggagacattggacgctgctcgcgcatctcataaatggcctgatgtgtgcgcaacttgttaagcacagtggtggcgtccgcgttaaacccggtcaatccgataaaaacgttgtcagaaatgggatggatctgaattaaagattatgagatatgatagaatttattttccctctttctgtttagtatcttagtgacttaaaaaacggctctagtccagtttatgcgtccaatcgacttttgtgcatcccatcaatttttaagctccgatcaaactttatgcgtccaataaattattatcagctaagcgaagccgacttttttcttcgttcgttggcaaaaagaaagtctgtaattaaaaaacccgtataggaatagaaaattttactgttttgtggtaaaacctcgtcagattgggtcaatagcagttcgtacaatggggtttcgtacaacgtttcaatttgacgtttcgtagaatattaaattttaaaaaataagtgatagtgacagcgacacctacttttaatcaaaatgacaaaaataaagcaaattataaaaaagtaatgagctaatgggtaccaaaaataacaatattaatacgtaaacaataataattcattcgggctttttcggaggatttgctcacttcaactgaacttggccaatgaaagttttagacaatgatttcataacttaaatgcttgcttttaagaaaggaaatataatttattgtgttaatcaaacattcacaaaaattgcaataaaaacaagtagttaaaagagtttttaaagaaaaaatcgactttaatatatattttttctgtacgaaatccgcaattggaacattgtatgaaagtcccattgtacgaactgccatgaccccg

SEQ ID NO: 25852 - DNA, 1747 bp, Heterodera glycines
ttttaatgtaaatcagggatggtatccgtccttgaatggcaaggacgtccttgaaaatgggccctctttcttgaaaataaaaaatgtccttgtatgcaaggacgtccttgaaaatgagcatttggaaaagtttaaaaaagatcaaagaaatttgaaaaatctttgtaattttcaacaatatttatttaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaaatttttaaaaagcgctccgtaaaaaacccattttataaacaaaaaaagtcgtcgcatggcttaaaatcgcaaaaattaggcagtttttggtgaaaatctgttaacaaattgcattcaaattttcaaaatttttccccggcggatactattataccaaacgaacccccccccccctctataccattcaaatttttaataaaaaatttttattataaaatacttttataactggttactacgtgtcaaaaacttacttacaattaataatatttagctttataataaatacatttaattatacattcctttctttacatatgtacgatttttctttgaattcatttaattttagtcttgtaaaaaacgtaaaaagattaccgttttgcccatccgcgaccgaccatttgctgatatgaattttttatgtacaattgcagcaaattttacttctcatttcttgtcacatataacttttttgatttagattatgtttgaatttatatgatattaatgccctaagcttttgctttcttccagtcttttattaaataaaaattataagtttaaattattttcagtaaattatattatttttttattaattagatttacagaatgttaaaaacattacattttgtgatatttaactttgaaaagtaatttaacaatttttcttattgaattatgttcaattattttattaagcaatgcaaaataaccaagcatgggcagttacaccaattattatataagacttttttataaaagcatttttcagtcttttcatacattctctttataatagtgttaagcataaaaaattattattgtgattcaatatttaaattattatgctcaaatctttatgttctaaaatgatttatataaataataatttagttttcttattaaggttgtagtgtcctttagagaattaaaaccgtttcatttattttaacaagtgttatggcaagaattaattggttttttcgttcctcttttcttgactgattcttatgtttttgatttaattaactgtattaattttttctaccttcaaaaattgggtataaatttggtatcatttgatagagcaaggtcgacttctattgtggttttttaattaaaattaactgatttttgcttattttcactaaagaaaaatatcatattcattttttagtctaaaaatgattttttaaattatttagttatattatacattaattaaaatttaatttcatttttcagttatttaacaatttcgtatctttttttatcttttattttatgaaaatcaaattttgttggactcagacgggagcttcgcgcccgtttttaaaattttgttgggcttggacgggcg

SEQ ID NO: 25853 - DNA, 1332 bp, Heterodera glycines
aaaatttttcaaaaaaatacacccctaagaatcatgctaaaatttttcaaaatatactcctatgaaatgaaaaaaaaatttctcaaaaatttactttcttggcaaaaatttttaattttaaaaattatttttttaggtaactattttgggttttttggtcttaaaaatccaagtcctactcatttgcaactgcaatcagtgaataaaaattattttggcttattttttggctgaaaattatgtcactattcgtcactattttggactttttgtcactatttcttcactattttgggatttttactcactattttagttaaatatttcgggatttttcgtcactaaaagttgctgccctagtaattggcgtttaattcaaaaaatacactggtcaataccttttttgctattgtttgttttgatcagccataactcacttgatttcaaactaaatcgaacgaatttggtatcaaaaagtttttgaaaaggaaataatttttctaaaagaaaatttcatgatttttaatgtgttagagatgtgaaaatagtacgccaaaataagaggaaaatacatatatttttttaattacaagttttactaaaaattgggatagaaaatcattaattccttatacattcaatgcaaaattttgttctctatcggtatgcaaaatttgaaaaggatttaacatcttgaaaaaaacttaccggataaaaataaatgctgttaaaaatatttttgaaattgaatttttagaaaaaaaaaccctaggtggttgggaaaattttctgtaaaaaaatgagcaagcctaggacaaaattctataacgaattgccttttggatggtggggctatgacctatacccacagagcgtgagaccgtgaaaaaatgattactgtaaaataaaatttttgtattttttgtgtgcccacatattcgatagggatgtgcgagaaatgatttataccgagaaccgagaccgggaaatgaccccgagaaacgatacgagaaccgagaccccaaaaaacccgagaaatttctcgactctggaatcgggaaccgagaaatgtaaaattttttagccgtttttcaccaaaaattactatttttgccattttggtcaccatttttcaaaaatatgataaagtgggagtccggcagtgccgttagccgccatcgagaaaaattttgcaaattttaaggacatttattacgaaaattgcataaaatttcaaaaaatttgctgaaaatttttactttttggtttcagggggggggtggggccttatccacctcatccccgcccctgcctacgcccttgggcgggggg

SEQ ID NO: 25854 - DNA, 1272 bp, Heterodera glycines
  misc_feature (34)..(34): n is a, c, g, or t
  misc_feature (69)..(69): n is a, c, g, or t
  misc_feature (74)..(75): n is a, c, g, or t
  misc_feature (97)..(97): n is a, c, g, or t
gtcatggatttcgaagttctctgctggactttcnaatttatagaaatgatttatcaaaaaaagacaatnttacnnccaaacacttcgaaaatgtatntgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctagtaattacgttttttcctgcgcagaatttactttttaagcgatttttatgcaattctacttttaaaatacatccaattatctccataatttgatatcttgacacatttctcttaggaaatgaattacccatccggtagtatttactcaccactaataaacacaagaaaatatggaggcaatgatgaagaatacagacgagagggcagcagcagcaactcagggagccatgaccacagaaaagcacacaaaacaaacagaagtccggaaaaaccaaacaacaggtaagctggcaatgaggaattttttgaaatcaaatgcgaatttattgcttaatagggtaattttcgagaattcaaaattctaataaattacctactttttgttcgagttcggggtttgatggaaaccagattctgacatccgttttgactctgagctgaaccaggattcgaaaaaactagaaatttaatttcaagcaaatttttattattattacagcttatttattgtatcaaaagattgtgattttgtttcgtgaatttgatccggttttgttgcataaatgcgattttgacttaattcgaattcgggttcagagtccggaacgagtctaacaataagcggatctcacattcggaacgctttttccgactgaaaattcctaaaatgactttattgaaaaaatgtattttttcaaaaaaggggtggtatacattaccaggattttgttcattattcattctcttttgaagatatgtcaaaggcgacgaattgcgcatccaatcgctcagttcgcagttggcatcagcacagtcacaagtccttcaattggaggccgaattgtcgacgaccaaaacggcaaagaatcacgctgaacatcggcttatcgctcttcaacgcgacttaaatactctacaaactcgaaattcggaagtcatttcggtacataattagttaattgttttct

SEQ ID NO: 25855 - DNA, 1551 bp, Heterodera glycines
  misc_feature (1547)..(1547): n is a, c, g, or t
ctgaggccgcgaagcaggccgaatgttctccacaaaattaaaaaaacgtgcgccaagcgcccgtcctgaagccacgaagcgtcctaatttccctgcaaagtttgaaaacgtacgcaaagcgcccgtctgaggccgcgaagcggccaaatgagtccacaatatttagaagcgcaaagcgcccgtctgaggccgcgaagcggccgaatgagtccacaatatttagaagcgcaaatcgcccgtctgaggccgcgaagcggccgaatgcacttgctcatcacttaacaaacgcgcatgcactagcaacgaagtcctttgcgcgaagcgctcatgtaatgcatattcttttcatctctcacaagtatactgtttacaccgagcaactactgcgccacacgctagtttctactatatatagagaaaaggtgcaactcgtcttaaaaaattataagtccttacggtttgcccggaggggcctgaaaccgtgacatcacttaagcaactttttgaggcgcatctgggaaaaataaggatttttctgtccggcggccagttgagcgccagcggcgctgaaacggccaaataaaaaaaatcgtcgcggttttcgggctgtaacttttctcagggaaccgggagcggaaaaagtccgctgagagggcacaccccagacatgttggctacaactttgtcactgatcactttttcatcagatcaaatgccgagcctgcagaaattggcgactgaacggcgctcaaaatgccggttttggcttttcgtgaataactcgctgggggttaagcggagcgggttggcgccgcttgagcatttgtgtagtttttaaagctgcatccgatggcgttttcagattttgaaaattttcaaaatttttcgagctaggccccctcgaaaatttttcgtttttgaattttattattttttgcagatttttcccaggaaaacggagaccactttcaagcaaccgtttttcgagctctatcgattggtggcatttttgaaaaaatttcaaaattttccggaaatagaaaatttttccggaattgagctccccatttccgttcaaggcttataactcgtcaggggttgattttagcgaaaatttgtcttagagcatttttgtagagaattttaagctctatctaatgtgctttatctcatgtttttaccatgagttcaaaaaaagttataaaattaattgtgattttgaaactcaaaaccataggggggaccccatggttttgcatttcatgaaaaatttttttactcctaaattagccaaaatgcatttttatggcataatttgaggtgctgaatacgtatatacgctttattttgcgtttcagattttttggaaggtgtttaaaattttttgaaaaatcgtcaaaatttgagccccggaaaatccagtgaaatttcgaaaattcataactcacttcgcttttggtcaaatttagtggaataaagctttaaaaatagagaaaaattgggagaattttatgggatttatttataatttctatcttccaaaatanaaaa

SEQ ID NO: 25856 - DNA, 1174 bp, Heterodera glycines
atttaaagcggctgttgagcagcttaaacaaatcaatgcctttgttcaaagggctaatcccgaacagactcatcacacatccataagagagaaacataagagtgaagaaaaagaatcaaccttaaacttggctatcagatacaaagaccaagagaaaaaggctaatcgacaaacatcgggtgctgttaagccaaagccatggcgtgggacttcaacttcatcggaaggatcaagctcacgctcatcctcacaatcgagccgatacggacgatctccgggaagaaaacagaagggaaaggaaaagaggaacagaaagagaaacaggagaggaatagagggaaaaagaggaagagaaagtaagaggaaaaagaggaacaaaaggcgaagaggaagagaaggggaagaggaacagaaagagaaacaggaggggaatagaaggaaaaagaggaagagaaagagcaacagaagggaaaggagaagaggaccagaagaggaagagaagcaaaagacgaacagaaagagaaacaggaggggaatagaaggaaaaagaggaagagaaagaggatattcccggccattaaaaaatctaattgccctcttataaaagctttttggcgcgtagcgccctctagagacagtgtttaatagcgaagctatttcaattttttaaaaataaattaaaatcgtcactttcagtgcccgtagggcactggttattatgaataaaaatttactctaaattttcaaaaaaaaattaataattcgcattctgacttaactccgagtagttgttcggtctcattcctttttcaattacattagtttatataatttttccattaatttatatatatatatatatatatgtctttttgaatattgaaaaaaataaattcttattaataattttgtatatgattttctattttatttagaaaataattttgttgcaccgttatcaaggtgatatttaaataaatgtcttataaaaatatatttatttatctcagctaatgtattctgttaaaaattacatttttttcgatttgtatatcgtttttgcatttattttttttaaatctcaacaatttcagttgcgccggggatattggcgccgctccatttgcgccgcgacacttgcgtcgcctagcaaaaatggacatttgcgccgctc

SEQ ID NO: 25857 - DNA, 1258 bp, Heterodera glycines
ataattaaaacctaaaataattttcgtatatttttcacctccttaggcaaaagacaaaaaaaaatgattcaattttgaacctaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaacctaaaataattttcgtatatttttcacaatttatttcaaaagacaaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaaacattgtacagcataattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccattttttcgttccacaactggccaaaggcgactgtg

SEQ ID NO: 25858 - DNA, 1111 bp, Heterodera glycines
cctcagaatctccaatcacacagtgattctgaggtcttaaccatgtctaaagtaaaatctgattaaatattcgtgatcagcggcccaaataacccctaaagacatatttttggaagatttttggtgaaaaaaattttccactcaaaaatcctggtcacacccctttggtcccgaatcccaaaatcacttttatttttatatctttttttaaaaatgtgttaaaaaggtcaaataaatttctctttatagagaaaaaaattgcggattttatgaatatttaaatattctttagcgccttttttgaaatgagttataaatttatttctgaaaatttaaaatttttgagaaatccaggcctaagtttgtgaatttttaaaatatggaaactcaaaaaacaacttaaaattctccatatttttctcgatttttaatgctttaaatgagctgaattggacaattttgaggcgagttatgaatttttaaaatttaggttgaattttcaagggccaaaaattattgatttttcaaaatttttttaccaccctccaaaaaatccaaaacgcaatataaagcgtatatacgtattcagcacctcaaattatgccataaaaatgcattttggctaatttaggagtaaaaaaatttttcataaatgcaaaaccatggggtcccccctatggttttgagtttcaaaatcacaattaattttataactttttttaaactcatggtaaaaacatgagataaagcacattagatagagcttaaaattctctacaaaaatgctctaagacaaatttccgctaaaatcaacgcctgacgagttataagcctcaaacggaaatggggagctcaattccggaaaatttttctatttccggaaaattttgaaattaaaaatgccaccaatcgatagagctcgaaaaacggttgcttgaaagtggtctccgtttttcctgggaaaaatcggcaaaaaataataaaattcaaaaacgaaaaattttcgagggggcctagctcgaactctatggggaattttcaaaatctgaaagcgccatcggatgcctcggttagggctacacaaatgctcaagcggcgtcaacccgctccg

SEQ ID NO: 25859 - DNA, 1281 bp, Heterodera glycines
  misc_feature (1268)..(1268): n is a, c, g, or t
gggggggggggggggggggaaaaaaaaaaaaaaaaacaaaaatctttttttttttttttttttttttttttttcccccccccccccccccccccccccgggggggggggggggggaagaaaaaaaaaaaaaaaaaaaaaaaaaaaccttttttttttttttttcttttttttttttttttttaaaaaaaaaaaaaaaaaaaaaaaattttttatatggggggccggcccccccacccacaaaaaaatataaaaaaaaaaaaataaaattgtttttttttttttttttttttaaaaagggagagaagaaaaatttattttataatattttttattttttttttttcccgcccaaaaaaaatgggggtttttttttttaaaaattttttctccccccccccgcgccaaaaaaaataaattttttttcccaaatttttccgcgcgcctttccccttaaaaaaagggaaaattttaaccaaaaaaaaaagccccccccggtttttttttaaaaaatttttaaaaaattgggctttttccccatttttttttttttttttgaaaaaatttattaaaaaattttttttaaacggtttttgaacccccccaaattttaattaaaagttaaaaaagggtttttggaagttttccttttaaaaaggggggggaataaaaaatttaaaaatttttaatttctttttaaatttggagaagaatttagggtttaattttaaaaagtttcatggaacctagcgcattaaattgatattatttctccaaattttgcaggccttctccattgtaaaggataactttacctgaaaaaatggcaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctatggaacgcaccaaattttatttacaangttattttaggca

SEQ ID NO: 25860 - DNA, 1779 bp, Heterodera glycines
ctgaattattacgatttgtcctgaattagagaaaggcactattaaaaatataaaatgtcctgaattattacgatttgtcctcttttagagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatgtcctgaattattacgatttgtcctgaattggagaaaggcaatatgaaaaatataaaatatcctgaattattacgatttgtcctgaattggagaaaggcaatatgaaaaatagaaaatgtcctgaattattacgatttgtcctgaattggagaaaggcaatatgaaaaatataaaatatcctgaattattacgatttgtcctgaattggagaaaggcaatatgaaaaatataaaatgtcctgaattattacgatttgtcctgaattagagaaaggcaatatgaaaaatataaaatgtcctgaattattacgatttgtcctgaattagagaaaggcaatatgaaaaatataaaatgtcctgaattattacgatttgccctgaattggagaaaggcaatatgaaaaatataaaatgtcctgaattattacgatttgtcctgaattggagaaaggcaatatgaaaaatataaaatgtcctgaattattacgatttgccctgaattggagaaaggcaatatgaaaaatataaaatgtttttttttgtttcgaaaatagtttaaaattaaaatgcgcattaaaaaagaaatttagtaaaattttggaatctcaaagtaattttcttaaaaattttttatttcaattgcctcttttgcaaaaattccagcaaaataaaagaaagttttttcaaatgacattatataattttgaaaattaaatttagaattttatgttccaggtcacctactactccatttttatagagtacagtaagatttaaataaactgttttttataaagaaaatatattcaaatgagagaaatagtacagtaaccatttaatattttacggaaaagaaacaagcgcagcggagaaatagtgcatggatttagttgccctctgccacccattccatcgctcatcaccccagcaaaaaatcagaaattcaatttctatcatataaaataaatgcgaggtggtttatctcctccatatttgggggtagtccaaataattaaaataataatcttctcaactgataatatattgggctagtcagttttataaatccgcctgcacatgcttagaaaaattcactaatataatttcgtcacaagttatttttattcagcacaaataataatataatttcttcagaaattattatgtacttatcattaatatttttaaaatttatgcaacaattgtcagctatagtaaaataatattattccctatataattttatacgaaattctcaaatataaactccttatagtaattagaatccaattttagtcaatttttccagcagtttttcaggttttttttagataatgataaactaatgtttttttacaccatcatatgatacgaatttttcaaaattaattcctaaaacactataatttaatagcaaagttattaagtatgtgatagtttttgtcgtgagaatttgatttcaaaagtttttttttcgggtactcgctcaatctcctcaaatgcattggtgccattacaccgattaatttcttactttttgtcttta

SEQ ID NO: 25861 - DNA, 2481 bp, Heterodera glycines
  misc_feature (27)..(27): n is a, c, g, or t
  misc_feature (2440)..(2440): n is a, c, g, or t
  misc_feature (2460)..(2460): n is a, c, g, or t
  misc_feature (2467)..(2467): n is a, c, g, or t
gatatttttgatgatttgtggacgacnatggaaagtgacggaaaagttgttcatatttaaataactatttcaatattaattttaattaagcaaaagcaaaacaataagcaaccacaatttgagggacagaatcatttgacagcagaaaatacggcacaaaaaataaaagaggagccaattgaaattggaaacgaaatgccaataattaatgaaaaaatgaaaataaaatacgaacaagaagaagaattcaatgtaaaaacagaaccaaatattggagaaattaaagtcaaagaaggagcaaatttgaacaaaaaagatttgacaccaaaagaaagtgaaggaaacaattcatcaccaattaaaatgggattattatatcaagtcaatatcattctacaaatttttgaggataatgaaaatgcctaagagacaaaattttcttggtttttagcaggccggttttatgtcgctagaccaaagtgatcaatattttgtctaaatcttcgctaacgagtcacctaagctcttcaagctcattaaaaaatttctaagccttttttattggagactagagctaggaaaattataaaaatgcgcttactttgtttgattggatttagtaaaaatgagcaaaaagttattaatgtattcttaattgatttacatcaccttatattcaaatttgtagagaatgttgatcttattaatgagtaccttagcaaaggaagtgaacaaatttctttaacggaacccgaaaaccctgacaatgaaattagcgttgattttggagatgaaaaaatggacaatttttcatttaatgaaactgtagaaaacatttttgaacatttaaatgtggaaaaggataccaaaataaattgtgaaaataatagaaaaacaaaaaaaggtgaaaattaattagaaatatttttaaaattcattaaacgaaatttggaaaaaaataaaaataatttttaaattcactattaaggcaaattatctgttgaagagaagaaacaaattgttcagcaatatattaatgctaaaaaaagtttggacaaaaaattagaaagaaaagaaattaaaaatttaaatgaagcaattgcccacaaattgggagtaagcacaagacaaatcagagattggaagcacaaatatcaaattggtatatatttgttggttaatagtatggcttttgttattaggatcttctataaatagtcaaaataggcaaaatttatacaaaattggtaaaaaaatttagccaaattagtagggatgagattttaggcacaaaaaatcgcaaaataggcattaaataggcaaaaaatatatattataaaaaaacaggttcaggactaagaaaccataaaatctttttaatgataagtagggttaccaaaaaattcctgcctttaaatttcagatgctcataataccgtacttttttaaatacaataataacctacacattcttcaactaacagatttttcagtcagtgtgtaattttcgcgtttgttttttaatctttattttattacggtaaattataatttttcagaatccattcgcaaatattcgcaagaaaaaaagctcaaaattattagacaatttgacgaaatgttaaaggaacataagagaaattcgagcaaaaaatacacttacaaaacagaaaatcaaatcgcaaaagaaatgggcattaaccgtgcaacaataattcgttggagaaaggaattttgcttatcaagtaagaaaaggaattatttatctttttaattttgctcccgccaaaaaaaaataaattaaaagaaatttttgaagcaaattttgaaattgaaaaattgcagattttgggtaagacattagcttaaaacatatgcgattctttttcagtacttaaaaataaccaagaaaagaaaaattttaggagtagaggaggggaaaacgaatagacaaaaattctttaaatttaaaaaatgcatgaaatgctatttaattaaactaaaaaattcgaaaatgttacattaatggcaaaatatgtgtaaaaaataaatatttgttttctaattcaaattgtgatagaatttatgctcaattaacctaattaagaatggaaaaaacatagcgaagaagaaaaagaaggaataatcaagaaatatcataaaatgataagaacgacagaattcacagaaaaagaaattgctgaaatgttaaaagttaatatacgcacaattttacgttggttaaaagacaaaggtaaacaaacgatttgcaaaataaaaaaataaagaaaaaaataaaatgaataattattaaattgaaaatttattaattttaacaaatagattttatgacttataaagagcataatgcctaagatttaaaacaaaaaaaattgtaaaacaaatttttttaagtattcatttttaagaaaaaaattanaggaatttaagtttttctangaataanttatactttttcca

SEQ ID NO: 25862 - DNA, 1055 bp, Heterodera glycines
ccggtaaaggactaacttacactgaaatgagcgccgaccctttttggctcaaaaaaattttcgaaaatctgagtctttcgttcttttttattttttgcaaaattaattcttaaatattttttcagaaagggttctgaaacgcaccaaattttatttacttgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgattgagtacccccaaacggacacttgaaaaaatcgatttttttt

SEQ ID NO: 25863 - DNA, 2491 bp, Heterodera glycines
aggtcattgggtaattggttttggcggtaaaatgcaagaaattcatctattaaatccttataaaaaaaacaattttttcgggggagcaccatatggaaaacgcaatgttttttaaattaaaaagtaaaataaattttgtagaaaaaatctttgcctttttttgtttttttgattttcgatttttttgtgttaaaagtgccaaaatatttgacacggaacattcaatctcttccaaggaatggaaatgtgaacaacgaataataaattcccctgagataaaaaaagttttttaatgcagcggaggaaaaggaaataaatgctaagcaattgaccaactttggctacttaagcttaatgagaataaaatttgtgcaaattaaaatacaaattaattttttctaataaattaaatttcaaatgactattttaaaatatattatgaattatttaccttgtcaaaattttgtgttgccattattaataatattttgttttcatctaaaaataaaatgaaaaaaatggaatggcacgaatggatttttttgccaaaaaagcagcggcaaaattggcattttgattgtgcaaaaaaaaagttttggagccctcttcaactgaagagcaaatggactgcatgcgaattggttaagacggaaattggcataaattatgcaaaaataggcattttattcgtgagaagatgttttagtgttagcgtgtgaccaagaaattgaattatggacaatttaactgaattaactgaactcggtgccaaacatttaaatggtgccaaacaaaaaattttatctaaacccttggccagcgacacatttttaaaataatgccagacttaagtttttatttaattttgaccaagaattcccaacccttgaagtagacgccataattttataggtttcattggacacttttagtttcaaatagtataatttaaatatggaatcttaattttttttttttgatatttttatatcaaactttgggtttttgccatagagaaggtggcgcttcgtctgttgcgctggtctccgcaaaattatataatgctttatcctcgcctcgatgcccccggccccggacattttgcctaccgaatcttaatgtattcgctgtttgcgattgtcagagaatgggtgttgaatgtttgtgagaaaattcttttatacatctaccagggaacgaaaaattgtggcattaaatttcaaaattggcagaaaaggtggaattgttttttttaaatgaaattataactcaaaagcataaaaaattgttagatagatttgttctaatgggacagtgttctttttgcgtcccaatttatttttgtttacaaaaatgcatattgaaaattataaatctttacccatccatacagaaatggattgccgaaaattctaatgagagaaatttttatggaaaattttcaatggagcagaattatgtaattgtttcattccgctattgttcaacgaaatgatattgatctgaatgctaaacaatctctgatcatctcgattaacaataatgacctgtttctgttcacttttggacttttagaatttaattgttagtttaaatatattttttatttttttgttcataaaaattaaaatatttccattttttggacatataaattgtgaaaaagtccagcaccggactttcaattaaaaaaaataaaataaaaatagaaataggaaactccagaaattgtgaaatttgttataaaaaacaaaaaccaagaaaaatgccacgaaaaaggtgactaaatcgcattcctgctgactacccttgagggatgtcaccacttttgtgaatttctcggccggcacgccgttcactgtttttgacaacaataacttccagttgctgcatggaagttgtttgccatgccgcacttttccttctaaaagtgccaggaattgacagccgtccaattcctcacacaaattgtttgtcctgtcaatgtgtttcgactcatttggtatgggggggatttcattaacgcacacccatccatttatctgtcatcattagttatcgcattaacgcttgcgggtccgttacaattaattaattaattaattcaagcgagcggttgctgaaaataattaatgtataaacactttggataaacaaattaaaaagagagatgcaattttattaaaacttaaaataaaaattccatatttttgcgtgttgagatgtttcttaatctgtcagatttcgtatataatttttttttgtcaaaaatgagtcatgaattttgctgaaattaattgcaagcattccatggccctaaagtgtttctatattttgacaacatattccaaaaaatcttcaaataagaaaaaatcacactaagcaagaaaatgcaaagtataaaattattccgttacttttaataagatacgaaattttgaaaattccactcggacgagattcgaaatacctaagcaatgcctgttcctag

SEQ ID NO: 25864 - DNA, 1234 bp, Heterodera glycines
  misc_feature (5)..(5): n is a, c, g, or t
  misc_feature (1122)..(1122): n is a, c, g, or t
  misc_feature (1219)..(1219): n is a, c, g, or t
cgtancatttttgtataaaaattatttcaatttttaaataaatattttaaaattttaatccttgtctcgagactctcgaagacatatccagacaatgtaatcgggattcataagcggaaactgacttaatatgtgggaaaatgtccaggaagcaagtgctcatgaacacaccgcccgcaaaacaggacaaaagcgtcaaaatgtaatccgattttctgctccgctgctcatcattttcgtcctgacgacgtgtgatcgcgtgaagaagctgaaaattaattaaaattctgatcaaatgttttgattaaaattggatttaaaataattaatgcttattctattcgatttttttaaatttatatttctgttaaatttttgtaaaaatccattaattcctaatcaaaattggtcaagattatcagcagtcctataatatacaaaataaatttcttctaaaaattctctcaattaaaatccacgattaataattttggatcactttgatcggaagcagtccggccaacgcagtggtggcaaacatcgcaaatgcgagcagtacttgcagagaaatggtgtccatcagcaaatgtagaatgaaaaaatgaaatagtaatgaatgacccgtgttaaataaaaaaaaacctttaattatttaggtaattagtttcatttatgccggtcagccaagcaaattcttggatccctttggtattgtcactggtcttgagattaaggggtataaaaatggttgataaatatattcgagactcaatcaaaaattacagagactcgacacactgaaagcaaaaatttctcgggtcgagactctcgagcagcaaattttaaagaaatatatcggtcagagcagttcaaaatttccgctctccttaaagatacagctcacaatcagtaatttttcctcaaaaatctgccgctattttatatacagatatatggtagggacgtaaaaattgcattttttttttccccctaaatttgggacgaatggtcgccgggaaccaattaattggcaaaaaaataaataaaataaaattgcttgtgaaatgcttgttttaactgtggtgacttgcgatcaaattgggggcacttattcactcattncgttcgtcgtttttcgatcgggcgcccctttgttggttttgcggtgcggcattttgcaaacataattatgcaattatcatttttatgatttgtgtgngacattcattcactg

SEQ ID NO: 25865 - DNA, 1003 bp, Heterodera glycines
ttttatcatttacctgggaaaatcacattaatagggctagattatttaaagatttagttacatttaattaataaatcaaataataaaaatgttgcaccaaattttggcgaaaaaattagccaagttgcgcacgttcactggaaattgttgatgatgtgatcaacaccgcacccaaaaaaagcaaaagaatgtaaaatttcatttctaaattaaatgcgatgaaatttttcaaaaatgaactgaattctctgatttttttgtcttggcacatgtgcccgtacctcgttttatttatatacaaatatttaaccgttaaattgtacaattgtactacaaacagcgcattatttatgaagaaatatgaaaaataaattaaaatgaataaaaaaaagtttactatttttaggtacacaaaaaatcaatcttttttattttggttgtgccaagaatttcaattaagacaaacttacgtaaaaaaaactgtcaagaaaatataaaatgaacaaatttgtacttttcatggcatttaaatatattaaggaaagagcaaaacctctttgaaaaaaactcattacaaaaatacgacgaacttaaaacataaatgaaggagccacagatccaattaatttctataaaactatttttcaaaaaagttataaattgacaaattaatctttcattatcaatattagattttatttattgaaagtttatttaattaaaattgtacttacaagtattctcactattttcaataatttaaaatttttaagaaaaaagtgttaagcatacgatatgcaacctttaattacacattaactaatggaaatgcttacatttgccattcgtggattcatatcagcaagtgattaaggtttacaaattcctgaaaccaggaaaaatcgacaagatttaaccgttaaacaaaatgcaaattatggttgaaattactttgaattttctcatttgctaccatatcacattaaacaaaatgttgtgcttt

SEQ ID NO: 25866 - DNA, 1817 bp, Heterodera glycines
cccctcccttgccctccgccatccctctttccctctcccctccctttcctatccctcttcccgcctctccccccccctctcggcactttttgtctcccttcccccaatttctccttgtatttgccatttcttccctttaaagttccaaaaatggcttcacaccaacaatatcagcgttgatctgatgcatgaacccaatttggtgctgacaaagactgaccctccgctcgctttgctcgcctccctttggttttatatgacccctcagcccccaaagccgtcaatgcacgacataatcactggtgaggaggcaatttgaaatggattcgtgcattttaataataatttccgtcaaaaggacaatgggaggcgggcgaaataaatgaagcggcgggcttttcgggcccaatttttgggccgacgagtttagtgattaacaacgaatgtgcgggagaggatgaaaaagcgccggggggcggcggcgaaaaccgacggatcaaagcattcaaatggctctgtcggcattttggagtttcggctggaaatcagacgactttgagttgcaaaagtgatttgactggtcaagattccttgtcttcaaaaacagtttttcgcagaaatgccgcggcacttcgatgagatgatgcacaatgtcagctggcagcccgactggtcctccacttggcgggaggatcggccgtgcgtttgtgcccccgccgcttacgggggttggctgcatgtgccgttttacaagtggcatttccccattatcaggtgccattccctacttccagcctggcttttacccttcccaatttgtggaagaaaatgaggccaacaaagcccagtgtaaaaagatgctctccgaacagccgcaaaacttcggcatggatccgatgaccagcggctgtctgaaccacacaaaggtggcggagggagcgaaagtgccaccggggacaacgacgctgacggaaaaagtgccaatgagtacggcgggcacaaaagtgccaaggatggcttacggaactgtcagctatttgcgaccaaatctgacgataattgccttgggatagggcggaaatgcctttgtatttttaatttaaaaataatttatcggttgtttcctttaagttgtcattagtaaaatatcacttccttaaatttgggggaatgtaaagattgtcataaatttgtttttcattttgcttggtaattttgtcacgttcaattttgtgccttcgctgccgctggtcgataaatgccacacttcgcctgcctttcgtgccacccttccctttcctctcccattttatttataatgattctttttacaattttacatcccaaataataattaatcaaatgcttttttttctgttgctcctctctctgtccctttttctgctgctcgtgccaaatgtctgctgtcataatgccgaattggtgctgctcgacccctctcagatcggcttctttctgcccaattattttgttaaaaaatttgagaaaaaacttttcgtgaaatttgccagagaatttcggcctgtttttgtcgcatttgcaatgctcgaaccgccttatttatacgtggaccaatcggaaaacattcgatcggtggaccgagcggaggttgagaaattaatgaagttcaaattggtgtcacgactgaggaaggagaagaagctgatggagacggcacagtttaatctgacgctagcacatgacatccaaggcgcactgttctcagttccggttccgtcggttgaacgatcgcgggaacaagaaacatttggcatcactaaattaccatattaaga

SEQ ID NO: 25867 - DNA, 1696 bp, Heterodera glycines
catgtattccgggtctcacaactttgtttaattagattatgacttgttcgaactcgcgccccaacgcaaatcctctgaaatcggtgtttggaaatgcgcttttttgcgagcggggcttgtcgaaccgttgacagaaaaagttacgaattgtttgtccgatccgaaccacgtctgaagaggcagcctaagggaagaaaagggaaacggagaaaaaacaaataaataagtaaaagtacaaacatttcttttctcttcggcggagtcggctgctgattctccgacaatggtaatcgttttttagccattttacacgattttctgctttataaagaaaattgaatattcccaagctattctttttctaaagaaaatcttaataaatattgaatgcattatggatcaagcccagtagagaccggactaacccggcgaggcttttaccttttcacggacggacggtaaaaaagaaacgcacaaaatcattggcgtagaaaacaaaatgccaatattcaaattcaaatgaaaaacaaaggtaatttaatccgatgaatattttaaaatcataaaaattcattacaaacaaagaaatttattatgatttaactgtaaattaacaattttattattaaatattaaaaattgagaaaagaacaaaaataagaattttaaataaatattactgaaaaatatgatagaaaatcattaaaacctatttttggattttgttttgttttacaatatgtacaaaagaacaataggctgagttctcaggatgcaacggaattccgagttcagattacaggggataacgggatgaaaacattctgtataatactaaagaaattaaaaaatttcaattaaattctacatttatattatgatttttagggctattaatgccgaagcatcggcatttttaggggcagcgattttgactgagtagggcgggcaatcgtcggcaaataatcattgaaataatcatcatttttatattcatgcatggtttcaagagagaaaaaagtgtagcctaagggtgcttaattgccaagaccattgaattgattgtcactgttttttgggcttactttcatttcattgtttggaaccataaaaattacctaattcgatttattattctttcttcactatgctttactgttttaaaatggacaatgtttctttcgtttgttttcttcggatgaatgattttatttccgactgtttctcttccgtctctcattttggcacttttccgctgaatctcttcggcttttcactgtttctaagctttgtccctcctccgtttgccattgcattttcctcaatttgtcctccatttccaaattcgtttcccgtgccattcccaaaactttgtccaattcctgcgcatatttttcccttaactttcgcacattttcttttttgtttcctttcaatggcactttttgttccatttcttccgatttctccacacttttcattaattttgtcgtttttgctgtttcagtgccgtctccgccttttttcaattcttccgttgccaatttccgcgcattttttctcatttttttgtaattatttttaaattgattaatttgtttaacatattttctctcaaaatctgttcaagaattgtgaaattgttctcaataatggcatttaattcttgtcgtataagcgctaaattttctttaag

SEQ ID NO: 25868 - DNA, 1259 bp, Heterodera glycines
caacggcggcacttgcatccgatgcagctgttcacgggctctctaaccctatttttattttttctgatctctgctctgaaaggagttataacatttttcacaacagttttgcatatttcagacacattcaaaaatttttaattagtatggtagtccaagcctattattattttttttgactagtctctgaatggggttatcaattgaagttttagtatcctttttgaaaaacaaaaattttaataactgatacggtagcccaacatccattgccccaatgtacccttcggttctccaacgggagctaacaattgatttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcattttaacagacacattctaaaatttctaatttagtatagtagtccaagcctattattattttttttgactagtctctgaatggggttatcccagttttagtatcctcttttgaaaataaaaattttaataact

SEQ ID NO: 25869 - DNA, 1982 bp, Heterodera glycines
  misc_feature (53)..(53): n is a, c, g, or t
tatcggaatttgcacgagaaatcgtttggagtgaacgtaaatgtgaaactgcntgtgtacataaagggaatgccatggaaaatatgggcaggaattaatacgaaaaatgaaagcactgagaaatggttgggctttttccttttgtgcgatgcttctaaaaaaggttttggttatcaaattattaatagaaataaaaattattttttctataaaattggtgtaattaattattgaaaaaacttatgtaaacagtaatttttaacataaaattaaaagtgattttttaaaggaaatgcgttaaaatataaatttgattattatttaatttgctttaagatggaaattggagccgcaaatgttcggcaacatttcgaattgtctctcaaaagagcggtgtggaggattttaagagagaatacaatgaaacagtttttaacaatgaagcgaagtcttgggggaactatttcatttcttttgcggtgagtggaaattaattagttaatttacattttaatattgtaatggcaaattaaggaattaatggacccaagcaaagggttgtacaacaaagacgaggacaacgtcaccttggcaattgattttacatgtgaatagcgtaaacatttcgagaaggattgaaaagggaaaggaaggaaatcagcaggatgagaagagagtcttggagggcacaaaattttcttggtgcttaaattttatatttttttatgttttgtaaagtattttggtttcataaagcaacatattccaatgatagggatggatttttatgtgctaaaatcgagaaatatatatacctaaagagttgataaaaaaggcagaaaaatttgctaaaatgcagaaaaatgccaaaatagttttcaaaaaattggaaaaacatgtcaataaatgtgtgagttttccagaattgcccggattcatgatcagctaccctgaaaaccattcgaaatacgctttcatgattttggtaagaataatttttttgaaaatatgttcggatgcggggttcggaattggcagaaaaagaaagcctaattcttattcagcactccaaaacgcgccttgaaacgttttaaaaatttcgagaccagtaaaacacattattatcgtttaattttagctgcaaaagaaaaattcaaaaataaaattaaaattaaaaatctgagaaagaacgaattctcgtcaaaaaccaatttacaaagcaagcgtccggagggccaataggcgctccgggaaaactgaaaatttatgttcatttgctaaataaatttatgaagaatataaaaagatgtaacttattgctgatttaaggcttgatttaaaaaactaattgaggagagaaatattttttgtttttatgagatttggtagaagattttgtccaccaaaaagtggacatccgaatgctcagctgtgctcagtatcaactttatctcatcaatcactgatttggacatgataaactgaaatatttgttagattatgatacataaaatgatgacaattatgtcatcttttattgtctcctcgaaaatctccattttttaataaaaataaaatttttaaaaatggtaaatatacaaataaaagtacataactaaaaaagtgtatttggaaaaagagacacaaattggagacattcttttaggggagggcacaaacaaaaaattacggcaaaatgatgacctaaaaaagaggctaagaccagaaaagaatttgatggattgaattaatctctttttttctaataaaatgaattgaaaattaattcccttcatttttaacagtgtaaaaaacaacatttgcttcttctctccaattaacttttttaccatcaataccaatttgtacaaattttgcatataaatagagaaaaaaaaacttcggtcaacaaaaagacgtgcaaaaaaatttttattttgcatttaggtatataaattaattgcaaaaaaaaatatttctca

SEQ ID NO: 25870 - DNA, 1604 bp, Heterodera glycines
tttttctgataattttttaatcagccattggcaattccttcgttcaagcaccgcactgctcctccagaggcaaccgatgagaatggccatggattcattgaggatagttggatttccgactcaacggaccgtgaggtagacccctcagtttaaaagttttgaaattttttctttaataaaaattcaagctcgatgccggtgttacgagtgacaaaaacgtcgttgatggtttgccgccgaagccgaaggaaagaaaatacaagtcccattacggtaatctcccacatttctgatcaattaataattacagtaaaaatgtttacagttttgacccccatccccgaagaggaggacaatgaacaggaggacaaggaagattaagaatgagggactgatggtcgacggataaatgaatgaattaacaatatcatactcaatacattaaggagatcgaacatttcattttaataaaaaaaaaatattcaaaaaaaatggccatcaccaattataaaattaattgtgtaattcccatcacccccaaaatttaccacgagaatccaaattgcacttttcactccccacattcttcaatttcctccgtaaatttttgtagtcggtcacgaattgaggccaacatgcataggcttgagttctgcttggccttttcctcaacggtcaaaaccttcgcaatcagttgcatttttaaatttttgatttcttccagcaaaaaggcttcgcctaaaaatgttgatcaatcagataagcaattttaaaacttgatcaccgaatgtagtcgggccgttcgacggaccgccaggtaacgaggcggatagttccattctttcgaaccccatcgagatgtcatgcatttgcacttgatgtcgaagatttcgtcgttgttgctttttcaggtgccgacgaatacggaattgggaccatagataatcactgttccgttttgttgggtgggagttgaaacgacggtttggtcgcattttagaaattgcgtaatttataaggaggacactcaaatgactcaattcaaggaatggatggaatacacccgaaagggttagtcaaaacaaaagctgcgcagttgcgtgactaggaacccgccccattgacacccagttgctcaacgaattaaactcaaaaataatttattaaaaacaaaataaattcaaaatagtgggagtgattattaaaaatattaatcggtaaaaaacaaattcattccggctttttctggttctttttttggccagcgatcagatcactgacacaacaattaagtttagcgcattcttcacacatctcgagtccaatcgccactcgcccatcttccagccgacgtgccttgtctttgttgtgaaataaattgttccagtcctctgaaagctgtcaattaatttggtcgtcaaaaatttgattaacctgagcacagccgaatcgcaagcacaaattggcctctcgtgattttccaaagaaatcgctcatcaacgtttggcttcttagctttcacttgttgctcctccgcagtttcatgttgtacaaattgttctgccatttgatgatgattttgcaagaaatgatttgattgtgcg

SEQ ID NO: 25871 - DNA, 1511 bp, Heterodera glycines
actcagagtgaaatgaatcatagccatggcttttgattttctatttacggagtttaacatttcacaacaccgaagcattaacattttcatttctcgcttaaatttgaaccccccccccccttctttcccaacagtttaaagtattattaccttgatgtgttttctgtccctgctaatcaccgctcaattataaggctccccgtcgaaactgagccccgcctcggcagtgttcgcacccaagccgttgtgcgtgttccgtgggcacaccgcggacgtgttggacttgagctggtcgccccgcaattatttcctcctttcttccggcatggaccgaactgccaaactgtggcatttgcaccgcaacgaatgcctgtgctcctttcagcacattgactttgtcacttgtttggcatttttgccaaaggtgtgtttgttttcaatgatctataattggctttcaatctaatggtccaattgcttttgatttgttcgatttccttttcatcgcccaatccattttcaggatgatcgttatttcatttcgggctctttggacggcaaaattcggctgtggcacattcccgagaagaaagtggccatttggaacgaagttgagcaggtggaggacgaaatttatatgactaaaatcacaaattcctaattttcaggttaacaaattcatcacggcaatgactttcgtgaagaatggcaaatttgtggtgatcggaacttttctgggccgatgtttcttttattcgaccgatgtatttattttgtttttttttagtatttttaaatttaatttcctcatttagcaactcaaatatcacactgtcattgacgtgcgctcgtcccgtggcaaaaattcggttggacacaaaattacttcgttggccgtccacggagacaaactccttgttgcggtgcttccaataaaaatttaattttaaaaatttcaatgtttttttcagtcggatgactcgcgaattcgaatatacgacttgcgtgacatggatttgtgctgcaaattcaaggcattcaagcgttcattgctttatccgtttattttggccattattttcatttttccctttttagggtgcccaaatcagtcagagtttaatccgcgctgccttttcgcccgatggttcgcatgtgatcagtggtaaatgtgtttaaatattgcactttccgttattcaaattccccacaaggctctgaagatgcacacatttatttgtggcggaccggcccattgccaagttcgttgggtgtgcgcaaggatcggaaccacgcatgggaacgcatccgagcgcaccaatcggcggttagctttgacatcttttaacatttatctaattgtgagaatgggtaactcgaggtattcttgtatcatcacgaaccggagcagttcgtcctccacccaatttttttttcaaacccttaaaattttccacaactaaaaaaatttgttgtaattttctaattaaacaaattttctgaattttttt

SEQ ID NO: 25872 - DNA, 1352 bp, Heterodera glycines
  misc_feature (1240)..(1240): n is a, c, g, or t
  misc_feature (1334)..(1334): n is a, c, g, or t
aaaagcccaaaaatccggatccaaatgtaaaaagaaaaatagtgcacaaaaaggagccgcctcacggcggggcttaaaagcatggtacatcataattacaagcgaaaataattttcgtatattttttcacaatttatttcaaaagacaacaaaaaattgataaaatgttgaaacgaaatagtgcacaaaaagggagggatggttagacgaaaagaggaatttttagaaaagaacgcaccccatctgatattcccatttttctgtttcacaactggccaacggcgactgtgctcattgacacgtagttgttcacagtagttgtccaattaaggtacttggactttccacagtaaaatgtggtgcaaattttggaactgtcccgcctcacggcggggcttaaaagcatttgtagcgcaataaaaaagtttattgttttgaatttttcacaatttatttaaaaaagccaaaaaatccggatccaattttaaaaacgaaaatagtgcacaaaaagaagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcccatttttctgtttcacaactggccaacggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatgcttagacgaaaagaggaatttttagaaaagaacgcaccccatctgatattcccatttttctgtttcacaactggccaacggcgactgtgctcattgacacgtagttgtccaattaaggtacttggactttcacagtanaatgtggtgcaaattttggaactgtcccgccctcacgcggggcttaaaagcatttgtagcgcaataaaaaagtttaattggttttgaatttttncaacatttattttaaaaa

SEQ ID NO: 25873 - DNA, 2239 bp, Heterodera glycines
  misc_feature (73)..(73): n is a, c, g, or t
  misc_feature (76)..(76): n is a, c, g, or t
tcatcagagggggagagatgcgaaaagatgaaaagaactggagagagagagagagagagagagagagagaganaancgaagtaggagaagggaagagttgtaatttatgttccgttcgttttatgcattacaaatataatggtagtattaaagttgaagtttgtgtttaagggaccaagatggggagggaaagtggcgggaaagataagaagaagaagggtaacataacgaagtgaagttcaaaaagggacttcgatgcgaagagagagagagagagagagaggggggaggggaaaagaagtcgccttggggtagtcgccttccgatctcacgtggtggaaccggtgacgaaagagaaaaacagaggcgtgggatctctcttctgtggttgttgactatatacacagcagcagatgcgaggaaaagaaatgttaggacggtacggaaatggggacggggagagagtgttgtgaaataaaggaagtatgacaaggccctaaaaatatagcacatcttcttaagaaatacagcacttttcgaaaacactgaaattgatcaacccatttgttataaagttctgctttttcaaagggcttaatcggtttttctgaaaatctatccattcgaagatttttttcccgtaaagtttaccgttttttcatcttttgggtttttctactcattcatttttccgagttcaacaaaagaaaaatcaaaaatcatcaaaaaaggcattatgccaacctgatcaatgtaagatgtaattacttaccgtattaaagggggcgggggggggggttctaattcagtggagttctatttcaataaatacggtacttaagaattacggtacatcaaaatatcatacggtataggtatcaacgaagagacctaaactaataaaagcatataaaagccattttgtgctttttctgtttcctcatacaatacataacaccgtccgaaaaaacgtgaggtgaacaaataaaatgagtgtagaaaaaaacgactctcatttttgcatattctttcagaatattaatgacgtggagcggattcgaaccttcattccttctccattgacaaccttacaaaaaccactaattatgagtcacagttctcatcttttcactagaggggggagtattttccgtacgctgtgtacatatttgttttcgcggttttttctatcctaaaaactcttaaattttcccgttttttagcgttaaaaatggcgagatgagtagaatttgcttaaactgagctcttgtacgaaaaaagattgcatgtgtggctcagtggtttttgtaagatagtaaaaggacaatgggcggaggttcgagtccgttgtgcaacatgaatatttttatttatttttgtccaaaaatttaaaaaatacaatttttaaatttatttttgaaggtttttttttttttttttatttcaaaaacggaaaaaaagtttcttagagagaataatgtatgtattagaatttttcatgcatgtaacaagaaaattttgatttctgctgctgaacaaataagcagggatgcaaaaaacatgcaaatgcatattttttcctggcttctccatgctctaaatagcaggaaaaacactttcttttttgtgtttgcgtataaaaatcgggacttttatttgcatatttatgcatatttcgccattttttggaaaatttgttaacaaaaatgcaataaaaacggaaaatacacccctaagaatcgaccgaaaatttttaaaaacacaccactaagaattggaaattttctcaaaaattcttcccccaaattttttttttcatgagaaaatttttgatttaaaaaatgtcaatatttgctaaagagaattttataaaagaaatgtagcagctcattggcaagtgcattagtaaaaaaaaattttttttattgaatttgcactcctaattttcaattttttagtgcatattttacgatttttgtgcatatttggtgcatatttcacgactttatttgcatatttatgtgcatattttggccacttttcgtgcatattttttgcatccctgcaaataagggtctggtgtgagttaagtcatactgaaatgtcagtactgaaatgactgatctcagaagaaggtgatttttcccatttctcttccttttttttgttttattcgccatcgccacgttcacgtttaaaaatgtttctacaatgttaccaaccagcatctaaaacattt

SEQ ID NO: 25874 - DNA, 1320 bp, Heterodera glycines
aggttttgattgatgacgtagataataatttttacgatttgtaatttaaataaaagctgattaatttagtttatgttttagtcttaaaagtaattataaagatttaaatttaacaccgaatttaactttcccgaatattttcaatcttgttcgctattcgaagtatttctattatctgatgattaaacgtcacgtaaattaacagttttgaatattttacagcaattttactaaaaaaatatgtaatattagcgatgaaaattttttaagaaaatttgaaaaatatgtaaaagaatccacgaaatatgtatgaaatatgtacaaaatgccagaaaaaatctgaaggcaagacagtatttcgtgcatgccattttgaattttgggtacttttccgttttgcgcctacaccataaaattttaaaaatttatgcgaccgaattttgtcgaaaattaaatttggggtttttgtttgagccgcatattcgtgatctgcgcattttttaaccccaaattcacaaaaaatcaattacttgattaaaaaatcaagataaaatcaatgattttgaaaaacccaagctcatttttctagcctagaaaatatgcttaaatttttaaatttatttttcaaaaaaaacacaaaactttaccattgccatttccaaatggtcttttatgtcaggaggggtcggtttagtctgaggtgacgttttagtcagggggtcgttttagtctggcaagctgattttgtgccatatggattctaatctgattttttttcaaaaaatgtttaatttaatactagaacatatttatcaatgtatttccaataaaaaaaaacattgaaaaatcattacgggcacatttcataaattcgagataatgtaccaacgagaaaatcgctgatgatatcgggattaacattgacagtggcatgcccgtaagagttgaagaattctcgcatcggcgatatcaccacctcgaagtccaacgaaaagtttcaggcgaaaaattcggtcatctttgacaatcagttgaggcatacgtgttcaacgcttcacacttgaagtgagaaggcagtacgtaataaaaaatccaattaattcgccttaaaaaccaaaaaaaatatgaaagaaattaggcttttactttgcgaggacataaatttacctgaaaaaggtggcgccgactgaaagtgccgtctgcgtacacatttttcataatacaggtccattgtaagtcgaagatcgagcaaacaccaagccttaatacagaatttagtggaattttaggattttcattttttcacctttgtggacagcg

SEQ ID NO: 25875 - DNA, 1484 bp, Heterodera glycines
ccttattttccataagtataaaagcaccaggaatgctgccttttagaaccaaagagctaaatgtgtacagctgtcgaagatcctttggagagacttaaaaaaacaaacaattcaaaaaaagcagcataaaaacttttaaacgttccatcgcatgcccaattccgatatgtacgtagtcgctgaattccagcatccgaacagaaaatgaagaaaaccggattttcgggttcagcagtgcgagagtcgaccaatagaaatcgattgccatgatgatcagttgcaaaatagtcgtgaaattcgagctcagctaaatttcggtcaaccaactcttgtccaggaattagacggtgtctttccattgtccgttgtagtgaccgagacttgggcaacaacacacgtgcatcatcactaagagtctctcggtgctctgcaattgaagatgatcaccgataggaatgcagaagggcgacaaggataggtacaaaaatggacaagattattcttcatgccgatctttttttaactcttgctatagatattccaaatatgtaattaatatacttagttttattatattcttttttatttatcatagcaaatcttagaaatttttattttgtgattacattgtgtaatcgattgaattgtataaattaaaatataatcttcaatattttgatttttatattttccggaatttatttatttattattgttacacaaaaatatctcttttattaaaaagcgatctctaacaatgttaaagagacttttaaataattatgaaaaattacgaaacaaaagttaaaagaatttaaaagaagaaattcacaatttcgaaccaaaagtcaaaaattcattttcaaaaaaattcacatttcctgcaaaaatcgttttagggtggttttcagggtggaaaatacaattatggtatctattttggttctcttcgagccaggaacctgatttcgacaaaagtaggaaatcccagtttttcagatttcaaatttttgttcaaatttggtctgcacttttgttgaaaaatgaatttgtacttttttcaaatattgttcgaatctgtgtcagggttcgaatatggacaaaatagatagcagaaccggttttccgaccctaaaatccccctaaaaagcgtttttgtgcaatacatgtgaattttagtgaaaaatgaattttcgacttttggttagaaatcgggtccgcaattcgaattgggctaaaatcaatgtcagaatcggtttccccgaccctgaaaacccccaaaataagtttatccccaaaaaattgtttttttttatgaaatctaagtacagttaataaaaatggacttattcaaacactttttatttcatttaaaaaaactcattaattttttaagtatctttaaagttaaaaaactatattttttatttaatatttttttttaatatatatttatttaaaaaaaattgaacttttttcaaggg

SEQ ID NO: 25876 - DNA, 1706 bp, Heterodera glycines
  misc_feature (1615)..(1615): n is a, c, g, or t
  misc_feature (1639)..(1639): n is a, c, g, or t
attttttttaattaaaatgaacatttttaaattaattttttattaattataaaatcattaaaataaaaatttaatcatttttttcggtaaagtaatagagtttttcccgggatcccgatcccggcttttaagaaaaaagggacaggatcggggtcccgacaaaatcgggatttgaatcccggtaatcctatcccggcctgatgccaatccgggatcctgatcccgactttctcaaagttccgggctcagtaaggaatataaatttcagaaaaaaaagtttttttttttactatccagaaatggttaaataatttctttctttataataataatctttttatttccgctttcttttttttgttaattcaacttttaagattaagctctcaagtttgaattcgtgccctttggcttcaattactacaatataaaacatttaaggaaagtgcgcaaggattagttgatttatgaatttggcgtcgtctgtcttttaaaagcgtgctgaaaaaatgaaataaaaatataaaaattttaatttaataattagggtggggatttttcagtttttttaagggtggggattttttggttttttaactattttttctgcggctttgtttcgctgagaaatgcgagaaaacttattgtcagcctggaaattctcattttaacgcaattagaagttaatttcgagaacatttcaaaaattgacccctactaaatcaggaatttgaatttttaattgttttctattgcaaaaattctatttttttttgaaaaaaaggaaaaatcgctttaaaatagagctgccatctgtccttatttcgaagatttgtccttatttggacgggttgggtcttagaatgctctaattccatccaacaaaaatttaggacagaataccgaatgtgatgtgtttgttggctcggacggcaaaggggggcaatttggcaagggcaaaatgggagagagtgcgggaggaattaaaataaaagaagtttatttaataaatataatataaagatgtgagtaagatgtgagaaaacgcggatgcttatatggagagagaaagcgtaggtggagcaattttagcagagcgacaaacaacaaaaaagagtgactaatactaagcacagaaatcacatattaaatacggaaatatcacagaaatataaaattaatcacaattattcaaaattatccaaattaacaattaaatttctcttcctcaatttccttccatttctctctctctctctttttccctcatttcttccttttctccactttcttagtcgctttggcgacagcccttgggctgagacaccccttgtacatgtatgaatggcacacaattaatcggaaacagtcctaattggttctaattaagcacacccttctgccggaccaagccctcgaattggccaaggccgcttctcaagtgacgacagcgaacgcaaatcgcaatcagcgaacggcacaacaacagctgcaagcgcccactcaaaatggtggggacacttcctcctcttccacgtcttccgttgtcagtgagcgaaggacatcacaaatggcttatttcgaatttcccgaggtaaataattcatttatttanaatccagaaacaatttgagattanatgatcccctttcaggctgattttgacagtttggaagcactcgtttgagtttgcgtacaccgcccga

SEQ ID NO: 25877 - DNA, 755 bp, Heterodera glycines
ccccccacctcacctcttttacacccccccccccctcgatgcgaaatggtcagacattttgtgccctttgcgggtgaatgcgatactggtttggggcgaatgaatttctcacaaaaacagccaaattgcagaaccccggttttttgaaaatggaaaattccggaattttttttggcctcaagaacaatgcccgctgtttttgggcactgctgactgaccacaatggcgtagtcggctccgtcaatttcggcatgtgccatggtcagcagttgttggcccggcatgcgcgggtcgaccagcgtgtggcgtcgactgctggtcaccagcaccgtctccagcccaatgtccacggtttgcacgcggcacaactgatcacgggccaccagcgaggcacggaactcatcggagaaggggccatcttcaccaacggcatcgctaacaaattgtttgaattttattttttctaaaaaaaatttttacactaaaatttcttgaaatgatttttaaaaaagtaaaaattttcagtaaattttttttaattttaagcaattttcttaacaaaattgcataaaaaactcaaaaaattttcccggtggcgcctatcggaaccgccggacccgggagcaggacataacgtcgccgcaaaatttttttaaaaaaaattatcaacatttttttagttacctagcctggttcggaaaaattctagaaaaattcaaaaaaatttttttttattaagaaattcaagggaaaaa

SEQ ID NO: 25878 - DNA, 1350 bp, Heterodera glycines
  misc_feature (1268)..(1269): n is a, c, g, or t
  misc_feature (1310)..(1311): n is a, c, g, or t
  misc_feature (1337)..(1337): n is a, c, g, or t
tattattctctgaataagagaatttaattttttaaccttttttataatctcttttcgaagtttaacagagggcggacttttgggtttttaattgtctgatactcacattatccatcattttagacaagtaatttaaaacgatgaaaattaattatgcatacggcaatttgttaattattttatttctgttcctcaatcattttatattgagttgcaactgcagaggtttaaacaatgaaaataatttaatgaattaatatattattaatagcgatcgatgtcttaacaaaggagcgcaaatctaacggaagaagccaaaagaaaggaaaaagccaaatcggtaaagcaaattttaggataaaactatttaaatttttgttttttttctagagcaagttaaaattttaaatcttttttagcgaaataaaaaaaaatttttcagaaaaaataaatttatataatttaattttatttttaaataaagttaaaattagatatacggaatattttcagaaagtaaaattttcagacggaacaaaaatgaaaacgcaaaatgaggaaatgagaagcgatgaagccgagagacagacgaaggagagagagcaggtgaagaaactgttggacgaatataagcgaaaggtgaacaaagaaatggaaaagaatgtcaagaaaatggagaaggacgaaaagctaaaggaagtgctgagggaaatcgaagaagcgaaagcgaaacacccgggggagaagagaaaagcggcgaaatccatcacagagataaatgagaagcattgggacgaattgtaccagggggacattgtactgagtgtggaacaggcacagtatttgctggatactgtaacaaaaaatgagcaggaaaagtcaaatagttcaccagcgggaaacggagcggagaaaaggaaaaagcgcggaacggacgaaaatggcaaaaaagaaacatttcctattttgaaatggccacttctcaccatcccattctcattccacagcataatccgtaattgaaaataaataggcaattaaatggaagcccaaaaatgttaaagcattttagccgacaaattgaggcaggaaatacattttgcaattcaattgtggaaccgcaacacctgcttgagcatggttgaacatcgtccttcatcgccgggcatccaatttataaatatttcgggcaaagggtgcaagtcatgggttgggaaggaagtcaggggcaacccatcagcagttgatttacctggaataatcccggnntgtatcaggtaatggataactaatgtcatttttacttattnnaccagtcgggcataattgcacacganattggcatgcctt

SEQ ID NO: 25879 - DNA, 773 bp, Heterodera glycines
ggctgccaactgaaaattttcaaaatcagcatttggggtcaaaaatcattaatttgtaaaattctattccaaatttaaaaaatcaaaaaaagcttttttgaggcgcttttccataaactttatgggaagagggggctggcgggcaccggtaggcgccgccggagaaaaattaatttgcgaaagcgaaacgcgaaagaccatccctgccgcccccccccccccctgccccctgggaccgtccctgttttaatcgttattcatagaagatgcgtcaaccaacggtaattacacattggtacccaaagcgggggctcattatataaacacaattggacaaagatttggtcccagttttggcgatttcttgcagatgaacaagtattactgcggtctgcaactgcttccggatgggtcgagcataaacacgggcaagcacttggaatatttttggttcaaaccttttcgctacaattcactggagtttttgggtccctgatcccaaatttgacatcaatttttgaccaattcctagtccctaacctgaactggaacaaaagtcgtaactcgaaaaatgaaaattttcgttagagtccgggttagggataggatgtcagattcatgatcagggaccaaaaaaacacggggaaaaatttgatgactagaatttaaaaaatgtaagccaaaaggtttttaataaagggtgccggatccaggcccgtatccagaaagaaatttcggggagggcacccgaagagcttttttttgctcttcgg

SEQ ID NO: 25880 - DNA, 907 bp, Heterodera glycines
  misc_feature (49)..(50): n is a, c, g, or t
  misc_feature (58)..(59): n is a, c, g, or t
  misc_feature (63)..(65): n is a, c, g, or t
  misc_feature (67)..(70): n is a, c, g, or t
  misc_feature (72)..(73): n is a, c, g, or t
  misc_feature (88)..(88): n is a, c, g, or t
  misc_feature (90)..(90): n is a, c, g, or t
  misc_feature (92)..(93): n is a, c, g, or t
  misc_feature (96)..(99): n is a, c, g, or t
  misc_feature (101)..(101): n is a, c, g, or t
  misc_feature (103)..(103): n is a, c, g, or t
  misc_feature (107)..(108): n is a, c, g, or t
  misc_feature (113)..(116): n is a, c, g, or t
  misc_feature (120)..(121): n is a, c, g, or t
  misc_feature (132)..(132): n is a, c, g, or t
  misc_feature (140)..(140): n is a, c, g, or t
  misc_feature (156)..(156): n is a, c, g, or t
  misc_feature (182)..(182): n is a, c, g, or t
  misc_feature (186)..(190): n is a, c, g, or t
  misc_feature (206)..(206): n is a, c, g, or t
  misc_feature (223)..(225): n is a, c, g, or t
  misc_feature (227)..(227): n is a, c, g, or t
  misc_feature (229)..(229): n is a, c, g, or t
  misc_feature (238)..(238): n is a, c, g, or t
  misc_feature (241)..(242): n is a, c, g, or t
  misc_feature (250)..(251): n is a, c, g, or t
  misc_feature (253)..(253): n is a, c, g, or t
  misc_feature (255)..(258): n is a, c, g, or t
  misc_feature (261)..(262): n is a, c, g, or t
  misc_feature (267)..(267): n is a, c, g, or t
  misc_feature (272)..(275): n is a, c, g, or t
  misc_feature (277)..(278): n is a, c, g, or t
  misc_feature (280)..(281): n is a, c, g, or t
  misc_feature (285)..(289): n is a, c, g, or t
  misc_feature (292)..(292): n is a, c, g, or t
  misc_feature (294)..(294): n is a, c, g, or t
  misc_feature (296)..(296): n is a, c, g, or t
  misc_feature (298)..(302): n is a, c, g, or t
  misc_feature (304)..(304): n is a, c, g, or t
  misc_feature (311)..(311): n is a, c, g, or t
  misc_feature (313)..(316): n is a, c, g, or t
  misc_feature (323)..(324): n is a, c, g, or t
  misc_feature (326)..(327): n is a, c, g, or t
  misc_feature (334)..(338): n is a, c, g, or t
  misc_feature (341)..(341): n is a, c, g, or t
  misc_feature (344)..(347): n is a, c, g, or t
  misc_feature (349)..(352): n is a, c, g, or t
  misc_feature (354)..(355): n is a, c, g, or t
  misc_feature (357)..(358): n is a, c, g, or t
  misc_feature (362)..(362): n is a, c, g, or t
  misc_feature (380)..(383): n is a, c, g, or t
  misc_feature (389)..(389): n is a, c, g, or t
  misc_feature (395)..(397): n is a, c, g, or t
  misc_feature (401)..(401): n is a, c, g, or t
  misc_feature (408)..(408): n is a, c, g, or t
  misc_feature (412)..(412): n is a, c, g, or t
  misc_feature (417)..(418): n is a, c, g, or t
  misc_feature (420)..(421): n is a, c, g, or t
catcagttttggattagactgacaatttcgagtcctcttttcagggaannagaagggnnaaannngnnnngnngacctttaagacgcngngnngannnnananaaannggcannnncagnnggcgggggcancaaaaaancgggcaaaaaaggagncgggggagaaaaacgccggagggaangaannnnnggacgcaaaaagggcncagaacaaaaagagaannnanangaacggagnganngcgacggnncngnnnnganncccanccaannnngnngnnccannnnngcngngnannnnnangacgganannnncgccaannanncggcacnnnnncgncannnngnnnngnngnngggncagaaccagggagggcannnnaaaaanaaaacnnnaaancaaaaanaaanaaaanncnnggccattggccgagaaattcccggttggactcttgacgaagacatttcgagcgtggcggtggtaaaggatgagtcgagagttgtgagcccaatagcctcgcttccgcctcaagtttattttcccgactgtaacagctatgcactcattaaatgtgcaatttttaaataagaaattgccgaagggcgtgttaattccgcccttcaaaaaaaacccaaacaaattccattattataagttgccaagtttttaaatccactggcaaaaatactccaatctgttgttgggtctctgtttaaatcctagctattaaaattttttttttgccaaaagcggtgcttctccgtttttgtcggtgccgctggcggtggttgcgcgcacaatttaaccgagcagcggcgtgtgccaaggaatcggcacaacacaaaattgtccctttgtggcccaaatggtgccgacaacgtttttctgtgtttgcggtgtccccc

SEQ ID NO: 25881 - DNA, 1580 bp, Heterodera glycines
  misc_feature (1550)..(1550): n is a, c, g, or t
ccgacgattcagtgccgacgattcagtgccgacgattcagtgccgacgattcagtgtacgttgaaaagccgacaattcagcgccagaaaatttggcaaaaaattttcaaaaaaacaaagtgaaaattttattaattgtaaaacataaataacaaatcatgggttcatctcataattgtgggatattccctgaagaaattcaatcacataattaaaatttgggccgggatttgcaaagtattggggatcgtaatgaatgggcactaacggattttggactcccatttcttgggcgtatcgttcaacaagagtaagaattcggcgatcggcgtctctgtactgcttccgcttctttgaaggttgttcgcctataaagtcagctttaaaaattttgatttatttttgaattacctatcgaaaattttgcaaaatcggcgtcgataattttctgacactttcggagtctgtcgataaatgtccaaattgacggatggtcacagccaaatgcgcgttgaagtgatcggtgtgcggcttctgcgtaattattcgtcctgtctcgtttttggatggttcgcagatgaacactccagatcaccggatcaaacagtgcagggtttcgagttccgtcaaaacgcggtcggccagtgtaattgttgatgaacctgtatttaacatttaagcaactttcaaaattgaatttttaccagtcaaaaactggctgaagttcgagaggaagttctctttcaagtgccatgattccaagcgtcaaatgttcaattggtaaaaaagccaatgatgtaatcattttggcatacatttgaaagaccgggtcagaattgtagcgctaaattggaatggaaattaaaagtgacacagcgttgaaggaaaaacctcaacaaggtgttcagtagcaagacgctttttgaaattacggacaagatgaaaaaagcatcctgacagttcacaatccgaaaacacttcttttacagcaccgatgattcctgcttcaaagtcaaccgaaattgagtcaggacgaaaattaggccagaaagacacaaccatccgaaaaaagcgggcataggtctcctttgtttttgtagtaagtagcccgtacaaaactgggaaaacccattgttcacgcctaaaatcattaaaaaataattgtttataaattaaaatgtacctcgcaagaactgcgaacacctgataaaaaagcggtggtgcgattgtaaaagtgccatcaacgtacacagttcgcatttgctgtgcccaactgccattcgactattttccgaaaattagaattctaaatttttaaattataaacggataatgggttttgtttccttaccgttcagttgtctgtcgtcctgcttctctgtaaatccctgaatcagcgagcaaaaagttcctcccgctcatcacttcttttgtagcgcgtgtagtcgtcacgaatctgtaaagcggcaacattgtctggaatgaccggttggagcgttttccttgtgccggacacgcttcacaacctaaaacattgattgaaaatgacanaaattcagtagagtttataccaagcgcata

SEQ ID NO: 25882 - DNA, 1216 bp, Heterodera glycines
agtcagagtctcccaatcgccaatcatttactatacatcattttgtctattcactcggcaattagtcttaatgtgtctttccgcaggctgttttcttcacctccactttgctgaccaccatcggatatggcaatttggtgccggtgacttcggccgggcggatgttctgcattttctacgccctcttcggtgttccgctgattctgatcactgtctgtctgtttctgtccaattttacgcattttactcttttttaggtcgccgatattggaaaggttaattgatttaaaacgtaatttgaaattgaattactttttgtttaaaaagctcaatcttttctctctgtggtaaagtgtttcgagattggttttcggaatttcgagctacaaaatgttgggcatttgttcaacttcttaaattcagtttttctccactttaatcgtccttctgtacacacattacacacgcgcaaagcttcgcctgcggcaacggctgattggccacggcggcggcgcagacgccgcggggcattcgtcgacactaatgaaggcgcacctccacgaagtgattagtcataaaagcaattaatgacccctctcccctcaatttagttgggtctctacaacatttccatccccgtcactttggtcgctgccattctactgggctatatgagcatagggtaataagcaaaattgctttttatttttataattttcgattaatcggggttttaaaaaataagaggggaggtaattagctcgagaattaatgtgtcgagaagcgaaacgcacccttaagctaaacattgttttgattttcaataatttgatctgtttttcttttaaagtgccgtccttttggccaagtgggaacgatggcctttgtaagtgaccacttttctgtcgattattaaaaacgggttaagccaattaaaattcgacgtcccaaaaaaggttcgacggcttttactactcattcattacgatgacaaccgtcggatttggcgacattgtgccggccaaacacgagttctttttgttcgatttattctacataatcgttggttggtaaatgaacggtggcacattttggcaaaagtggcgccgcttttcctttccaggggtggccatcaacacaatgtgcatcgacttagttgacattgaatacatcgaaaaggtgaccactccgttttttgctaatagccccaatttgg

SEQ ID NO: 25883 - DNA, 2091 bp, Heterodera glycines
ctctagagtcctattgagcatgtggtattatacatcgagtagatgtttctttcacatatgcaaatatgcgtatcattgtgaaagtccataaaaaatggtatcctatgctatgctacttatctgtggcaattggaaaatgaccattttatacgcaattatttttttcaaagcctgatgggacaacacttatgaccatgactggatttccgaagtccaataggacccaacctatttcctatttcggaactaattcagattgcgacatcttttggctctactgttctttatgagtccaatcaatagtttttgagtccgattactcagcttaggatattttttcattccacaataacatgaataaataaaaaagttcactttgatttgcgcaagcgactataagacattgtgcttgttctttagataaaagtgaaggtggcgatctcacgttaagttaagaaatgttttaaaaattggaactgacaacacaataaagtcgtttgtttacactaagcgattaaaatacgaagagtttcttgcttatttaaagcatgtttcttttgaaaaaagttacatttaaataaaaatgctttttttcttcattttcctggtcgcaccaattaccgtaatctctcccaataattaccaatcacctgaaacgcttaatggaagttgcatcgcttattttgactaccgtaattcgaaaaaccaaaaaataactgtattaccatcaacatcaatcgagaatgacgcagaatatgcagattgttacgtttcttgttcttcgttttctcccactgtcgctttcaataaaacttgtaatccagcgccaattggaaatcctgcttgttggattgtgtacaacagaagtcgaattgacatgggaggagggtgtccatcattgttttctggatcaaggggaatctcgaacaattcaacaaacgttggaactttaagtggtacaactttgtttctgaaaaacgaaagcattgacatgatcagaagtgaaattgatcattattgtgactacttgcttgttttacgaacggcttgaaaatcaattctcgtcgactttatcatggatgatttggtgaaattaatcagaaagtgtaattaggcattaaaaatttagttaaaagcaattaccgattaccgtcctgccaaactttgttcggtttacttcaaactttgtttaccagaccaggatcattttcttcatcgactaaatgatcagcagattcgccatgaacatgaacaccgtcatcgccatcatcatcagcatcgtgagcagcatcattgtaaacagtgttgtgccaaagagaaacaaaattttcaaaactttactgcgccgcgatcaaggatcagcattttggtcgaaaatgatggagctgtcatgcctgcgggttcgcttgctgtgatggatgaaatgagttatgatacattggttagccaatttcttggcaccgatgatcatgaaggtgtgattttccactttttggaaatcttttataattataggaatggaaaaaacaatgaaatttctcgcaagatatgaattgattgctaacatgcttctctgtcctgaatgccaggagaaacaagcatcattggtcaaatataaacagtttcctgaaggttatacggtaatttaaatttaacgttaaatgaatttaataaaaaaatttagtggcgctgtaataaatgccgcagggatgaccatgagagtgaagctgccagccgattttctgtccgttttgggtccttcttttcttcatctcacctttctttccacaaaattatgcgaattggctatttctgggttagtcaccctagtagtcacctagaaactgtcatgcgtgaaactatcattcgttcaatgcatacgatcatagattttaatagctcttatagagatctttgccaagtgtgggcagaaaggcagcaagcagaagggcggctgggtggccaagaccttgtagtggaaatcgatgaaagccatttttttagagagaaatataacaggggaagaatgataaatagagcctgcgattaggtgtgtggtctattagaaaggggcgctaccaaagttagatt

SEQ ID NO: 25884 - DNA, 1165 bp, Heterodera glycines
caaatgttccttttcgctagaatcaattcactcggtgggcggggagaccataaaatgtaaatgctttttcagagagtctcattgattcctatgcgagttattctgctgacaaaaaatcggcttttccactcatttgtacaattcgaatgtcgcggagggggggggcttctttcaaccctcgggtaaaaatttgcatttcccttgataaatgagtgtcctttcgcatttctaagtttgattggatttgcgttggcgcagaatcgggctcaattttcgatgaaattgctctcaacgaattgccaagtttttagcgcattttttaagcccttttttgattaggaatgggccgattacgatgagaagaattcttccgctcgttgagattaatggcatttcatttcgatttgttagagtttaattttaaaatatgaaaaactttcattaacagaatgtgaatatttattgcccaaagatacagtatgcatatgaaaagggacggtattcgactgagagaactaataaatgtgttagttgcaagagattcctttgcatcgaacactaaaacggatactcaattgcggcctggctagaaacgactcaccgattattctggcaactgagaaataatctaaatgaactactacacgtgaggcgacagagcgatgatcgcctgatcaagttaagcaaaaaatattgaaaggaaacgaggagccgtttgagcagcccaatggccaaaaagatgaagagacaattttggttatcgttaccgataaaaaaggggaagtatttccatctaaccaatatgagattgaagataattatccatcgtcatcatcatcatcatcatttattgcccaaaacgaaccatcggtaacgaccaaaggtggagaaggattgttaacggtccaaattaaaaaaaaccaatgacaggggataatgagcaaaaaaaatacaaatggtaccatcagattttccttcatataatgacgatgatagcagagatactattatcaatgaattgtcagaagaacagcttgcttctactgttcccgaagaagatatgccgaaatcggagccttatgatgtagatgagctcccagatctgcctgatcctcaagcgctttctgccaaggggagaggaggtgataaaaaaggagtaacttct

SEQ ID NO: 25885 - DNA, 1072 bp, Heterodera glycines
gagaggaggagcagcacaactttttttggcggcggggtgggggggtggcgggaataggggatgctctctctttctctcccctccctcctccactctctcgctcaatcgccgtgttccgctgctgcccttgctgcaacgattgcgcatcgttggggggagagcggacgggggacaagtttgaagcctttagccacagggcgagtcgcgcagcaaaaaaaaaggggggggaagagagtcaacgccaccacaacaaccaacaaccccccgccgggcggcgaccaaaatggtaggagaggagggaaagtgtccgccgcgccgactgatgcgcaacggtggcgagaggggggcgggggggggaacatatggctgttgctcgggatggcgaataaaaatgtatcggaaggtgggtgattaagcagccctatggcgcattgggagctgcacagttgagaaatggagagaaagcatcaaaaagtgggggaaaagcattgccccagggcacttgggctttttgggcaaggcaaaatgctaatgtcacttacaacagcagcagcaaaggtgaagcaaaaatagggagaaagggatggtaatgaaaaacaatcacttttgatcagaaatgctgatcaataatcgttgaacgcaaaacaaaactgatcagaaaggaagaaaagacgatcaggaattgtgatttgtgggcgaggaggagaagttaattgatcagacgatggtcaaaggacgcgaaaagatcaaaggtagggggcgaaaagaggtataaaaatggaattgatgtaattaaaatcaaagtgatcagaggaacacaatgtgcagcagcagcagattgtttggagatgggtaaaatcagtcaggcgattgtatgtgtaattattatttggtcatggagatcagaaaaacgagggcatcaccgcgagggaggaaatagcaatgtgatcaagtgcgatagtatggaggaaatagacaccggaagacggtgatttgagtttgtaatttgatcggaaggcctcagctctgagagtgtgcctgatcagttcatttatgataaaagtgatgaatg

SEQ ID NO: 25886 - DNA, 1242 bp, Heterodera glycines
  misc_feature (1112)..(1112): n is a, c, g, or t
  misc_feature (1188)..(1188): n is a, c, g, or t
  misc_feature (1214)..(1214): n is a, c, g, or t
aaaaattccacagtttcgcgcacggtgccgaagaatgccatgtgctggttgttgttgtgctggtgacgttgctggtcgggctgtcgacttttcgacttttccacaacttgtttcggttgttgttgttgttgttgttgttgttgttggtggttgcgcgaggagttcagattggaagtagtcacaacaatttgtcctaatgccgttgctgttgtgtcgtcgtcgtgccgttcttcgtcattcgccgtccgggactgctgtggcagtgcacagttgggcagcgatgtgctggccttaaaaaactcgaagattgctttcagttaatgtgaccaacaatgatcagaatcaccgagaatgatcaggatttattgattttgatatcagaaagagtgagcgggcttttttcccggatggtttcgtatttttttaaattttttcagagcgagcctctgttggttttagttgaaatgtccacattattcgggattaattgcaattctcatatcaatttcatgatcattatttgatcagccttttgtttacccgcaatcgccgatcacttttcgtctcccttttccgcgactgcctaatcggttgttgataatgtttttgttgatgtgcagcacataaccacgggttggtggtgctgataaatggtcctacaataagggtttattagggatttaaataatttcgaagtgctggcattatgtcacaagggataaaaaaaatgttccgttgttcacacacaaaaagaaaacaaacaaaaattctaccagtttaaagtataaaagaaaattcttatagttttattgtaacaaattatccatgaaattttggctcaattacactttatgaagccaatagaacctggaattttgaaaaaaaacggaatcggatttggaattggaattaggccaggaaaggattagcgggattgaaatcccggttttgtagaattttaagctcgaccccatggtttaaatcccattttccccccggattccccgatgggcggcggcacttgcagccggaatcgggatcccgggaaaaccaggcgggatctttgaagaagttttgaataaataaattctcagcgctcagaaatttctaanttttttttttattaaacagttgtttttggactcataaattgcaaaaaattcaaaagcaaaatttaaaaatgccgantccgattgatctcaactgctggcatncatgggtcgtaacagtttttatctaatc

SEQ ID NO: 25887 - DNA, 838 bp, Heterodera glycines
aggaagcgccaaaatcggcattgaatttttgggaagcgaatttagcggaattaagttttctattaatattactgattaaaatttgataatttaataaaaatttaagaaaaatgtttattttgagtcaattcccaactcataaaaagcaaaattggttaattacaatagaaagcatttttttttgctaattattacaactttaatcatccattttataataacattgctactgaattttaactttttctggataagaaacctaactttttctcagatcattttcagatttataattctcccttcagaaaagggcagaaggaattggaacagaaaacttcgagtggatataatggtggcattgtgcccgtccgctatatcggcctcggccaatgatcgctactacacaaaatacctggcgacgtttcttctcgttttcagccaggcatccattggttctttttcagtcttctcgcgccttatttgagggtcctcttctgacagtgcttaaatgttgaatttcgtcagctgactccttacgcaagcgcctggcggatacctttgtcgtatcgaaaaatgtcacagtgcaattgcgattggggatgatcattcatgacagaaataagctcatcaacgagcatgaggaaaaaagacaataccattgtcgtcactaaaacaagaccccccaacctcgttcagcgcgaagaccagcagaaagccctcacccgtgcgcatgtactgatcccgcatcgctgaatatggggggtgcaaaaggatggaaataaatttaaaaagccaagaagggaaaaagaatttttttttttggtcgcgtctttacgca

SEQ ID NO: 25888 - DNA, 826 bp, Heterodera glycines
gaagcgccatttgcttaaatcaagtgccattctgtgagatgaagtgccattcaatgaaataaagtgccattcgatgaaatgaagtgccatttgctgcaatgaagtaccattcgatgaagatgaagtgccattcgctgaaatattgtgccattcactgaagatgaagtgccattcgctgaaatgttgtgccatttgatgaaataaagtgccattcgctgaaatgttgtcccattggatgaaatgaagtgccattcactgaagatgaggtgccatgatctaaaatgttgtgccattcgctgaaatgttgtgccattccatggaatgaagtgctattcactgaactggagtgccattcgatgaatgaagtgccattcgcttaaatgttgtgccattcgatgaagatgaagtgccattcgctgtaatgttgtgccatttgatgaaataaagtgccattcgctgaaatgttgtgccattagatgaaatgaagtgccattcactgaagatgaggtgccatgatctgaaatgttgtgccattcgctgaaatgaagtgccattcgattaatgaagtgccattcgcttaaatgttgtgccatttgatgaaataaagtgccattcgctgaaatgttgtgccattagatgaaatgaagtgccattcactgaagatgaggtgccatgatctgaaatgttgtgccattcgctgaaatattgtgccattggatgaaataaagtgccattaactgaagatgaagtgccattcgctgaaatgctgtgccattccatggaatgaagtgctattcgctgaactggagtgccattcgatgaatga

SEQ ID NO: 25889 - DNA, 829 bp, Heterodera glycines
gtgccattcgctgaaatgttgtgccattccatggaatgaagtgctattcgctgaactggagtgccattcgatgaatgaagtgttaaatgttgtgccattcgaggaagatgaagtgccattcgctgtaatgttgtgccatttgatgaaataaagtgccattcgctgaaatgttgtgccattggataaaatgaagtgccattcactgaagataaggtgacatgatctgaaatgttgtgccattcgctgaaatgaagtgccattcactgaactggagtgccattctatggaatgaagtgtcattcgctgaagatcaagtgccattcgctgaaatattgtgccattggatgaaataaagtgccattaactgaagatgaagtgccattcgctgaaatattgtgccattccatggaatgaagtgctattcgctgaactggagtgccattcgatgaatgaagtgccattcgatgaagatgaagtgcaattcgatgaagatgaagtaccattcgctgaaataaagtgccattcgctgaaatgttgtgccattggatgaaatgaagtgccattcactgaagatgaggtgccatgatctgaaatgttgtgccattcgctgaagataaggtgccatgatctgaaatgttgtgccattcgctgaaatgaagtgccattcactgaactggagtgccattctatggaatgaagtgtcattcgctgaagatcaagtgccattcgctgaaatattgtgccattggatgaaataaagtgccattaactgaagatgaagtgccattcgatgaaatggtgtgccattccatggaatgaagtgctattc

SEQ ID NO: 25890 - DNA, 1942 bp, Heterodera glycines
  misc_feature (18)..(18): n is a, c, g, or t
  misc_feature (1786)..(1786): n is a, c, g, or t
  misc_feature (1854)..(1854): n is a, c, g, or t
  misc_feature (1863)..(1863): n is a, c, g, or t
ggttgagtcccgtgattnggaatgttgtgggttgagtcccagtgattgaatgtttggtggattgagtcccagtgattgaaatgctggagggttgagtcacagtgattgaatgctggtgggttgagtcccagtgattgaaatgctggtggattgagttccagtgattgtaatgttggtggattgtgtcccgttgattggaatgttggtgggttgagtcccagtgattggaatgttggtggattgtgtcccgttgattggaatgttggagggttgagtccctggagggttaagtgttggcgattgaaatgttggtgggttgagtcccagagattggaatgctggtgggttgagtttcagtgattggaatgtcattgaaagttggtgggttgagtcccagtgattggaaagcctaagaattgagttccagtgattggaatgtcacagaattgagtcccggtgattgcgatgccgaagtaccaggtgaggttaggtcccagtgattggaatgccggagatttgagtcccagtgactggaatgctggtggattgagttccagtgattgaaatgctggagggttgagtcccagtgattcaaatgcaagagaattgagccccggtgattgaagtgctggtgggttgagtcccagtgattgaaatgccggagatttgaatcccagtgattgaaatgcaggagaattgagtcccagtgattcaaatgcaagagaattgagccccggtgattgaagtgctggtgggttgagtcccagtgattgaaatgccggagatttgaatcccagtgattgaaatgctggtgggttgagtcccagtgattgaaatgcaggagatttgagtactagtgattgaaatctggtgggttgtgtcccgacgattggagaaaaagcaaaaaaaggatgcgaggccacgaagcggccgagccagtcgattttatcaaacataatcttacaatacaatcgtactacctagcgggggatgcgccgaaggcgctgaccccgctaatattcagcaaaagaacggagtaaaattgaaggaaaaatagcaaaaaaattgggcacaaatcgcaattatatttatgaatggatcaaagaattgggagtaaatcaaaaaataaatcattcaaaattaaaaactgacgaacaaaaatttgaaattattcgaaaattcattgaaatgtcaaatgaatttaaacaaaaaggaataaaatattccagaaaagaatggcaacaaaattatgaagaaatttgtaagaaaatcggagttagccttaaaacaattagtaaatggaagaagcaatttggaattagccgaaaatttataacggaaaaagaaaaaatggagaaaatgaaaatgtattggcaaataaaaggagaaaagccgaaaatgagtgaaaaggaaattggaaaaatattgaaaattcatcaaaatagcattttcaattggaagaaacaatttgggaaagaatatgtaatgcgaaattaaatggatgagaaactaagaaaattggaacaattttgccaaaaatgaccgaagattaaataaataaattaaattatttttatggaactataagtatttcaaaaatttcaccaattaatgtttaataaacattacagttttgtcatataattattatattaggggttcctttttttgggcaaatgcctaaattttctgcgcaattaatacgcactgagaagcacgaaaaacgctttttcagcttggtttggaggtgtctacgatgacttttctaatgcctatttttgcttanaaatttataaatttattttttttttttcttacaagaatttttgttttgaaaatttgtccttattctanataatttanaacatttaataatttcatttacaaatgaaatattatcaaaaaaaataaggaaagttttatgtgttttgctacctaaaaa

SEQ ID NO: 25891 - DNA, 1337 bp, Heterodera glycines
tcaattaacgggtggataccattttttgggaaatggagaatattcggtttcggggcagggtctttttgtcattgaatatttaaggcgaatgaatattttaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgacaaacaacattgtaagccgttgccaaaactgaaagcgccctctcaaacacaagattataatcgttgtaaatttgcattctacagtacactctgtatacaacaacaattaattaggaaaagtaattttgtcaatgagataaattttggcaatgttaaaatgcccgctcatttgcaccaattcttgttttcttcattaataaaagttaatttttaataattaattataaaacattgctgttttattttgttccaacgcaatcattttgttacattagcaattcataagaccatccgagggtactcatggagtttgtatccccctttttttgggtcgaattttttcaaatttttttttcttttttattgtcgcaattgcttttagattaatggaaacacttaaaaattttaaacttgatgctttattcaaagttttggctctaccagacaaagaattcgaagaatggctcagagaacttaagcttctacacaccactcgtttttgtgactgtggcaacgaaatgagctacaaatggattaaggaccggaatcaaccgctttggatatgcaattcaaagaagaaccacgacggaaaacgtccaactattggcttttacactggcactttttttgaaggagcccatttgtcgcctaaattttcaagtttttttaaaaggccaaatttacatgaatcaattttatattaaggtttttcaattttcttactactgggcccacaaatttggaaatgatcaaattatgtttcaggatcctgtcactggtcagcatacaaactcaattgaatcgacgtggcagaagttcaagcagcaacacaaagcgagatttggcagtcacagatcacttttttccacatacatttctgattttttgtggcgtaagcaatttggaggaccggacattttttataatttgtggacccaaatcgcggaattgtacccaataagcacgtaaatctccttttatttgttatttaaagcaattgcgacaataaaaaagaaaaaaaaaattgaaaaatttgaaaaaaaaaaagggggatacaaactgaattagtaccaaa

SEQ ID NO: 25892 - DNA, 2373 bp, Heterodera glycines
  misc_feature (32)..(32): n is a, c, g, or t
  misc_feature (2362)..(2362): n is a, c, g, or t
gagcatcaaatgcccacgtccattggaaaacnaaaaacggcacactgtgcccactgatgcatggcacagacacagcaaacaaatgtcaatgcctttctcagtgcgtgcgtcaacgcacgcgtcaaaaaagggaaaaagcaataaaagaaaaaaggggagtaaaagtgtcggcattgacaaagaagaacaaaagcagttatttcctcaaaacacggaaaaaataaattgattaaacatttcaagtgcaaaaaaaaagaattgatattttgcattatttttattcctaatttacatgcgaaaaaacccaaaaaattacaatatgcgaagagattacaaatgaaaagacgcgggcgagtcgaatttgggaattgagtaagcgacggcctaagcaaattatgaaaatgacattaaggcttcagaaggcacaccggagaaaagacaaagaatggtaagaaatgaatgactaaaagtcgaacaaagctaagaaaatgagcagtcatcgaaaatcgctgctaataattcaaacgttgggcaacaatttgggctcaaatcgcggcatgaacaggccgaacttgtgctcaatgccagaaaaggttgctgcagccaatttgtatccaccgatgtggtgggggttttccgatgcttggtccaatattgtggtgtgggtcgaaacctgtcaaacgaaatcaaattgaatatttatttcgggctgggaattttgtaactaaaaaagtgataaataaaaaacagacttccgaaccgcttggccgagtaccaccaaaatcgacgtaaaaaatgcgttgtaacagctcataagtgaggagagtcaccgcaaattgaggactggaccgacaaacacgagcttaaaaaacaattggtacaggagacggctattaattaacattaaatgacacctgccgcgcccttccaaaatgccgaaggtccctcttccctaagaatctgttaaacagaaaattgatcaagtctaaaggagcaatgttagtccgttagcacctttcttgagcagtcgataagcccgttgtacgtcgtttggcccgtccgagcggccacttgcagccgcgttttgatcacatcagcttaaatgaaaagtgcaagccgtatcaaaacccaacaccagtaaatctaaccgggggtgaccaaagcagcggcgggcgccccggcaataaaagcggagacaaacaaagaccaagggcgattgtaaccctaaagaactgagtttgatatacaatcattggactgaccatacgacctgttcatcggctgttttcattttcatatgcgcataaacggggaaataaatggcggagaaaggaatgtcgcggagaaagcacgcctgggcacctctgtagaggccgccgaagcccaactcgcgcagaacggtgaaaacattcacttttgggccgttgatgatctctcccgcagtttgcagcctaattttcacaatttccaacggatttgtgaagacaacctcaaaatgagcaattttaaatgttaaaattttaatactgacagtgaatgagtttttatggcaaaaaaaaagaaacttgggatccggcggtgaaaaaattcgaattaagaatttttttgagtgaaatttttgaaaatttaaagatttcgatcttaataggtaaatttttccaaaaattcctcttaaattattaaaaaaatgctttttattaaatttcgacaataaaaaatatcattttttgaacttcttggaaattttttaaacttaaagatagaatttaaaataaaatttcaaaaaatggaagtaaataaatttattttattttgaaaaaacaaaattataattttcaaagaaatgaaaattacaaaaatgagcaagatgtttctaagttatttaaaaattctgaacagcctccaattaaaattatattttagaaatattttatacaaagattttattttccagcgatatgactgggaccgtccctggttttccccacctgactggccccagcacagccaccagccaaaatttcggacgaaagcgaaatgcgaccgtcagaagttaatttgtcgcgcataaaatcattcattgtcagtttaatggccttctccggcgccacgccaataatttggggcaaaagtccgcggtaaagaccgagaacacctgaacagattaataggtaaaaaaaggaaggaaattctgtagaaccttcaaattttatcacttttttgaagcagtcataactgaagaaaagagcaattgttggtgtcaaataacaacaaccgatcactcacctgtttttgtacatcacttcgccaaggtaagagccggtccgctgattttgcatccgcgtcttcaccaggtcgatgngatacacctga

SEQ ID NO: 25893 - DNA, 1168 bp, Heterodera glycines
aggccatacttaatcagggtgccccggtggggggggggagcgcgtcggctctgtccatgatgaccaccctcccctccccccccccctcatcaatccctccttttccaaccagccggccgctgcccctcccctcaatccgtccacccgtgtacttttccaccgctccattttttggcggacggatagggaaggaaaaggggtgacccagtttggcggaggagagcgcgttcagccgggaggggaaataaaggaaggaaaattccagcggaagggagccaacggacggactgtcttctggactgactcggacacggcgcagcccccgcccattgaaagcccatggatttagttggtcagatacacttttagaagaacagatctacaacatttgggcagtcataagcattgtttagcttttagtagcaccgatgtttctttatcctccccctctcccctctctcctcactctctctccctctctatctctctctgtctctctctactgcgtctctatctctctctatctttgccccctctctccaccctcccgtgccattgccatcactgtaaatgcaaatccgtcgcacatttatatttttggtttgtaccgtcgatgacctttccatttgcctgaaggcatttcgttgatactggctgggacagaggcattggcattcgtcgcaccgttcactgttcaatcgttccccactaacagtttattcctgcccgtcctcttcgtcctcgtccatccttatctgccgactcttttccttcagctttcttcataatcctccaatggcacatttaactgtccatttttgctcataacaatctgtttctgttaataatacaattttacctatatgaatttaattttaaagttaatctgctgctgttcccattgtccactttttctccttctctgtcctgctttatccttttggcttgtctccaatggtcgcagttcggtcccgtcccttcgaaatcccccgaggggcgttgacccaaatctctccccccgcccttcgcttcctttgcttctccgggcgcgatttaattgtgctagaatgaatgtggaaaaagaacagagtgctgccgcagcagccaactgcgacgtttgagctttctgagccactcactcattgcccgcccgtcacagccgaccctt

SEQ ID NO: 25894 - DNA, 1141 bp, Heterodera glycines
  misc_feature (1121)..(1121): n is a, c, g, or t
agtccctattaaaaatgggacatttcaattcgatttttcacttgaaatggcaagttcgcccctaatttgcatcttttcgttttgggccgtccgttttaaatcggtagaacctaacaaccatgacattgtgtgatttcggatttttggagcacttggggatatagtaaaattccctcccagccatgcttagagcagtataatttaaaaaaaattattttgggtatggatataattttcaatttctgcgttcggaaaaaggcatttagttgacttggtgttggctcagatgggaaatcgcatttttttaaacaaattccatggttaattcgggcactcgtgaacggttgacagggcgaagaattggggaagatgaccaaatttttgattgaacggtgtctaatcgttgtcaaaattgcggacgaatggaacgaattgggccgagaaaaagcatagaaaatgactgatggagaaagaagaagcattgggtgttggaaagtgctcgaatttggcactcctttcgttaatggatttatttggatcaattttacgcataatggactaaatcctcacaactgttggtcggaaagctttcaccaaatcactcaaatttatcctaatgattagggttgcaaccccgacgtcggggttggaaaattcggggttcggggttgtcggggttggaagtgtcggggttcggggtcggggttgccaaatcgttcggggttcggggtcggggtcggggtttttcaatttttgccttatgccaaatagtcaaaaaactttataaatttttgcttaaaaatatttaatttcgtaataataattttatgtgctttttattattttttttatcataaatattttgtatagaattaattaaaaacacatacctaaagcatttaaaatgggcaattttcagcgaaaatctgaataaatctttttttggtcttttttttgcggcgctccttatctaaagacgtttaggagaaaatgggttcggcgggtgccgataagggcccgccccggaaaatttttgaaaatttggaaggggcccggttaaaaaatttttgcccaaaaaatgaaaaaatttttctgaatttttgggcccatttttttttaanaaaaaaaaaaggtttttttt

SEQ ID NO: 25895 - DNA, 1205 bp, Heterodera glycines
tgatttacattaatttacatggccggagaccccttcgcaaaattggaaaattggctgctgaccccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtggaaaaagttggtaccggtaccggtaccggtttttgcattaccggtcagtaccggtaccggtttttttacaattaccgattaccgctcaactctaattttttgtcataaatttttagattagttttaataacgtaattaatttatgaaattcgtctcaaatagcacattcccctccctaatgtaatcaaaaacaaagtgcagctgataagaagcaaagacagcattagcaggaaacgcaaaccttttattttgggaatgcgtttcttcccaaaaaagcccatttaaatgttttattaattaccaaaattttaataaaataataattttaatttgtgaccaaaatacaaacatcacttttgaattgtgttaaatttctcgtcttcgtcaattttacgtcatgttttgagtttttcttaatggacaaagtctggtggttaatcaggcgtcttttcattaattattttttgaatggaaaattattggctaatgaagtgtcaaattaaaaacaacagcaaaaaattggacagcaaaaataagataacttggcaaattacgacttgacaagaatctatgtaaataacgattgaaacaatagcaaaattcttaaattagcaatttgaattttgtttatcccatttaaaattggtttttaatgtccctaaatcataaaaacggccaacttaaaacaaattggactttagatcaacacatggtcaaatttggcgcaaaagtgcgacaattttaatgtgttaatggactgtttttttcggtgttaacacccgtgaaaatacattcatttggtggcggcggcgaataaaaaagatggccccaaaagccattcattgggctgaggacagaccgaacggaatga

SEQ ID NO: 25896 - DNA, 1732 bp, Heterodera glycines
ggaagtggatagtggcgtaaaaaacacgtgtatactcctctataataaaataatatttttacgtctggaaaattttatcaaaaaaggtaaatacgtataatattttcatttattaggataaggcatcaaagtgcaaaaaaacatcgtgtaatataaccataaaataatatttttcgtgcctcgggaaattatgtaaaaaataggtaataatatctataatattttgcattgattatgttaaggaatcaaaaacaaataattcaaaatatttcgtcaattcattttataaaaattgaaaactgctaaaaaaataagcatatattggacattattttgttttgaagtttgcctgatgtaggggaagggacgggtgccgtgagtgattagtgaggttagggtgttggtagtgcttaattactttgtaagaagctgtaaaaagtaattaatgaggggagggggggggggggcgaaattgatacgaattgtcatcggtatcaaaaaaatatctatttaattatgggaagatattgatcggacttattggtccgaagggtgggcaagggttgtttagttagttattgcttaactttcagatgttaaaagtctgtgaggctaaccatcaaagtaactaactcaggtcaacacaatgatcaccaaagagggcataactcattagtgtattcgcttcgataaactaagtttgtgccgttggaaatggcccacatgaagaatgggtgccataagtgaaaacaaaaagctgtactcgagaattggttgagcgggcactgctggctcgttgtgatacacgatgggggtgatggaacaaagtcataatgggctttgtcaaaaaaccatcaaatggaaaatttttaacggaaaattattcataatttcgccaaaaataaaccgaatttaaaaatgttggcaaaggtgtagaattgtgctcccgacggaaaaaaattgtaaaatttcaaaaagcattttttctagggtaaaaaaatgtgctgatcacaaatctgaaccctgatttgaaaaatcattgctattatctattacttttgatcgataaaaccccgaaatatgtaaataaaagtcccgatttttgttcgcaaaaacaaaaagaaagtgtttttcctactattcagagcatggagaatccaagaaaaaatatgtatttacataaaattggcagccctaattatgatacactaatttcagttccctcctcttcgggtaaaactcaatttttcgaaaaatttagtgttgtgaaatagtcaaaatttcgaaattttctgccggcggtgcctctcggcaccgccgagttccccgaaacattttttcataaaaaattggatcaaaagctaaaaaatttgtcatttttgatgaaaacctgttcactcattgcataagattttaaaccgcctaccggcaccgccggacccttaccccaaaaggtttttttttgggaaaagcgcgccgcaaaaaaaaacatttttggattttttgattgtaataaaattttcaaaatgatgattttggaccccaagaagctaattttttttgtgcttctatgcttggaagatcttaattgtactatttccaagattgtacttggaaatcagcattttggcacatgatcttaaaaaataacaattttatgaaaaaaagtttaaaatttttggcattctataagaaataagcattaattttgctacacatttttgtaattggt

SEQ ID NO: 25897 - DNA, 1616 bp, Heterodera glycines
tgattttcacacatgcattccttttttggcttccccccccgcgtattttctgaatttccattaaaatttcattcactctaattgttcatttttcatttacttagtaacactaattttggcattaaaaacggttcaacatttaaacctgttagcatcacataagacaaacaacaacaaaaaatcacacaatggctttatgccttcaaattcacaattcatttttggcattaagcccttggcacatagtcattttaagcacacagcgttacctgccattttcgcttgacactaggagcacacagcttcgactagtccatggcttacgctcatttcacccattaattggtctcttttctgggagcacacagcttcgaccagtctcgtggcacacagccacaacggcactcagcccagctaggagcacacagctgcgactagcttttatcttttcatgctcaaaacctttgcacttatcctttcgaaaacagccaaaatcacaaaaattaacatattatcacattaaaacacaccgcattgatcaatcaatgatcacaaaatatgccataaggtttttgtattaccgtactcagccaaattagccacagaaaatttgccaaatttcttttgcaagacaatgcatttttgttggctcatttacgttttactgaaaaatagcaatttcccattgctttagtccttttttttgttgccaaaacgtactttaatttactcttcctatctccaacaaggaattaaaatttaaccagattaaaactgcttttgggtctgcgtccctttttaagtctgcattgttcaaattagcctttaatggcctcagacactttttgtctggaatgctctggaattttaattctctctctctctgtttaacaaaaaaattttacacaacgggtcgtggcaccaaaaagggtgttgtgtccccgggtttaaggcttcaagccatttcaaattaccacttttaggagagaggaatttattataaggaaaagcattgacaaataattatgaattgaaaaccgggaatatgtttgggtcaacaacaacctcagagcattttgggtgggtcagtgcaattggttatttgggaaaggattgccaaaggcaagaaatggcacagactgacccaccgcagacatctcgcagcccccgagggggaaattgggaggacttatatactgacacaaaggggatggactttggataggatgaggggtatggcggcaaaaacataaagggaataagagaaatggatggcatatgcaacagaggtgaaaaatttgaatgctgcggatacagcacattggaaccatcgcaattttccaaaataggaaaagacgtcaaagagacggacaaaaagggtgggttagtcgaattcccctctccgaattttttcctggctataggcctgattaacggtcctttttaaggtgccgcccgatgacattgcctcggtgttttacccgtcccttggcccgtacagcagttgggatgccaaagtgattgagcggcacattaagtggatgtccagcgcgggcattgacgtggtcgtctgttcatggtaccccaggaaatggcgaacccgaatgtttttttat

SEQ ID NO: 25898 - DNA, 1374 bp, Heterodera glycines
gaaataaaatttggattaactaactttcttcacccttttcaaaatggggataccaaattaagttattaattatctaaattagaaaaaactgaaaacttcaattctttatcaaatcattttttgtgccattaagcagttttgtgttgcttttgttcataaatttgtgattaattttataaaaaagtcatttttgtatgggggttattagtgggcaaaagtgctgaccggcggacggacggacggacggagggatttattaccgtccccccccccaggcatcttgccctcctcccttcccatctgttccaaattaatttcatccatcaccatcatcccatcctctcctttttacatctcctccgttccgttcaacattttttaatttaattttcgcattgtctttctcttttctctcaccctctcattagtattttcactctctttctttctctcccttttctcccctctctctcgctcggtctctctctctcattagtgttttcactcactttctttctttccctcctctcctttcctccctctctatctttcttttctctttctctctctctctctcattagagctttcacttctttctttctcgccctcctcctcttttttctctctctctctctctcctctctatctgattaattaattctccattctgttttcctcctctcttcctggcactgtcttcctttatctttctctatccctctctatcgccccttttcactcccctctatttctccgttctcttctccccttctatgtacctagatttttttgcattgtgtgttatttggggcttctgttttgtgcgcaatgtgatcacatttcacatttccggcgcgctcaaagttcgatcattcattgcgcgaaatcggctaaatccccccgttccataatgatcaatcaccacaataaatgatttaattgcccggcgggaaaccaattaagccccgcggagagaaaaatagtccaaattttctaaaaaaaaattacaacgaaatctttggaatatttcggcattcattctgttacataagaaacttttagttgtctgatcacttttgctaattactttgctcagaaaaagtctttgttaattgaatttgccgctccctttattctcccttttttctaattaagaaactgattaaacgtttttgttaaagaaggactgactaattaatcaatccctataatgctaattaagtaaataatgtgactgactaatgacttgtttgctaattacaaaatatactaattgaggggatcttgcaaaaaactttttactaattagtaaatctgtctgctcatttctttcaattaagaaatttgcccaatttgttttttgctaattaaaa

SEQ ID NO: 25899 - DNA, 1190 bp, Heterodera glycines
tgatgatcagaaaaagagataggcgtttttcccaaaattttcgacatcaacctcgcccagaaagaaattcggaaaaaattaaggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcacccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattaaggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcacccaggaaagaattcggaaaaaattaggggcggcgctatcattccgaaaatgtggttggaattcttcagactgatgatcagaaaaaggagataggcgtttttccaaaattttcagaatcaaactcccccaaaaaaaaattcggaaaaaattaggggcggcgctatcattcccaaaatggggttgaaattcttccaactgatgatcaaaaaaaaagtaagggggtttttccaaatttttccactccaaactcccccaaaaa

SEQ ID NO: 25900 - DNA, 387 bp, Heterodera glycines
taaagctgcattgttagtcagctgagctgttcccagctgattggtcctggcgcgggctaaatgtactctaaaaagataagaagtaatcttggtacttatacagtttgacccacataaaaaaaattttttgtttctaatgataaaaacgtgtttctaggggttttcggggctgctgatcacgaatatgaactctattggacgaatttccgaacccctaacccgaaattcgaactttttttcgaaaaaaatttttttttttaatccgtttaaaatgtgtcaaaatgcgtgctccatgattctccggtgagctgctcgttcaacacatactcaaaaaataaataaaatttaacaaatttctaaaattaaacaaaatgccaaaatatgaag

SEQ ID NO: 25901 - DNA, 1820 bp, Heterodera glycines
tccgaatgttgctgaaaggaaaaaatggttgccgaactccctgccaattaattcaaaatcaaaaagcctttccaataaaaatataaatataatttttaggttccctgacactgaaccgtcaccaggcgtctgtcctattggccaatgcgttcttttgcacttttccggctgaatttgggcacaaaggccgacgctttccgcgctttgatttcaatgcgttggtttaaatttaaaaataagcatttgttaaatcctttccatcttcagacttttccatttgaacactcatcgggcggttgaaaaactcaaatttttgcttcattactttgctcaaatcagacattgtccgcccatcggcactttgtcctttattcgccaagccgtggaacggttgccggacggatgggaaagtgagcggacgaaggcggggggggggagaagcaggacaaaacatcgtcgcatttttttttaattttagaaaattaagaaaaaccaaattataccaagccgaatttgaaaaaaaattctaacctaacgaaaattttataaagaaattcaaggaaacaagcaatttttacaaaactttcccttgagaaagacgacccattgacatttttgtgcccggcaataatttgttgttttgtctcaaaggtgccccgctggacggccatttgaccgcactttgcgatgggcgcattgaggacgaaggcgccgcgcacacgcaaatggattttgctaacgaattcattggtggcggagtgttgggacacggcgctgtccaagttggtcggacggggagggaataaaaatatatgcaaataggacacacaatctcaaaaagttcgggcgggtgtgggaagttcgtttttaacaaattttctcccaagactagtcaatttttaagatttttagactgtttttagaatttagttgggtaccggacaagaaaatttacaattctgtcaagtaaaattcctcattgcttttctgactggtccaaattatttgtagaaattgtttcccttttcaggaggagatacgttttctgatctgtcccgaattggttgttgcttgtctgatttgcgaaagggtgggtaagaaacgctgctaaaaggggtgattgagaaaaccaaaaagattatggtgttttatctggaacagtccgtccccacctcagtatgatttaccgcaaaaaattttaatttttcagatctaaaaaattgtaccttttttttaggatttttttttttttggaaatttgtaattttgttttttggcgggggagagaaaagtagtgcacccgtgttatcctcttacaaacaattagatggacgacaacgaggccattcttttgctgggcgccgaacgcttctccgactatcggggctattgtgacacgctgcggtgggtgtaccggaaatacggcgacgacaacacaaaacggtgggggaattcaaaaaagaaatttcaatactaattcgggtccattttcattagggactcaatgggccgtgcgattgacaccgaactgttggccatcgacgcgctttgttttggcagtacaatggactttttgagtgaccaattcgacgcggatgccatcaaacgcgagctgctcaaggtgtatgggaagaggggacagcagcataccaaggattaacgttgattgggtggactctgtttctgtattttttcgagaatggatcatccccccccaccgaaaatttcctaattttttttagagtttttaaaattttcaggcttacgtcggcttttccctacaaagactggagtcaccgcatggcatttccaccggcaat

SEQ ID NO: 25902 - DNA, 1574 bp, Heterodera glycines
ttcctccacctgtcactttggtgacagacggatgtttgatgaccttctgcggcactgcacggcgcggggaggggaaatgaaaaaacatccgcgaggatttggggaaattaaaatccacaaagcggcagacttcaaagtaacaacccctcacataggtttcggtttgcacgcacccctcctataggcttgggattgtgcgggaaaatgtccggggcggcaacttcaaaggggtccaataggcacgggtttgtgcgagaaatacccgcaataacccgcaactcaggatttgaaaaataataccgcctaaaaggtttgggatttaatttgcaaagaaaaaaattaatttcattatctgccactttggtgacaggtggatgattgatgacctttccgcggcgctgcgcggcgcgaaaaaaaacacccgcgccaatttggggaattggatttggttgggcggcaacttcatagggagtccaataggtttcggttcgtccccatcctggttttttttgatggggcggcaacttcaaaggaaaacacaccttcaataggcgcgggattgtgaacgggcggtaacttcaaaagaaaacacaccttcaataggcgcgggtttgtgcggtaaatgtccctggcggcaacatcaaaggggtgcaccccttccataggcacgggattttggaggggtcattccggtacccgcgccgttttcgagccttatactacttataagtaaaaataagaaaattattttatttttaataaatagggaccggatttgtagggattttttcgcgcacttatttcggcctaaaaaccacgtaaatagtatttccatattttacattcatattacggcacattcacaaaaaaaacgaaaaacctacccataaagatggaaaattttggaaaataaccctaaccgaaaatcttggcaaaattaccaaaaattgcgcaaaaaatttttcatcagcaaaattcgcgtaaaaattaattttaatataaatttctaccaaactaattatgattttttcttttcaaatttacatatattgtttccttatttttgcataatttttcgttattttggttttgtacttaaatttatttttgtgataaattaaatatttccaatcaatttcctttgtcatcgattaaagggaccatctccgaaaagaggatggcagcgcgagcccacatacccgagcagatttttattttaaatatttttaatcatatattatatattccattcccggaacttcttttaaaaattaaataattttatttcccgctcaaaaaattacaaaatcagatcattttcatataactggacagttcccaaatggtttattgtttagcgggagatgcaaaaatgccagtcttttaattgttaattcttcagatgaaaaaaaggatatgagagaaaacaattttttattatagagaataaaaaatatttatccaatataattatttctaatatttcgtaattaaaaattgtttgtgaaaaaaattattaatacagaatcattatttcgcgcattttcatagtcatttatttcccgcactaaaaa

SEQ ID NO: 25903 - DNA, 995 bp, Heterodera glycines
ttgtaaagctcgagctgttctttccaatggtcttatccctgtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttacaatggtcttatcccggtctcgatccgtgacgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataaggaagtgacttcaaatttttcccagttttgattgggtttt

SEQ ID NO: 25904 - DNA, 483 bp, Heterodera glycines
gcgttgtaagggaaaagtgtcaaatcaaatgttcacccttctagttccctgtttttttgtcaacaattttcaattgaaacataacattttacaaattacagttgcttatcaatagggtcgcgatttttaggtttaataaattttttgctcaattgatttgaagaaaggagctcaaaaaaccatttctgcattaaaaattttcgattctgatgtcattatccggtcggggtcgttttcgcgtggccattttcgcgtgagggccattttcgcgtggccgttttcgcgtggttgcacataagcgaattttttacctttttatagtttggaaaattttttcactcccgttttacttctggtacttaattcaatatatatttagtgaattttataaactaaattaagactgacaaattattatacagtcaaataatttttattacagaattttttctatataaaattgagttatttgtgtggaaaatg

SEQ ID NO: 25905 - DNA, 1135 bp, Heterodera glycines
aaattattgttgaatttatttttaaaatgtttattttacatttttatgcttaaattaaaaaagttgtttttactgtgatttttcattttttgtacttggggccaaacgaccctggggcccaaaaacgagggcccaaacggcccgactctgattttgcgggatccggtttttgaaaattcataagacagaatgccaaaataaatgaattatacaataaaatcaattaaagataaacctattttctcttcgcaaatcccatcaaaattttgtgaaacttttcccgcggaacggtctccactctattaactctttagaaattgactcaaatttgatcggttttatggacaaaatcacttaaattttcaaaattttcccggcagcgcctaccgcactgccggaccccaaaaagttgttttattgggttcggggccggattatacagttctgacaaccattttgacctaatttgaaccccgaacccgtactcgaacaaaattttcaaaattaaatttttagcaatttctaaatacgcaataagaccagttcaaatgcatggccttcagaatcgtattattcattttattcgtgcattttgtcgtaatccgaatttttacaaaaatttaaaacagatttgggttcaaatttggtcgaaatggatgtcagaaccgtattctccggccgacttcaaaaaaatttttcaaaaatatttttttaaaggggaggggggggagtaccatccgtatactattaccaaaaattcactcactgtccactgtctgagttcactgtcgagatttcttactgttataatgtccgagagccctctccaacccacgaccctttcgaaaaatcttggtcaacccactaccccctttccatatacgccgccagtcccttaaaaaatttgagttccaatcctgcaatgggacccgcaaatttgaaatgtctggactctattaaattttcttaaattcatagcagagaaatttttaatttataggttttttatataaacaaaattctgaggtacagacaaaaaaaatgaattttgcttttttcctactgtaattttttcttaatgcctgtgtttgatttatatgtattttatttataaattaccgagactatctttcat

SEQ ID NO: 25906 - DNA, 1362 bp, Heterodera glycines
ttttatttttatttttttgcaaatatttatctgtcttctcaatggtcttctactttcagaaaaccggttggtatgtggaattctgaatttaaaaataaataaataattattttaattgaataataattattaaaaaataattaatttaaattttattttatttccctaaaaagtgatttcccccccccccccctccccccttttaggtgttgctgttggagagcatttacatttttgacgccacgaaggacccgcatgtactgcttgacgggcctttacgtgagtttttacaatttgtaaatgtgaggctgaccaatcactttaatcttattattattaattaatttttaatgactttcaagggcatagcgccagacgggtgaggggcagctaaaaacagctataaaattcttgatttttccctggcgttaatttttttccctataataatactttagaaaaatattttaaatttttttgttttccccaaagtttttttttgtatggggtgtcggtgtcttggagggttagtaagtaacaaaaaatactcaaaaaattataaattttctaccattaatgtctgttaattcagtgttaatccaggaggtcataagttaaatttacgagcggaatttcgttttgcatttttcggttttaaccaaatgaattcgtatttttaaattggaattttttgtttttaaaaaacaaaaaaaaaatgcgcgtaaattcacacaaatcctacctttaaatccttttttatttgtttggttatgctacttttcacttatggcaaatatttaataaatattatttaataataatttacaattttttccccgtggatcgttgtcaatacttttgccttacattttgaccattcgcaaatggaacgtatttcacgcaagcaaaccatatgacaaaggccgaccaccgggtgggattctcccttttcggggtgggtcgccaaacgacccacggggtgggattctcccttttgggggtgggtcgcctataggaggaactagctccggcccaccccacagggtgggtcgctggtgcgcacgtgactcgacggtgagggttatgaagaaggtcagatatggtcttggttggatgaaattatcttaaggtctgggagatgcgaccgaacgctcacgattttctgtttgtccggccactcggacgctgttgcgtcggtgatttgccaaggagtgaatccggtcgtgtccactggaagtcatgactcgaccattcgcctgtgggacttgcccacccgtcgcagcatgagcacgttgacccaccacaaagctagtgctatgactggcattgtttatataaaggggtgcgagatgaactccccga

SEQ ID NO: 25907 - DNA, 1053 bp, Heterodera glycines
tacaaatttaaaaactattaaaatgcgctttttggtcgtccgtggggcttaggagccgaagagcaaaaaaagtcttaggattcagaaaaatttaagccccaaatttttgacaaaatatctgattcaaaaatgcgcacaaaactcacaatcgaatcgcattggttttttgcgtgccccttcaaaaagtgtgtcgaaatatttggtaatttcacttcgacccggcggtttgatttcaacaaatgaatttggggcgttaaataattgttgaatctaagagagaaaaaaaaaaatgtaaaattgttaattttttatatttgcaaaaaaaaacagtacatcatgagagcaatttgtgtacaatttttgaacagacgcaaacaaaagcacagaaacaaagccggagaaggaattaagcgacgaaatcagctaaaaaataatatttaaaattattaggaaaaaattctttttaatttaaattctattaagataaaatttatttattttattttttattgctattgaccaatttcactccacgacaaattaagaaagtagttttttatattcttcgatacgttgaagaaaatatgaaaaaaaatttggaggggggtggggggtgggagaaaaaatttaacgcacccgcccccgattctgaccattttccatgtcccggttggcaacacggattcgaccatgtccaagtcgggcagcagcatcaatgcctggaccgagccgtgctgtccgacagtgcgcagcgcacggccaacaatttgggcaatgttttcctcgggcgtcgccggccccgcgaaaatggtctccacggagaggcaaaacagcggcaaatggtccacgcgttgacgaggacgggcaaaaagtgagtgaactgtcccagagggccatgtccatggagcaacagacgagttaattaggtgataattaattatttgattgtaaaaatggacaattttacacaattgttttttgtgatccgaaggctgaaactttttgcgcatatgcttaaaaatgaatcaagtctgtttagttttttaaaatttt

SEQ ID NO: 25908 - DNA, 829 bp, Heterodera glycines
  misc_feature (198)..(198): n is a, c, g, or t
aaagtgtcgatgaaagaaacgcgacaaaaatggcccggcatttgggcatggaatggagaggctggaaaaaaaaaattgtggagaaatcagacccaagtgacttaaacaggggagcagctctgtatttccaccccttatcccgacaaatttattgaaataattgaaaatttttttttaattttttacaattagattttntagtaaaagttaaaaaaaacagaattttttaattacaaaaaactacttaaagaatcaaatatattcgttttacaaaaaaacaaaaattttaaaaacttttttttaaaaaaggtttgtttttttaaattaaaaaagttgaaaaaacaaatttcttttgaatttttaacagatctttacaatttcaaaatgttagagaaaactataaaaaaaaatttcagttacttttttaatgggaaactcccaaaaaatttaaaaaattgtcgatgtggagagagacctagtgaacccctaaatagaataacaacaacagtataccacgcttggcggatggcttcacggaatgcaaagcatcggagaaatgcgcttttttgatgcgaatttttgctgggtccaattccaacttttccgaactgatgtacatgtgtggaaagcactcacgcattgcgaccagaaccgattccgtgcacaaagcctaaaaacatgaaaaaatttaatttgaagaaatttaaaattttttattatatgtatttattaaaaaagctctaaccaacaaagattttttcaattttgtctaattttttttatagatgctgttgaaaacgcgtacatagggcttaggattgactctaga

SEQ ID NO: 25909 - DNA, 1370 bp, Heterodera glycines
attcgtcctcctcatcctccgacagttccctcgccgttccgtcggcgttgaacaccaatattccgcttcgtcctcctctggccctctcgtcggcaacgaaattgccgacaataataataattatttgtgaatttcaaatttaaattaaaatttacatattttaagttcccaaattcgtgcatggcaatttggttttattgcttgcattttgttgaattcttctgccggatcaaatgcgattatcctttattttaacaggtcttaatttgtcaacaaaaatatattttaaacttttttcatttttttatttaaaagatttaaatttaattaatataattcctttttaattagtttcaatattcaaatataaaaaatattttatttttcagaaaaacgaatctcagatttggtattttatataacatacaaatatacaatatacaacacacatcatcatattctagttcaggcgctttcctcgtccttcttcgccttcttcggtgtgttgcttcagccagtcgtacaccgcgcccattgagtatcggttcttgtccttcgggtcccagatgtgcagcatgatgaactcgacgaacttctgcggcgcgtcatggggaaattgcagtcggtgtccattcagcatctggaaaaaagggggaaatgatcaaaaattggaactcttttttgggcttttcactcactctcggtggcgaggcgccatccatgaagacttcccagcacagcacgccgtaggcccaggtgtcgctcttctgggtgaagctgcggtccctcagtgcttccggcgacatccgtttggtgttcaaatcggcgtccatcgtccatcttcttcatctttcccttgtgcgccaagccgaagtccgaaattttcacctgttaaaaatgagcaaaattaatgttttataagaaaattttgttttcccataatatgtggacgatgggggggggggaatttaaacatactcaatgaattggacaaagcaaatgagcagcaaaatctacagtagtttgagaggaaaaacagcgtaaatgagcgtttgccattgttgttgcagctttgtgagcaaagaagcgaccaaagaattcatttacataaaaattggggaagaaaaaaaacagaaaaattaaattccattgaaaacccctctcaatcacttcactcttgaaaagcaaaaaaagtcaaaaaaattttttttttttcaatttccttaaattttggcaccaaatttttctgacccctccctcgtccatcatgttctcacccaccatgcagtccgagtgaaagcagttcctggcggcgatgtcgcaatggatgatgccttttgagtggatgtggtccagtcccggcggctgct

SEQ ID NO: 25910 - DNA, 1257 bp, Heterodera glycines
  misc_feature (14)..(14): n is a, c, g, or t
gccgccggaaaaanttctcaaaatttccgcgccgtaatatattaacagaacttgtcaaaaaatgatcaaagttttggttaaatttgcagttttaggctgtttaaaaaaagaaaaaataataatttttaaattgaaataatttttattaattaaaatttcaattgaaaaataatttaaagaaattatttaaaaaattctgtaccgttggggaattgaacccaagagaaaaataatgaaaggcagaaggtttagccagagaccatatttgaattggagctatccaaaaatagaaaacattaaggaaggaaagaaagagatttaagattttttttcgcggaaatttgaaaatttttctggctgctcaaaagttcaatccttaggggtgtattttcaactctcgcctctcgtcccaaaaaacgagaggcgagagtaccaaaaatggcgagagttggcgagagacgagaggcgagagttgtcccacccctggtatttaggatggaaagcaatttttaataattttcaatttttgcaactaaaacccgcaccaagcccaaaattttgttcttttttttgaaaagtgcgctataaaattttgtttctaaccgttcggacttcgaaagttcactagatagctcattctaaagctattgatgaaattctacactttccagtgctggtagctcacaaatcagacggaaagagcactggtttgggtggaagcgatcgccgcaccagcagaggtcgagggttcgattccctcccacaggtctgccttttgcccaaatcttttacttattttataattaatttatttaaagtaatccctaataaatataatcaagtatttaattcaatcaatttggatctataataattgttaatatacataaatgtaattgtttgtagcccaaacccagagaaaaatagactttgggattcaatatgtttggtctctgtacacccctatataatctttatttacttcgaagggataatacattttcaagcgatcatagatccaaattgatttaattaaatgcttgattatttttgtgagggattactttaaataaattaattataaaatttttgcggttttcgcgcaaccccatttttgtctatagtagggcttatgaattagctcaacattatgagcttctccaagcgtcgcgaaagtcaacttcaaatgtggccatgaacgaactaatgaaaaaatcgaggcgttggccatgcaaaatgtgaggcatgcccccaaat

SEQ ID NO: 25911 - DNA, 1090 bp, Heterodera glycines
tctttttttcctaacccccccccccccccatttccggcttatcattcattggcacactttcagtcgcatgtgccgagtcagcgattggattggcaccgttcgcccggtcattccctgcgccgtccgtcggctgagcggtgggcgatggaaatggcgcagctgtgccacgacattgtgctgtagcagtgggaacagtgccgggtgcaaattttgggcgggcagtgaatgttggatggtcaaattggccaacgaccgttgcgtcttggtatttgctccgctactcttcggcgcgtaatattcgtcgttggacaaattgaacgggtctttgtccgctatttgcgcaatttgcgtttcgatttgctcctccacttcctgtcgctgccgcttcagcacttgggccaggatcagcttggacttcttcatgacgccctgttcctggagaaaaacagcaaaagcaaaatgatttttgattaaaataattcaaaatggcagaaaaacctttccgagtgcgcgagcaccgacttgctgctgttgttgctgcagaacttcctccacttgtgccgcgtcctccggcattccgaatgccctcgggtcgtcctcgtagtccaaggtcaacacccgcggttctatggcaggcaatacatatgggattcagctcgtttttactatcattttctcacccccacccctatcttccagacaaaaaatttcaaaaaaattttagaaaactttcaattttttttgttgaagttctcatagaaaaaaaatattaaaaaatcacttggaattgccggcatattcgcactgtcccaaatgatgtcgtcctcccactgagtgttctccaattcgtaattttcaaaagggaacagcgaatgttgcgggtcgattggcaaacgcgaatctgaaaagtgccaaaatggagaaaaaatagggaaacccaacacaaaatgacaaaagttataccatttgaaaggtcggccgaagtgttcaaaggcgacgagtaacgcgtggggttgagaaggtattcgaaaaaggttttgtttttccctaaaatttagaaaaaaagaaagtatttatttgatttaaattt

SEQ ID NO: 25912 - DNA, 2078 bp, Heterodera glycines
ttataaatttaactcattccaaattgtttcttccatttcataattacgtaatggctaactccaattttcttgcaaatttcggcataattttgtcgccattctttggttgaatatttttttcctttttgtttatattcatttgccatttcaatgaatttttttacaatttcaattttttctttatcagttttggattttttgcttttattaatttgtttattaagtcctaattctttaatccatttataaattttcattcgatttgtccccaatttttttgctaatttttctttcaattttattccattcatttgttgaatattttcttcctttttgctttattttttcttttattttataaaattttgcaattttttcttccaatttttcttcttctttttcttcccaattttctccaaatatttcgtcaaatgacttttgctgtaactttttcttttctgattcaattttgacaattattaaaaatataattaaaaataataaagggaataatttcatttttgtcgtcttaaaatgattttattttttcttcaattaaatgccaattcattttttgaggcatttaaatgatttttttctgattaaaaaactgaataaatcattattttactcaataaaataaggaaatcctgtttaatttcaaagaaataatgataataattttatcttaatgacaaaataattgccaattggtaaattaatgcctccatttttgataaaaaataacaatgaaagaataatttcattaattctcaaaaatgtattttattttttattcatagggaaatataaaacttctagtgtttttatacatgaaataaagaaaaaattgaaattgtaaaaaaattcattgaaatggcaaatgaatataaacaaaaaggaaaaaaatattcaaccaaagaatggcgacaaaattatgccgaaatttgcaagaaaattggagttagccattacgtaattatgaaatggaagaaacaatttggaatgagtaaatttataacggagaaagaaaaaatggaaaaaatgaaaatttattggcaaataaaaaaagaaaatccaaaaatgagtgaacgggcaattgcaaaaatgatgaaaattgatagaacgaacatttcaaaatggaagaaactgtttggataaaagaatcattgaagattgaaaggatgattataagaaaaattggataaatttgccgaaaaaattatcagaaaaactatgacaatttctagttttttttcaaattttttgtatttgtattaaaaaattattttaaataccctaagttttgaaatttttcttagtgaaaataagtgaaaacagtcaattcaaggattgggagggtatcattaaaactgaacaatgttggaactgggctcccagtatgcgtaaatttttgattttagaggccctgtaaaactccttggggttttgctagggtgaaaaaatggaataattgtaaaatggaagagaaaatttggcatttgtattagccggaaacgattaacagagcaagaaaaaatagagaaaatgaaaatttattggcaaataaaaaaagaaaatccaaaaataagtgacaaagaaattgcgaaaacattgaaaattaataaaaaaaaaatagcattttaaaatggaagacacaatttggagaagaaatggaagaggattaaaattattaaataatgaatttttttttcacttaaatttctttggcatttttattttcccatttcaatttgccaatgtaatttttaggtgctaaaaacatccaaaaaagttactaaaattaatgaccaacattttcaaaacagtcgtgatggtacgatattttcgaaaacaataggttccctggtctggcctctctcaatctgctcaaaacggtcaaacaagattttcaagtcgtgcagggtcgtttcgtaaaatccgtcattttagcgaatttttcgacaaaaccatggcataactttgcttaaaggcaaccaaattttacattattagtgccattcgatatccaagctttttctctataagcctgcaaaatttcaaacaaaattatcaaa

SEQ ID NO: 25913 - DNA, 2054 bp, Heterodera glycines
caacttttaaatataggcaggagcgatttttgcgcttttttttgctattgcatattgcttgtcaccgcttgaatgctattgacgaaatcttccattacatcaccatcgggagcagattcagttgttgctgcagcactgctgctgtttatgcatccctccctctcctcctcttttgacaatagctgttgttgttgttgttgatcaaaagttggcgagacatctgttaatgattccgccaaaagcaaattggccagcacattgatcgcgtttttggctttcttccagcgcgtcccatcctgcatcattgcgtctgccgctagaccagcttccactaagtcaagcgccacctttgccttacgcctcaaattcttctcctcctcgtcgtccggtgtccgttgatgttttgctgttgtcattggtggtggtggtgatggtggtggtagaggcttggtgcacctgtctgaggacgacagttcgctgtatggaacgctttacgcgcggcaacgcccgttttcctcaaacggaatgaaacggggaacagacaggcgggggccgctcaaagttatgccgcccgtgcttatagtgaggtccacctctgcgataactcgcttgaacaatgcttttttatccgacatgatgctgacaaaaaaactgacggtcaaatgtttgaaaagattaaatgggccgattgggacacgtgcacttatttatatagcgcgagcgcccacccacatttttcaaatgcttctaaatcctcatttaaaattttatctgatgccttcgttgtacctatttttagctttttataaattcctattttagttatcctattttcaaacattttttaaattttattttaaagtgaaaaatcgatcgattgattaaatggtgagtgatcgcttgccgaatcactaaaaatcgctgtaatcttcttcctcctcctcctccccattatcttcatcgcgcatctcgaccacgatgtcgctgtcaagcggcacctcatcgtacacgggctcttcgccctcctcaattgcaccatccgcgcggctctgccccgctgcctttaaatttaaattgtaattttaatgagtgagaaattaaaatatataaagattttaatttaattaaaattgcccacccggtccgccgtcaaattgacgcccgtcgggcgcagagaaacgccggccaatatagccggcaaaatcagcggagtcggcgcgcttgccggctggcggttgcgactagcggcgctcattcctgtacaaattgttaattacaatttgctaaaatgtaatagcgagaaactcacgctggcgatgtcggcgcagcatcccctttttgaaggcgcggtctttcaaaaatttgcgcactttgaatccggcgcgcacaagcttaattgaggaataggggtttagcggataaatgaccaaaattaataacagacctccgcaatcaccaaaagcgccaccagcgctgtgcacaccgcgatccacgcggtcaaatgcgcgggcggaggtgcgcattctgccgccgccgccgacacctccgcagttgtcggaagtgcggttgttgttgttgttgtcgttgcagcttcgtcaagctgaccggtgctcaaaaagtccgtgatgttacggacgctgggatgcgcacaaagcacaggctttgcgtacttgcgcggataaaaacaatgcagaccgatcggacaaagcgtgcagttaaatttaatccactgcatggcgcgaatattcggagaaatgaccagcggagtatggcccgatcgcttaacccccccccccttcccatccactttagttctccaaatttttgtttcttttgtcaatttgtcgtcttttcattgtagaaatggtcatacagatgttatctttctttgtttggctcggggcgatcagcaaagattagtgcagggaatattggacacaaaagaataagtgactttaagcgccccattgacatcttttggcggcggcaaaatttgaatttaatgaatgtgttataaaatttgttgaaattgcgattagggacggtcggggtaa

SEQ ID NO: 25914 - DNA, 1136 bp, Heterodera glycines
taaattttttatagatttttaaatgttgggattttttttggcttaccaaaacttcatccaaacctggttcttttttttctctttcaaatcgccccaaattttttttccagcttaactaggcccttttaagcttatttccagaaaattttgcatgaattctcatttttaaattttttatagatttttaaatgtttggatttttttttggcttaccaaaacttcatcgaccctggctctttttaaacatgccaaaaagtttaggcttaactttttttaattaaactgatcagaagcgcaccagattttgcaagggcatcaaaaagacaaggaaaagcaccgctatgatgctaacgccagtaactcttaatttaaaaatttttattaatttttaaaacttcactattttatttttttaatagatttttaaatgtttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttatttttttaatagatttttaaatgtttggattttttttttggcttaccaaaacttcatcgaacctggttctttctattctctttcaaatcaccccaaattttttttacagcttaactaggccctattaagcttatttccagaaaatctcgcataaaggctcatttttaaattttttatagatttttaaattcagtgggggattggcttaccaaaacttcatcgaacctggttctt

SEQ ID NO: 25915 - DNA, 1499 bp, Heterodera glycines
aaatgaccacaattgggacgaggaaagcgacgagcaaattgatgacaatgaaaagccaaatgttgttggaagtgtccacacaaaggcgggcaaccaattggccattgttgttgatcatgccgttgttgttgtaactgttgtggtggtgctgctgaacatcatccggtgaaagctgaacagaggaggggggggggggggggggaagatagtacagtgttgtacaaagtggaggaaatttgaatacggtaaaataataaaaaagaaatttatttaatcaatttaaaacatattaaatttttcaaatgccaatgaaaataaatatttatcccttttttcgtgaagttaaaataactaaaaaaaatcgaattatatcaagaaatgttaagtttggcttttatttttgatacatatctcttttttaaagaaaacatttttagtggtataaacaaaaaaaaaaaaaaaatcatttttattaaaaaaattttcaataataaactcttaatatctcaagtagagttcgggtacgggccggacccgtatacgggtttttacgggcccgtaacccgtatttttttcggccgatacgggtttttacgggttaaggatttctagcccgtaacccgtattggtgtcaagcccgtaacccttacccttaaccgtattttatcaaaataccgatctctaatctcaagttaagaaaaaacgaaaaaatcgtgaaattttgaattttattttaaataaagaaatctcgggcgttatgttgacaaaacaaaatgccaaacaattgagaaatggtagcaaattcaaatatttaacaatcggcttctctctctctctcccacctgttgtccgctgatcaaatcgtacagaatttgccggtacacccacaaattgggcgacgccatcagcgcactgagcaaccaaatgcccaaaatgtacaggtggagcagtgaattcttcattttcagctgcctcaacggatgacagatggccaaatagcggtcgccggtcacctgtgccacgaagaaacaatttgaaaatgggcattttggcgtaaattggcgaaacgtctttgaaattgtgaaacggatagagtcatcgaatttgaacactgatcaataaagtctgactgatcagaccctggatcgagtcagtagtcttatctcacaggaaaacaacaaacttccccatttttcttggtttttccttatacatataattcagtttatgaacttttttgatcagtgatcaatcatcaaacagcttttgttttttgaaaatgctttaccccgacaagcgtgaaaatggaggcacatgatgtggtcgaattgacccaaacagacaatttgcaaccccaggagccgagctgccattctaaaagcaaaaaaaaatcggggaataaaataattttttttttgttggcattttctttttggtttttgaccctttttacatcccattctttctttctctttctatccccttttttgctttctccg

SEQ ID NO: 25916 - DNA, 1218 bp, Heterodera glycines
  misc_feature (1080)..(1080): n is a, c, g, or t
  misc_feature (1145)..(1145): n is a, c, g, or t
attggctatctctttttctcctcaacagtaatagggatttcaacccgcattctcagaataattacgccgatactaatttttctggaatttgtttctcggcgcttttgtttgggaaaaatttggaaaattggctatctcttttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaatttgggaaattggctatctctttttctgctcaacagtaataggaattccaaccgcattctcagaataattacgccgatactaattgntctggaaattgtttctcggcgccgttgtttgggaaaatttggaaaaatggctatctctttttctngctcacagtaataggaattccaactgcattctcagaataattacgccgatactaattgttctggaatttgttt

SEQ ID NO: 25917 - DNA, 1326 bp, Heterodera glycines
aaatcaaattgtgatgcttgggtcccatggggggggagaaattttcaaagtcgtgcactttccgtccagccgatgaaggcaggggagaaagaagacaaattttgaatttgaagaaattttttaagaaaccaaaaattttttgaaaaggtttcgcaaaaaatcgcatttcacacacctgcacagttgccggaaacattcgtcgttccaccgggtacagccaggcgtcgagcagcacacaggcgttgaacagcgacggatattcagcgcacgcggacagcgacgaggcggcgccaaaactgtgccccatgcacacgcagcggtccaacgcgagacgattctgacaaatgggagagggaaattatattttatttttccaaacttttcgaaaacagcaattttttgtatgatttgctcaaaaatccaatttcgccgcaaaaaagatatgaaaacaataaaaaaatagtcaattttggctgaccccttccggcccggacgattattaaaaatttggttgaccaccctcactccgccattgagaatttgtaaattttaatgaaggtttcgaaaatgatcatttttccttttgcccccccccccttccactcactttgaattgcgtccaatcgaaagtttggccgagcaggatttgctgttgtccaaattggcggtcgttgttgttgtccgtcgccacattttgcagcaaattggcgtccatttcggctaagatccgtcgcatgtgcactgtctcggcaacccgtcgtttcacatgaatttagggaatttgaaaaaataaatgcgaaataaaatttggcaatggaaactccaaaaactatggcatttccccgtgatcaacccaaaaaaaaacgacaaattttgaaaccgcttgtggacaaatttcgggtaaccgacacactcggaagcagttcgttttgctccaaaaaaatgaaaaatttattcaacgatttttgaaaagcaattttttataaaatagtaaaaaaatggttcgaaaaattttcgtcatttttttgaaatttctgtataaaaaatccattttttaaggaggcaaattccttctgtaacccattaaacacataaggtacacagacatatcaaatgttcgaaattttggagtaaaaaaacgaaaaactccatgtttaagcgaattttatgcgttcgcgcaatttcataaattttctcgaccgccccggctttcccccggtctcccacctgatcaatgcgtgtctcgtactccgtctcgtcatgtggcaaaatgcgcatttccatcggcttcttcacatgcgttgtcgtcggcacgggcggcggcgg

SEQ ID NO: 25918 - DNA, 1298 bp, Heterodera glycines
  misc_feature (1282)..(1283): n is a, c, g, or t
ctcaaaaaagcatcgtttgtaatttgcctgggcatttaaacgaatgttgcagagttcgtcgaggtgcaaaacaatcgaggcgatcatctctgaaataatgcgaaattggtttgttttcaacatttaagtgcataagttttgataggattattggaatgacttaaaatttggtcaatttatcaaattcaaaggattgtaaacagtcatcagagcagtttcataccttaatgagtaacttttgggtgttctgatttgtttaattatttcttttgtctcattcaaaactgacgaaaaaaggcaattgattcagtataaaattataattggcttttcaaaggttttacatttcgtagcttttaaagaattgcttaatatttgctgaccttttctgggaaaacctgccgaatatttgttgccatttgtcaacggggatgaaatgagtccgattttattgagttttcttgccacctcaattgtcatttgggggtccaattggagccggtcactcgctaggcaaaacaacgtcaatgtgttcattggagggggtggcgcatgttcaatgaattttgagccgaattcggagactgatgcttgactgcgtcgctgagtttgttgataaaaccatggtaccagatgcacaacaaatcactaattgatacctccaagtcgcggaatcgatgctccgtaaaaattttgtcagtccgattgaacgggcacaattcatgttcaacaacaaaacccaactgacccctggccacagccgacggactctgaaggcgacacgtaatctgaaggagaattaactgtcattccttagggcaaaaggacaattcaaaaggataaaatggaagagaaatgggacaatgaaaaattatgacttttaaaggaaaccttttctttgttctccccagaaccaacatgggccatcaaaatgtgaagtattttcaattgcaaagggaattcggccggcggtggtgcaaaattgaaaattggcgaagtcgaaaacaaaccaaaattagaagaggcggaagtacaaaactaaaaaagacagaaactgttaaggtctttggtcaacaaatgtgcttacctctgacgaactattcgaaggcaccggcggttgttcccgaatttgaacagttcccattgggtcgggtggaaaatttccgcaaccatttgctccatcggttaaggactgattggatgtcaaacaagtgctgtcctcagtcgattccagttgggcaacggtattttcaatatagcagctccattttgagagtgaccnntgcaggcccatgcaa

SEQ ID NO: 25919 - DNA, 1497 bp, Heterodera glycines
  misc_feature (1413)..(1413): n is a, c, g, or t
  misc_feature (1442)..(1442): n is a, c, g, or t
  misc_feature (1450)..(1451): n is a, c, g, or t
  misc_feature (1460)..(1460): n is a, c, g, or t
  misc_feature (1462)..(1463): n is a, c, g, or t
  misc_feature (1469)..(1469): n is a, c, g, or t
ggagttgggggttggcgcgacagaattggccgcctcgcttctccccgccccgccccctccaaataccaacgcggcattttctcacaaggcataacgcccacttccttctcgtattatttggaaaatgattgcttcagggatcacgccggtgtttttaaatttgcgaatttaaaaaccaaaaaattccataaaataatttttatcataaatctctttaaaatttatttccctgtttttcgaaattttgaaaaggtcatttaaatttttctctttttattttttaaaattggccattcattggcaaaaatttcgtagttaagaaaaatgacagctaataagcaattcaacaacagcttccttttccccattacaaaacggcggattggtgccacggcggaaagggcacaaaaatggcactttaaaatgcggagaaacatttcgcggaagcgtttgttgaagattgtgtagatgatcgggttcaccttgagagggaagaaagtgtggtcaaatgccgcgttatttatttgcattttacggtggacgagcagtagccgaaccaaagggcacagagcgaagctcaactcggaaaaacgcactgctgcaacccgcagaggcccacaacgatgttgaggacgaagaacggagtccaaccgatgaaaaaggaagagaacacgacgatgagcacctcaaaggggccgactcattgccagcctaattaccccctaatactcaccctcgtcgccttttgttccgatgccaattccgccgtccgttttgccctcccccggcggactctgcgccggcggcgctgccgcgcgttcgccgtttgcgaatcgccgctgatacttccggttgattttcgcaataaacttttggaccaaagagacgagccgaaaagcgaactagttaagaagaaggcattttgttggtctgatcagtgagtaataataatctgatcactttttacctttttctctgtactttttgctgatttttttttttgcaaaaattcgtcgcattcattcgacgaactttttgagaccaaatgacgagaagcaccgttatttttactggacaaattatcctaaatttgttgactattatgattccgcttttttaaaattatttgtgcctcttttctcattttttcatcggttgcgactggcaaaattttgatgatcggtgagttcaaatcgcttctttgttgctgaacaatggcacattgcttttcccccattcgggagatcgttgcgggagtttgcggcactttggctttgcatccgccgcaggggcgaagcggcgcaaagggaaaaacgatgggagtgacctttgtcaattgtttaaactgatcagatcagctgatcactttcaatttaaaaggcgataaactaaagaaaagattacaattcatcngcctggtgggagtgggccggcttctgctngcactgannaatggaaantnngttcantaaaagactctccgctcgctatcactga

SEQ ID NO: 25920 - DNA, 1371 bp, Heterodera glycines
atttacaaaaataaaataaatttctctcccaacagccaccttaccgcttccaaccaccaccaccaactgtcatgaacaacggccgagctcctccaactcgtcatctgcgttacccccatcgcccatcaaatgctcaccactgtcacttgacgagcggctggccgcgttgatcaaacggcgttcatcgcttgcgacggcgtccgccgcgacgacaccaaatgccatcggcgctggaacgggcgatgtgtgctcctcccacgcactgctgctggtagtgtcagtgctggcaacagtgttagatcctcctcctcatcagcaaccgctgccaccgcttcctcatccatgtccatgtcgttctcttcgtcggttggcaaaatggtggcgcccgcggaaacttcggcaaccgaagcgtcggaagcggccaaagcggcgctggaagtggcatggaaagaagacgaacaacaactgctgcagcgacggcacgctgacgacagtgcattgttgctgccagcaactggcggcggcggcgccgcaacaccaccactggtcggcttcggcacaggtatgccgtcatcagacgctgtggcgagtgcatatcaaacggcaacgacgactgaagtcgtggtgccaaagtcgtcgttggcggcggcaagaagtagtagggcaccgttgacgcagtttggtgggagacacaacaacaacagcaataacaacaacagaggctggccaacggcgtggaaccacagcggcgccgatggtggtggtgccgttggtggtggtggtggtggtcgtgggcgctatcaccattatcatccgcaacagaaacggttgtggaagaacaacaatagttggcaacggaataatcaacatcgcaacagcaacgaccagttcaatcagcagcagtcgcaaagttttggtggtggtggccaaaaccgtccatggttcaacaacaaccacaaccagcagcacggccagcaacacaaccggcatcagacgctgtcgttctcgtcaagtggtgcaacgccaacaacaagttactgtagcggcaacatgaacaacaccaccagcggctacggtagcggttttggcggcgtcaacagcagcagatacagaggagggcgacaacagcagcaacatgaacatccgctgcaacaatcacaaattgactacacccagcaacagcataaccaacgagccacatccagcagcacaacaacaaccatggacacaaaaatggtaaggcactactggtgtggggagcgggccaggctgttttcgcgtggggcggagaaaattccaaaaaatttagttccgtataaaaaaagatcgagccaaaaaaaggtggaaaatttgtggtgatgaactcttctg

SEQ ID NO: 25921 - DNA, 1133 bp, Heterodera glycines
gcattatagtgttcattcccaaaaatggaggaccatagtcaacagcagcacacaaaaataggacagctaataaaagacaattcggactagttgtgtgcattggcaaggaccaaatcctctaaaaagtgtataaagatggtgtgtcacgcaaccagtgaacagctgttagcactcgtggaaatttgtctaaatcttgtcgcttcgcgtttccaactgactagccgacagaaaagaagactgatgccctacgtggaaactgtgcgacggatgagcagagcgagaagtgaacgcggtgcgagacgtgtgcttgtgcagaaaggatcaggattcggggggttgtttgccgccctcctaacacccgtgctaattgaagtagcaaaatcatttgtcaccaaaaacgcataaataccccacaatttgttgttcacgctcacatttttgcaaaatggctaataaatttttgcttgttccacaagaaatttaccgagggctaacctcagcgtcagatacgggagtcattaatttggatgcggtaaggtatgacctggaccgtgccaggcgtgaacggactaatccaacaacaaaaaatgtccggtacaatcaacagcttaggcgttatctgcaaatgagaagggagcttgccgatagacctacaaaagttgagttaaccaagggcttgagtgttttgctcaagcgagatgggggtgttgatgatgacgacggcgaagtcgtcaacactcagccacggcctcccgctccaccaccacctccaccaccacctcatcacccatctcaacaacaccaccgtcgccctcccagccttcccgatcagcaatcttcctcatctgacgatagtcatccgcctcatcctcctcgtccaccacgtcctcagagaacaaagaaaaaccatcaatcttctctgaaacatgatcgtttgaaccaatggcagcaaaggcgtcgtgacttacaacaacaacaacaaccggtagtacgtgatctcctcgctgaagcagcagctgctccgttacctgaaagtgacgatgacgatgaacaaatgttggaaggcgggtatctgctgccaacaccgtcacaaaattatggagacataccagtatgccagactatgcagatga

SEQ ID NO: 25922 - DNA, 1456 bp, Heterodera glycines
tttcaccaatcatcttttccatttttaaaattaaataccactcgtggtcgtagcatccgagtgaagcgattaaaacaacacaactcacgttttattcaaaaattattttaattaatattttctatatttttttcatgtaaatattatatttttagagtcataaataaaattgagttttttgctgtttgtaatttatgaaaattttcaattccatagatggaaataaaagtttaattgttcaagtttgaaatcgcatcgatagtttgttaatgaaaaaagaatattattattttatgattatgcactttaatagtttaaattatttattattttaaaataaacaattaactaagtaactttttataatatagaatgttgcattggcaaacaaaagaagaaaaatttagggccttaaaatgtatttttgaattattagaaattccagaaattgcttttgcattgaatatcattcagattttttcaatttattgagtaatttaaatttatttccatacattaaccaacgagcgatactaatgaaaagctttatattgctgttacatatttttcacatggaaaaatttctacggaaaggatgaataaaaattatttctttcagataagcggtatctggcagttaaacaaaaaatttaagaacttaaagtagaaatttagtttataatttttcttttcttttataacgattttcgtaacttttaaatggtaataaaccgatgatcgctgaattttagatatttttttgagttcaacgtcaaaaatatttatgtgatttaataaatttataaaaattcacttttttagatttgcaagtcattcttacaattaagaaatgataaggaaaataacttttcataatttgtaaaaattgtttaaagaaaaatgtcaactttaaaaaaatatacattatttaattaatgctaaaaagtattccttttttgcgttaaatatataatatgtatgagttaagttgaaattgaagtgaaacgcaaaatgagtgatgctcaccagcacaaccaactaagcaaatcttctccatttctcatcggttaattggcgtcactttccaaagcgacgccatagaacacctaatttaagaaagaaaaattagtgatgaaggaaatggtgagagacaaaaggagagagaaaggagaaaaggtgagagagacagagaaagagagagattgagagagaaaaggagagagataggacacaagcagaagagagagagagagagaggggagaaagaggagaagatagagagagagatagagagagagagagaaagagagagagggggggttgtttttttctgtgtgtaactttttattctttagaaatttttattgcttatgtttagggcataaaaaatatggatataaaatggcaaaatatggccataaaatattgacataaactttttggttatttttgacat

SEQ ID NO: 25923 - DNA, 1330 bp, Heterodera glycines
cccccccccccccatctgctttgccctttgtccttaatgcctgtgcaaaaaaatagaaggagacaaaagacgacaaatggatgcttgttctacatttcctttatttttttaaaactaatattgttacattttgggtagtaagagtgaaaacagctaaataagtgtgatttaggagttcgacattttgaaaatgcatgaacatgtatgtcgaattctaagttaacaaaatttattcatagcattgaaatttcatctcaatatttgcactttaattagccggacaattggcaattaacatgcacaatgcgattagacgagcagatccctccggcgattatgagcttctgcagagagtcggtagtggtaagtgcacgttgtgataataaataaatacttcaatttttggttatttcgaatcacttacactttggctaaatttgattggttttacattatcaggttcctatggggaagtgttcaaagcccgtgatgtccggtaataaaggtcaattttataaaacattttcagtttcttacaattagctcgggagaatttgctgccataaaaatcgtcaaattggagacgggcgacaacttcgcagacattcagcaagaaattctcgtgctcaaagaatgcgtacatccaaacatcatttcgtattatggcagctatttgaagcgcgacagactttggattgtgatggaatattgcagtggcggctctctgcaggacatttacgaaagtcagcaatcaaaaactgactgtcaacacaccgtccccttccctttaagtgatcggacctttggcagaactgcaaatcgctttcatttgccgagagacattgcacggccttaaggtacggactcaactgcttgtcagtcgtccattataacatggtacaaattcagtatttgcaccaaagagggaagatccatcgcgacgttaaaggggcgaacatccttttgacgcacaatggcgacgtcaaattggcagactttggaatcgcggcacaaattactgcaacgattgggaaacggaagtcgttcatcggttcaccctattggatggcgccggaggttgcaaacgtcgaacgcagcggtggctacggctcggagtgcgacgtttgggctgtgggaattacggcgattgaactcgccgagctgaagccgccttattactatctcagtccgctccaagtgctttcccaaatgacaaaatcgagctacaaaatccccaaactgaaggacaaaaagaattggttcccctcctttttatcctccaaaacacaacaattcgttcaggtcgtccgccttttcaagttttatcaaa

SEQ ID NO: 25924 - DNA, 1088 bp, Heterodera glycines
acaatcattgcaacacatatgctcgcaagacaaagcaatcgaaagagcaattagttgagtgttatttaaagcatcgtcaaagacgaaatagcaataatacagttaacgggtgaagaccctccaaatgacggattttgtacgacgacggtttccatttccatccaccggtggtgcgtatttcttcaaaatcttatggaatcggatcagcaaagcacaactgtgataaataggatttgctgttggtaatgccatcattccgaaactaaggaagttacaaagttaaatggcaaagtgaatggaacgacggacttgtgaaaagatgaaggattggaggatgccattctcgactaaccatttaaggaagtggcgagtctcagcacagggatgggcatgggcaaacaatttacgattactagccgacaaaatgttttgtccaaattttcggcaatgcccaaacagcttggcataccaaatcatcactttctatgaatataaaaattagaagaaacttgcgatcagaacacactttctcaattttgtgatccgctttctctgggacacgcacgggcaaacaactctttaaggcactgacaatttcgcaaacggccgaatgcggaaaacccatggacgaagagtgctggataattgctttgagaccaatgcgacggtcagaacaacgcgaaatcgacggaacgatcattccccggtcgacgtcgattaaggcaatgtcattgttggacaattcgtctttcgggaaccgttccggacaaatgagttcgtttattttgctgaggttgtacctaaaacagcgaaagatgcatagaaaacgagacaataaacacacctgagtataccacaaatataaggcgtagggttaaagcaaagttcagtttgagaatcgggcacaatcggaattaaagtgtggggccattccaacggggccaacaaacggacgaaagtctggacagtcgttgacacatccctcacctgaactgtttacagactaattcgaccaaataaatgaaaatcagaattgacatttgcaccggtcacaatcactcgccgctccgacagcaaacaaagaaata

SEQ ID NO: 25925 - DNA, 2411 bp, Heterodera glycines
atagatattttgaattttgttttcttaatggtcctttaaaaaatggttattcgcgaaattcgtttgatttggttcagtcagcggccgcaaaacaatcaataaaattttatttaaattttgccataatgttttattaacattgttaaaaagctacatttttattaatttaattttttatatctttcagtagaatagacaaatttagcgtgtaaatgtttataaaaataattttaaagaatttatttgtttataattgttaaatgtttcattaataagattaaactattaaaatttttaatctccatttgtctttcctctcggtcaatcccttttgtgtaattgtaatttttgggtttattgtaattaatattcttcactttgattttatttaatgttttttcatttcttatataattaattcgtagtcgataattttcgaatgcaaaattaacccttttttgttatatatttttgatttttaataaatcaagtattccgtaatcctaatttgaataaatattctttatgtttttattacctaaggccaaaatctgtcctttaaaaaaatatataaatgataatattttataattaagactatttacgaaagtgattattaaataaggattaaattcatgaatttttaatatgcatttaaaatcaaagaaaataaaaaataatacaaattaacccgatcattttaaaaatttcattataacatatttatgatatcaattttttttcaaaatttattattaatatcttgttttattttaattattagatttttaataataaaatttatcttatacaaaaaaaagcataaaaatgacggctatacatttagaatccggcaaaacggcaacgtatgaaataggtcattccaaaacatttaatataaaatactttataaaatgaacaatgtttttttaggttattaaacttgagctataaactcaaaaaactattattcaatatagtgtaattaaatttggtctttgaaactatatttataaataatagttaacttggtaaaccttcttaaaaatatattattaaattaaaaaaagtttatgaatacttatgaaagatttaaataaaaagaaaacttaagaattaaaataaatatatttcataaatatatgagagctaatttttttattaagtttaaattctaattaaaaaatttctattaatcatttttggactatattaattttataattcataaatatatttctgtggtaaatttattattattattattatttttcttagtattcatgaactaagattttaattctctttatagatttactctcatgacggattctctgttcctcatttttaaagattggaatgttttgtgctttttagtttaaaattataatttgttttatgtatttaattatgtatatttaaaaaaaagaatagtaattagttttatacgtatatttttccttactatttattgtttatcttaaaaatctttctttgaacatatttttaataaacagtgtttaattttcgttatatatgtaaaaattattgcacagcttttgcaaatgtttaaaccaaaaatattttaaaaaattttaaaattattttttttgtaattttcatttcgtttagcttatccatcgtttctctttgcttcatgaccccttcgaaaagtcgttgacttaccaacccctttcacagaatgcctcaagccccaaaaaatttcttttttcaaatattggctatatttagttttttctaaattttttttgaaaaaccgcaaattttaaatgcgagattaacataaaatgtaaatgaaaaaaagcagaaaaatgactaaaaatgaaaaattagtcacgcaatttcttttcctaaaatggattttcggggttcacagattttctcattaattttgactcacattttcagtctcaacttttgacagtttgtcctcctccttttgcttcgttcactctgtccctttctgcctatcagttattttttcaatcgtttttaaaaaagaaaaattgttttgcttccttttttaaagcaacccaaaaccaacgaaattaaccaaaaatttatcattttttggacaaaatcttattaaaagaattttcctcaaaatttcaaatttttcttcctgcaccgcctgacacgccgcaccttattccccaaataatattttaatttgaaaaataaaagtaaatgcaaaaatttagtcattaatataaattcattataatattgcatttaaatattctttattaccttaaaaacaacttttattctctgttgtaacttataaaaataattgatatgttatttagagatatttaaaagaaaaaataaatttgattatgtttaatttatgttgcgcatattttattatttaatgccttttgttttta

SEQ ID NO: 25926 - DNA, 916 bp, Heterodera glycines
  misc_feature (809)..(809): n is a, c, g, or t
  misc_feature (850)..(850): n is a, c, g, or t
ttctatgcgagggtttattaaccacgaatattgaaatttttattgttggcgttcatgaaccagtttttcaaaacagcaaccgggccaatttagaactcgcactacccagcaatattgacttcaaacatattttaaaactgataaatcgcacgtatcagtgcgctgtatttttaagattgtcaaaagtactaattgcgtttctcttattgctttcgtgtgcgatttttcttcatgaaattggggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaaccacgaatattgaaatttttattgttggcgttcatgaaccagtttttcaaaacagcaaccgggccaatttagaactcgcactacccagcaatattgacttcaaacatattttaaaactgataaatcacacgtatcagtgcgctgtatttttaagattgtcaaaagtactaattgcgtttctcttattgctttcgtgtgcgatttttcttcatgaaattggggaatagaatggtcagcaatcaatttcagacgctttttgcaggtttaacgtataaataatgcttttccagcgattgaatataatcacaagcaatttcaattattgccaatgaagctttgcaagaaaaatgatgttgacttctatgcgagggtttattaaccacgaatattgaaattttttattgttggncgtcatgaaccagtttttcaaaacagcaaccgggccatttnagaactcgcactacccagcaatattgacttcaaacatattttaaaaccgataaatcgcacgtatca

SEQ ID NO: 25927 - DNA, 1127 bp, Heterodera glycines
  misc_feature (25)..(25): n is a, c, g, or t
tcaacggcgaggcagatagcttcgntgagtacattcaaatcttctaataacaaaattgctagaggagggaaagagcctaaaatttgcgcaatttttattgctgcagaaattgggctcactgcgccataactgaacgctgaatttatgtgtataatattttatacatttgtaaatgcctcatcctaaaaaaacaattggactcaaaaaagtcaaagtcgcgcagtcacgattaaagactgataaattgcccaaatgatggtgcaattgcgggaggcacaatccacaattagcggataacccgtcggaaaatggcggacaaatggactaacctgttagcggagagccagtttattggatatctgatgagacaattggagagggagtttaaggaagatcaagcaccggaagtgtgcatgtgttagagttgtcggcgtggaaagtggagcggggacagtggtggtcgcggaggaggcatgggacgtggctacggcggagccagtggacgagggcgcatgagctaccagcagcacgcgggccaaactttggacactgaggctgagcgactggtatggaagcacgaaaaaggtccaagacatttcggaagggggaaggaatgttgcatccacaattttgaataataataattttcttatatgtaatcatccttttgctttatttatttatttttgccttaagaacggccaattatgttttttaattcattaaaaattccaaatttccggcgatgccttccggcagtgccgcctccctcccatgcattggatttttgaaaaacacagaaaaatttctgaagcaaaaaatataagcttacggttccaaatcaaattaccttctgtctgctcagttcaatctctgtggcgcatttctataatattagtcatttgaaaaaaataattaaattatttattttgaattattgattaataaagtttttaatttattttttgctttcgatttatttattcaagtaataaaagtccaaaagaagggacaaaggccgcttatactttcggaacagaatgatagtccgggaaacatgatggtgtcagatctccaacttgaaatgaatcttgtaaaatattttttacttttttcttgaaggtggg

SEQ ID NO: 25928 - DNA, 2226 bp, Heterodera glycines
agaaaaaggaaaaaagatagagacaaacagagaatgggccccccaccatgagaggcaaaaagaatcccattcatttattatttcgcttgggttggcttttgatgggtagcgaaggaactgccggatgagtgaaatgaaaaaaggaaaaaagagaaattagggaggaggaacacaaaagaaaacaaatgggcgggggcggggagaagttgctgggcaagtgcgtgccatcttcgctaataataaatggagtgaaccaagtgggcatggacggcacttccaaaaacctgccgctctgttagacaacggaatgagagatagcggtttaacgagagtctcgagtcttcctctcaagaagaaatggatgactaatagaaaatttggaaaatttaaaaaaaactaattaatttaaaagaattccccaaatcgaatggtgctgacattcaaaacatgtctatgtgcacataattgcataaattggagcttattataaataatgtcgggactgattcagtcggagcaaatcgatggacggaggccaaggccatttattcactcattacctcgcgcactcattgcccccccccctcccttttcttctcctctcaattggcctccacgtggaaaacaacaaaggatgacttcgacaattggaaacactgaagggtttcagacaaaagttaacaaaccaaactataaaaatcaaattttgccacatttttaaaatttaattccattaaaatattcgtcaaatattatgaaatatttaaaagattgggcacatttttgcgcgtacgcctcagtcaatgagacggacgtcagtcggtcggagggttggcgcgtgcctttcccagcggaaggtgccaaattaaaatgacaacagcagagcactgacaacgattgattttgacaccaaaaaagtcaaaaatttttgaacatatctatttattttgttcatcaaatggggagaagcaatgtgccattggcgtcgtaggcattttgaaattgttaccgtaacgtttttgtgcatggttatgtacagtaatctgccgttgtccagcgctttgtttggttggctgcaagggaagaaaaggggtactgtagcgccgggttggcgccaaatgcgcctaaattcgaattgccatttgaagttacacacgccgcggcacaattggacggtgatctattggaagcggagaaaactggcgaggaattggtacaccattcgtcggccaatcgacgcggcccggacggatgtggccacaagcttaagacggcactcgccgttgtcaaagcgtacggcgcctcgtttaagcattggttggtggcatttatggaactaattaggtgcaaaaatcgcttaattttaggcattggccatggcgaaaaaagaagaaaaccaccaaaaacaaccaaatcattggggaggggagaaaagggcccgaaatggacgaacatttgcgagtaattgaccattgtgcggcaattgcggagcgagaagaataccaggcaggcagcaattgccgtaaattcggcatttttaattgcatttccatagagaggccattttggccatgtgcagcgacgacggcgacaacggcgcggggcccgccccgcacttccgcgtccgcgcgaaatggacgacaaaagtgcactgaagacattgacgcgaatgctgaaaaagcggaagaacaaagcactgtcctctgctgaccattggacaaatatcggcgtaaatccgttaattaattacgatcccgactttcccagccccgccgaagaatgacgtgcaatcctgatcattttctgatgtagcataaattctatgtttaattagtttatttttagttgattcgttggggacgacgcacaattcgcggcattcgaagacccgcaagtaattgtaattaatattagtgatttgcaattgctcctcgaatgatatgccccataaaaacgaaaattttatcttcagaaatcatactttcggacattcctacgaaaaacctaaatattcttattgtaacattttcagtacatggaaaaatattaagccttaaaaaaacaccgacaaaaagcaaaaaatggaaaagtcagcagaaaaaaagggagtaaaaacatacgacgacgaagaataaaacgaggggacgaagaagaagaagaagaggaagaggagggagaagcgacgaacgacgaagagggggacgggggaaggtcatcatcagaaga

SEQ ID NO: 25929 - DNA, 1098 bp, Heterodera glycines
ttttgcacattaattttaagggaataatttttttttggcctttttaggagtaatttaaggggaaaaaaattaattaccaaatattttgggctttaaattattttccataataccccaaattttgtttgttatttttctaacaatctgtatgcaaaatttggtgtagatttacatagggaacaaaagctacacatagaaaagtaaatgttgttctttacattattaagaatgaagagacagtacataaaactgagagaaataaagataaaaagtaaaggtgacagaacgccaatttttttttataattgtccataaaatttatttatcgccgtttttttttcttttttaccatccatgacccgaaccggaagtcacttaatggattttcggcatgaaaccacggcagcacaaacattccattaatttttgctttgctgaagaaactttttcatataaatttcaataaatttttaaaaataggaaattttgcataataaatgattaccagggttaaaaaatgttttgattttgcatattttttctgcgcatatgctacgaagaaaggggctcaaaatagcatttctgcgttaaaatttttttaatttggtgaagtttttagtgcatataaaagcatattttgggggttttcgagaataaatgcatattttgccatttttgcatttttagagcatatttcggtcatttttggcaaattttcataagaaaaatgcaataaaaatgaaaatgcacccctaaggattgacctttttgagaagttcaaaaatatactcttgaaaatcgaaaaattttgaatttttgggagaacttttgaaaaaaaaattgttgatataagaaaaatataattttggttagcatatgataaaaattttaaaaattcgaaattgcatatataaatttagaaaatcaaaatttactccttagctattgttttgatgtttttaagtcaattctgtatttttacataattttagcattttttgagggttaaaagccattttgggtaatttttaagacatattttagtgcatatttgggcatttttcgggtttttagggcatatttgggggatttttagtg

SEQ ID NO: 25930 - DNA, 1049 bp, Heterodera glycines
  misc_feature (35)..(35): n is a, c, g, or t
tttcatttgcccccaaacaatccgcttatgacggnccgaaagaaattcacaaaaattggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaattcacaaaaatttggcaccggaaaactccattttttatgggcagcataataagtaaacc

SEQ ID NO: 25931 - DNA, 972 bp, Heterodera glycines
  misc_feature (964)..(964): n is a, c, g, or t
ttttttttttgggggcagtcccccagacccgatgcccacatatttttggggaagctgttttccttcgggaaaagtttccctaataccctgtactttaatttggcgtggattttttgctccccataattgttagagtaccccaaacggacacttgaaaaaatttttttttttgttttcggggcagtccccccgaaccgatgcgcacagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctcccccataaatgtttgagtaccccanaacggaca

SEQ ID NO: 25932 - DNA, 1624 bp, Heterodera glycines
  misc_feature (622)..(622): n is a, c, g, or t
aataaaagtcccgatttttatacgcaaacacaaaaaagaaagtgttttcctactatttagagcatggagaagccaggaaaaaaatgcatttgcagttttttgtagccctggttatttcccttttgttattagtctgtctctacacggatttgattttctaatgttatgcaaaaagaaatttattcgtcgaaagaaagaaagacataagtttacctcagttaatatcaaaaaaatcaggttacagaattcattagaaagaaaattctctcctcttaagagttagtaattgtaaacggacgagttggttctcgctatcattcgcttccgtgagaatgtgcacgttgcccatattggccaatatcaaagccacaagcaaaaagcgacttcggtcgtaatcattgggcagttccgataacatctgaaaactgtcttctcattgtcctttcactgacaatgaatcctttccaatccaccttagtgaaatccaattcagaaccaatttcccccccaaagcgctccagcagttcgtctccatatgcgccagtgcaaaagtcacggtgcaaatgttcctgttccagcacctccgtcatcctcatctcccacttctgaaggtgctcactgnaacgtggaagttgcttgctcagaggcagtccaataccttaaaataaaaagtcaaattaaaggaaggcattgccaacgtgacttgcgaagatggaaggcgatgatttcgtcgtagtccatttgggagattggacgaggaggcaaatcatccgcgtttagttaccttccgcgaaaaatgtgtcatcgtaaaaattgttctacgaacgaccaattgaattattaaatgcataattaaataaagaatgaatgacctttgtggcgagggattttgcccgtttcctttgaacggtgtttaaatgctgtaaaattgcataatcaatctagagacgcttccactgtttttttacatcaaaaccagcatataaattctgcatgcggccgatcgaattctccaaatcctccacctcgagaaggtcacccaaattctgatgctcactctgctcaaattcgtcgtcccaaacctcatcttgcggtactgataacaaaattatcccgaataaaatgctttaacgcacagttaattatctcttccgcaaccaattcgtccatcggatcgtcaaaatcatcaatcacttcgtcgttttgaacttcaccatttggtgcaacgaaatcttcgtctaacaattgattcgcaaagataaaaaggcggtttgatggggactgactttgttcggcctgcccctctccgtccgtttgttcctcgtcactcccaacatgatgctccaacaccgggtcaatttcccggttttgcatcacacgacgcattgctcgctcggcacgttcggcattctattttcattgaaaaataaagtaacattaggaacagcacttggtattctttacgacgccttttctttaattccgaacgacgcttttcctcttcgtggattaacgggttaaggacgagcacagccttaaaaggcgtacaaatgactgacactccgaactcattaaatgcttgaaagtactgtacttgatctgcgataaatgaattaaaaagtcc

SEQ ID NO: 25933 - DNA, 1449 bp, Heterodera glycines
ttttgaccttaatctcatcataaggaaaaagctgaatatccctaccagatacaggcagttgtcacgctatgaacagcactcactcattcattttctcttacacatctgtactatctcgcacctatctctaactgttctcttccgtccattgaccatctctgaccttctcttacacatctgtactctctaatctctctctgactgctctcttccacatctgtactctctctccagtccacggactgctctcttccgtctctacactctctcacccgtatcttacacatctgtactctctcaccagtccacggactgctcccttccgtttctacactctctcagccgtctcttacacatctgtactctctcttcagtctctgcactctctcacccgtctcttatgcatatgtactctctaatctgatctctgagagagagatagaaagaggagagaaaggaaaagagaaaaagagaagagggagaaagaaagagaggagagaagggagagagagagagaagaggagggagagaagaggagagagagagaaagaaaaaaggagagacaagaggagagagatagaaaagaggagagagagaaagaaagagaggagaagagagagagaaaagagtagggagtgaagaggagagagatagaaagacgagagagagagagagaaaagaggagagagggaagagagagagaaagaaagagaggaggagagagagagagaagaggagggagagaagaggagagagagaaagaaaaaaggagagacaagaggagagagatagaaaagaggagggagagaaagaaagagaggaagagagagagagaaaagaggagggaggagggagtgaagaggagagagatagaaagaggagagagagaggaagagagagagatagaaagaggagagtgagaaagaaagagaggaggagagagagagaaaggagagagagagaaagaaaagaggagggagagaagaggagagagatagaaaagaggagggagagaaagaaagagaggagagaagggagagaaaagaggagggagtgaagaggagagagatagaaagaggagagagagagagagaggaagaggagagagatagaaaagaggaggaagagagagagagagagaaaaagaggagagggagaaagaaaaagaggtgagagagggagagaagaggagagagatagaaaagaggagagagagagagagaaaagaggaaggagagagaaaagaggagggagagaagaggagagagagagaaagaaaaaaggaaacagaggaagagagagagagaaagaaaagaggagaaagaaagaaaagacgcgcgagagacagaaagaaaaaaggcgagagagaaaagaggcgggagagcagaggacagagcgagaaagaaaaaaggagagagatcgaaagaggagagacagagagaagaggag

SEQ ID NO: 25934 - DNA, 1518 bp, Heterodera glycines
gaaacttaattgaccgaaacacggtgagatttgacgagaaacccaaaaaacgcacgcctccccaatttagtcattgtggagtggttggctgaccaaggggccccaacacaaatttttttcgccggtgacacgggcctttgtgccgacgaagaagcgatcggaaaaccgaagctgagtccatgcaatgttgaagcgaaataccacgacggaacaaaatgcacccttcttggaaaaggggaagctgagttcgaattcggagggataatccgaaaagggcaattttacgtctccaagagagggtcattgaatttgttcggcatcgaaatgttggatgcttttggcctcatggacgacgtcagaaagaaagtggccatgacattgaatgtgaataatgtcaaaaaggaagagtctgttgttgatgaaacactgagcagactcagggcgaagttccctaatgtcttttcgacaaatttgggccactgtaaaaaggcaaaagcgcgcctttccttaatggctgacgcaaagccagtgtattgcaggccacgtccggttccttacaacaccaagttggttgttgaagctgaattggaccgtcttttggctgcaaatgtcatccgtcctgttgaccacactcggtgggcagcaccaatcgtggttgtcaaaaaggcagctggttcggcacgtgtatgtgctgatttttcaacgggtcttaacaatgttttgctgtcgaatcagcacccgttgccagtgcctgaggacatttttgcgacactaaacggaggacatgttttctctcagatcgatttccgtgatgcgtatcatcaaatcgaattggaagaaggatcaaaagagttgtgtacgatcgcaacgcaccgtggtaattttgagtaccagcggttgccattcggagtgaagtccgctcctggcatttttcaatccattatggattcgatgttggcagattgtccatttgccattgcttatttagatgatgtcattattgtgagccggactcggaaggaacattggactcatttggcagaagttttcaaaagaattgacaattttggcttttggatcaagccagagaagtgttccttcggcaaggaacgaatcaaattcctcggattcatcattgataaggatggccgaaggcccgactcaaccaaaattgaggcaatccgaaggatgcccattccaaccaatgtgtccactctccgatcatttttgggaatggttaaccactaccaacaattcgtaaagaatttgcggttcattcgccacgttggacgaccttttgaagcaggacacggtctggaattggtccagcgaatgtcagaaagcctttgatcaggtcattggcacgcttcagtcggaccaactgctcacacattatgacccatcacaagaaataattgtgtccgctgatgcctctgagcatggtatcggagcagttatttcccatcgttatgcggatggaagcatcaaggccatcgcgcatgcgtcgcattcgttggc

SEQ ID NO: 25935 - DNA, 1118 bp, Heterodera glycines
gctttttttttcaataaatggaggggaataaaatttttaattcctttttaactttgggaaaaagtttcaaacgaacttttgaaaaaatcgattttttgtttcataaatattttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaatttttgttgaaatatttgtcgtgctctgaagggcgtgggaggggggggggcgaaggcccaccacgaggccgcgaagaggccgagtgagtaccttcggtgcaggaaaattat

SEQ ID NO: 25936 - DNA, 1001 bp, Heterodera glycines
cttctttaaagtagcgccatgttttttataatatttaattggatttatttagaaccaatcggctaacagtgggccattgacttgcgcagcgtctgctgtgttgttccacgcccatgggtctcatcaccagcaaagtcaccatgtccaccagcaagggcattctccccgacatgctaactctccccactcgtccatgtccccgcaaatggccgctgtggctattgggcctcctcctcccaatccggcgtattgtccccccaattcttcatcgccacaacatagacaacaacaacaattcgcccatcatcatcagatataccatgccctaaatcaaaaccaggcaaaatggctaggattgtattttgactcattagcattttttagacacccattcccaactctcaagttcctttgaccaattctgtggtcggctttgaagtgacggcaaacaacgaaaatgccattcaacaaaacgctgatcaattttattgctcttcgggtcaaaccttgttttagtaccaatataatatcatcaatcacataatatttcattgcaggcacttcgcatcaacgctatccgtccgaactcgactccatccctgcgccatttttcgacgcagccacaacaaaggctcctgttttcaaatacgtttccggtgtcactgaattctccaaagtatacaaccatgcttttgattaattaattgaccctctaattgttaggcatacaatcgtccgttcatttccgacaaaccaatgccattgcattggtgctcggccaattactatgagttcgaccggagcattggcgaaatgttccaggccgtcgccgattgtcctcgcatttttgtggacggtggtttggacagcactgacattgcccgcttctgtttgggtccgttgacaaacacagagagaacccacgcatcagaaaagtgcaggtgaaagtcaagaatcatataataaatatgaatgaacattaagtaaataatcctactttt

SEQ ID NO: 25937 - DNA, 1681 bp, Heterodera glycines
  misc_feature (1509)..(1509): n is a, c, g, or t
  misc_feature (1606)..(1606): n is a, c, g, or t
  misc_feature (1653)..(1653): n is a, c, g, or t
gtgaacgaaatatctgattttattggaatcaccatttctgttatattttgacattgggaaattgaaatctgaaattctttatggttttcaagtaaaaaaggcagcatttttttgaaacgcattaaaaacaataataagtgctctaatttttaattttaatttatttagtttgactatatatttttaagttttaaaattctcattttgttcgcttattttcagtgttcctattcccacccttctccaagtccctcccccttttcttcacctgctgctgatttgagtatttatgtgcgtttgccaccctttgctgtcggtcgcgcatttgttggacgagggaaggcaaattcgattcgatttcactcggcgcgtattgccttaggatttgattttcgccctccaaaagtgaaacctgcgaaaacagaggataaattcgaaatgaatgaacaattaaaaaaaaactttgtcctccaattcgacgatggtcgaccgcaaaagtttcatttctttgcgcacagccaaagtcaactgagtcttcaccaagtcctgtaatttccttagtttcgtggcatattgctgagttttgaatgctcaatgtaaaaatgggaccaaagcttgttcaattttgttgtcaattggagacggataagcgatggacgaagaaccaattgcacttgaggaagaatcaaggacagaatttctggaaccgaaatcaaaattgggagtctctgacaatcatttgttaatgcctaataccgttgcgtcaaataatccgagtccaaagcaattggcacaaccgaatgggacggtgaaatgtcaaagtttgatatggctgaactggcaggaaagttggacttcggcacccgctgctggtgaaaaaaggaattagacaagctaagaaaaatttataaaaaatcagaaaaataaaaaaacctaaaggaatttaaaaaaaaattaaattaaaaaagttaattgcctgttcaaagggaccgacgtgttgctgaggtgcgacggcggaagttgaggcattttgctgttggttcgtttgaaggacaaccgcggggaattgggctgtcaatggtaacgcaatgaattttatgacaaagaatgttcctatcgtttcccttttcccccttttgctcaccgttctgtcgcatcgtttgctgctgatggcacggctcgccataatttcgcccgtcagcgtcaatggtcaaagtgagtccaacagaatgggcagaatcgatgctgaagtgaagaaattccaaaaaagtgcagttagtgccaaaaaacgaaagcgaggtttgtgatttaaaaattggccgagttaagtctcaaacggaccccggccaaatccaatcccaaattaataaggaccagaagacacctgggacagggcctgggttaaaactaattggccttcgcctgacctctccgagtgtttgaaattctccaatgttcctttgttatcatttcgcgcgcgtttgatgagctgaaaataactcaatattnaaaagcaataaaaatgccgaaaatactccgtttgataaataatattttttgatttcgcgctattccccgtccgttcctcaatttttcctaaacttgntcgccgcatttttactggggacagcggcaagcacagacggtgatacngtctgtaacgcatgcgcgaagatttcgt

SEQ ID NO: 25938 - DNA, 1424 bp, Heterodera glycines
tcatctgctgcctgatcacactgatcagagccatcaccctttggaggccatgcgccggggggggggaggagggcgcaaattggtagcacctccgtcctccgccgcgggcgggggaccgccgcgccgcgcggaggtgtgagagttggtaagtgacagtgagacttttcttttgtgtgtcccactcattagcgggtccaaccggcgggagaaatggaatgggtggggacagtaacagcaggacaatacgggggagggggaggagtgggacgagaatttcgtcaagagtggcctcctccttctcctcctcctctactggctgtggtgagcggtgggagaagtgaaccaagtgagagagtgtgagagacaggagcagcaaccggacgaatttttttaaactgttttttctagcgaaataattttaaaaaattgattttttaaaattttttacttaaaaatttgtaaaaaaaatgaaataaatgcgttttgaaaaacctaagcctttttactaaaaaaagcatttataaatttagaaaattctctgttttttatgtgcggattctcgcctctcggtttcccgactcgggatcctttcccagtcttgactttaggctaaaaaaaaaaattttaaatcattatacagtgaaaactctaggtgagctggaaaaaacaacataaatctctctcctgctgaagttggaaattttttaaaacatttaccaaacgcatctatctcattaaagttttgcaaaattggttttaaaattcttaaatttggccatttttaggggccaaatcaattaacgcaagtgaaaaattcaaaaaattttcttccaaaaaataatggcttatggctgaaaacgatcacaaccagcggataaaaatggcccaattcggcaactcattaggacataattaagagagagcccattagcatcagcaggtggtggaaaatgatcttcggcagggcttaaccaattttgaaggttaactccctgctgctggggatgatgacgaattgaatgaatgaattgttagcagcaaaagaagcggaaaagaaaataaattggtgggtttctgctggctgctggggggtgggcacataatttccattcgaattcacttccccgtcccctggggggaaagacacgcgcaaatattgaaagatgaaaggcgggggctgggggaagtgaatgggggggggggtaaggggatgtataaaggcgattgtagaaggaattggaagcgctaaaattgtttgaggagctttttgagcgtaattacgatttttacttagatcatttttttaaggcttagatcacatgcgattttcggcactctgataattttagcgctcataatgggatgtataaaggcgattgtagaaaggattggaagcgctaaattgtttgagaagctttttgagc

SEQ ID NO: 25939 - DNA, 1486 bp, Heterodera glycines
  misc_feature (1142)..(1142): n is a, c, g, or t
catttttggccccggatcatataaagtatctttgcataatgcacaatggttaagtcctgatcaggccaattgttccttgtattaccaaaacaagacgttctgtggtgtagtaacattatttggtgctctcattttttggcgccggatcttataaagtatctttgcataatgcacaatggttatgtcctgatcaggccaattgttccttgtattaccaaaacaagacgttctgtggtgtagtaacattatttggtgctctcattttttggcgccggatcttataaagtatctttgcataatgcacaatggttatgtcctgatcaggccaattgttccttgtattaccaaaacaagacgttctgtggtgtagtaacattatttggtgctctcattttttggcgccggatcttataaagtatctttgcataatgcacaatggttatgtcctaatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgctctcattttttggcgccggatcttataaagtatctttgcataatgcacaatgcttaagtcctgatcaggccaattgttccttgtattaccaaaacaagacgttctgtggtgtagtaacattatttggtgctctcattttttggcgccggatcttataaagtatctttgcataatgcacaatggttatgtcctgatcaggccaattgttccttgtattaccaaaacaagacgttctgtggtgtagtaacattatttggtgctctcattttttggcgccggatcttataaagtatctttgcataatgcacaaagggttatgtcctgatcagttcatacgatccttcaattaccgatacaagacacaaatggggggtattaaagtcaatatttatgtttctacaactttttttaactacttgaattttattacaatctttagtgaatgtatcgattaacacaaaataattatatattcctcttcttaaataacaagcanttaactatatagacaatcatgtgtactaaaacatttcatctgaccaagttcaggctgatgtgagcaaatcctccgaaaaaaaccgaatgaattattattgtctacgtattaatattgttatttttggtacccattatctcattacttttttataacttagttaatttttgtcattttgattacaagtatgctgtcactagtcactatcatcttattttttaacattcagtattctactaaacgtcaatttgtcaacgctggtctattccccattcgtacaaactgctattgacccaatctgacgaggtttcaccacaaaacagtataattttctattccaatac

SEQ ID NO: 25940 - DNA, 1576 bp, Heterodera glycines
tgaggccgcgaagcggccaaatgttcccacagaattaaaaaacgggcgcgaagcgcccgtcctgaggcagcgaagcggccgaatgttctcaacaaaattaaaagacgggcgcgaagcgcccgtcttgaggccgcgaagcggccgaatgtcccccaaaaaattaaaaaacgggcgcgaagcgcccgtcttgaggccgcgaagcggccaaatgttcccacaaaattaaaaaacgggcgcgaagcgcccgtcctgaggccgcgaagcggccgaatgttctcaacaaaattaaaaaacgggcgcgaagcgcccgtcttgaggccgcgaagcggccgaatgttccaataaaattaaaaaacgggcgcgaagcgcccgtcctgaggccgcgaagcggccgaatgtcccccaaacaattaaaaaacgggcgctaagcgcccgtcctgactgaggccgcgaagcggccaatgatctcaacaaaattaaaaaacgggcgcgaagcgcccgtcctgaggccccgaagcggccgaatgcttcccacgaaattaaaaacgggcactaagcgcccgttctgaggctgcgaggaattactaaattacttcatttttatcgacgcggcgaagccgcgtcccatagccgacgcggacaagccgagtcccataatgcgatgctagcgacgcggcgaagccgcgtccctgagcgcgaagcgctttctcacagcaccaaaaacaaaactgttcacaccattgccaactgtgcaccctagttatatatatatagagaaaaagggggtttcgtcttaaaaactaatttgagtcgaacggctgtcgggaggggtctgaaagtggtggaagggtcttacaactttttgaggcgcatctgggaaaactataggttttccgctccggtggccaactgagtcccggcggctaatttctcacttttgcttgcgtttgaaggcccgtaactttttttctaaaactctaatcaaaaagtctttgctggtaggaaactaagttgaagtgttttctaatttttaaaaaaaattccaggcctctacctatacttggaagggctgcagaaattggcaacttttcagtaccaactttttccagttcagtccccgttgaataactcattaggctttgacctgagcgcagggtggccagcggacttattgtagagctcggtgagctcgatttttccaaatttaaaaatttcgaaaattttcaaaatttttcgagctaggcctaaaaaacggttttcgggtttttgaattttaagaatttttaacgaattttcccagaaaaacgaagaccacttccaaaacatagtttttcgagctctatcgactggtattttttttggaaaaatttcgattttttcccggaaatagaaaaaatttttggcctgagcgggacatttgagtcccgggcccataactcgtcaggagttggttttagccaaaaatcgtcttagaacatttttgtagagaatttaagctctatcgaacggtgtgctatatgcccggaaaattcaaaaatttcgagctaggccccctagaattttcagaatttttttt

SEQ ID NO: 25941 - DNA, 1476 bp, Heterodera glycines
  misc_feature (1409)..(1409): n is a, c, g, or t
atttttgcactttccaaattacgccacattttcccctcctagtacttaccctttttgcttggtagtgctgttcgacatcgaaaattttcgagacttaaggtcgagaattgacctcgaaactgagacgcgtcactgagactcgagaccgtcactctcgaacatcacactatagtttcgagccgaattttaagttttagaaaatttgtaaatgtaaaaatggaataatttctgggaaaatataaaatgtcgggggccttgttttcgaaaattctcaggaattcgggtcccaaaaaattcggctcaaaaattgcacattactaaatattgtagaataagaaattttttgtttgattatccaatatagattttcagctttttttgtttgtttgtttttccctgaaaatttaagtttgcccaacgggcgcccccgcgttgggcccatgctcgcctggttactgcgttggtaataatactgaaaccatcccccaaatggaggtgcaattggatttaaatgattgatgaattttcgcatttttgaaaaaaaggaagcctccgtataaaaattacggtatatctcaaaaggtcgctggacaatttttggaccataaaatctatggccaaaatggccagaaaaaaaaaatcattttggctctgaattttcttgtagatgaacgaaatttttttcaaattttcaagtcaataaatagtttgacaagcgcttccgagcagtaccaagaatttttaagttactgtccaaaaactcgttcggcggtgttttgtaatgaatttcatgaaaatccaagattgaaatttatgaaaatcaatccaattacatcctccctggcctattgatttcctatcctaaaaattgttcagcgccgttgcaatgcgcaggtgcgttgtgttgcgcaccaccttctccagtgatggcaccacctccgcccatcgcctgttaaatttgaaatttattttgttttattttttaaataactattttttattttccctttattttcatttttgaatattcaaattcggcattaactaacactgaaggttcttttcgttatccagttggccatatattttttaagagctcagcagcaatttttcaaccattatccaaacaaaacaatttttttaaaattatttcaataatcattttaagatgcttgtcctggtgggttgcctgcacttggcccatgcattggagggcgctgtgccgcaccaggtaatatttaaatttaaagccaaaccgttaatttggatttaataattaattaaattagcaatctgtgcctcgccgtccaatgtttgttgtgctcaaccgtcagtcccgacagccatacctgcaacgggtgggctaagacaaatttgatttttgttatttgacatatacatgtaccttnaatgcgtcatcgggggaaaattgattttattgagtacttaagaaatcgcccgcccaaattgcgtaaa

SEQ ID NO: 25942 - DNA, 248 bp, Heterodera glycines
  misc_feature (58)..(58): n is a, c, g, or t
tgttcattcggcagcgcatcaggaagacaaattgttcaaagaggggagaattgagggntttcaatttatgttttacttccggagcccaaaaagatggatttggatttcaatttcttaaaatttagttaaaaatcgttttgcgatccgtattttttcgaccaatactggttttcacggattacgggttatttagcccgtaagcccagttcaggcccgtatctaggggaggggggaatgttattttgaaa

SEQ ID NO: 25943 - DNA, 928 bp, Heterodera glycines
aattaagtgaatttgccctcctcccgcttaaataattaattaatgcatttttaaaatatttaatttgccacagtgtcttttattcctccgttttggccactttcccttttttcggcccgacttcgtcccgcgtgacattccgccccgaatatgtccctccgccaccgtttggtccgctgaacgcgttcgacgcgattacaccgaacatttgcattatttgcgcgttcggttgcgccaaataaagaaagcccatcgcaaaaagtggcaacttcagaataaaacaaaaccgaaaaatgtctctttttttggcttagaatcaaccaaatcgaagtgtgcaagcaaatttcggaatggtacggcgaattgaaaatgcaccgccgcattattttggaccaatggagggcacttctgcggcaaaaagtgtgcaatttaatcagaaatgggtttgatagaaaaatttagtatttatttataagtgaaataatcgggggtccccaaaactaatgaaatccgtaaaacccaatctgatggcctttttttgatttcttcgcacacttttacggccttcattttttctaaaatttctggagaagtgaggggtaaatgccagaaaaaattttgaaaatttgagtgtaatttattacaagggaaccatccgaactgtaactaactgctcaaatcgctatgatcagaaaaaatgattaaaatttttaaatttttaagaatttataaaataaattccaaactcatgctagaaataattaaaaaaaatttaaatgaacagcgaaaattttctatcaaataatgtcaaaatttaactctaaaataatggttcatcattttgttaagacacaagctgtttgattaccatgtttggtccgcaccaaaaggaggaatttgaagcgaacaatgcgcttaccgtcgtggg

SEQ ID NO: 25944 - DNA, 1091 bp, Heterodera glycines
  misc_feature (38)..(39): n is a, c, g, or t
tgtcatttctttttataatgcgtatataattaggctannttgattttatcagcaaattccgaaattagcttgggaatgggcccttttgaggccaaccttttttatgaatgttgtcccattttactttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgagtcttctgtcatttcctttttataatgcgtatataatttaggctatttgattttatcagcaaattccgaaattagcttgggaatgggcccttttgaggccaacctttttttatgaatgttgtcccattttacgttgtggtctgcggcctatggacgcttcagagccatttacgccttcttttcaatattcgtatgtaaaaacgactatctctttttttcggaacacttttttgaaaattttttccggaagagattttgtgacacgcaatataactaacattcgagtcttctgtcatttcctttttataatgcgtatataatttaggctatttgattttatcagcaaattccgaaattagcttgggaatgggcccttttgaggccaaccttttttatgaatgttgtcccattttacgttgtggtctgcggcctatggatgcttcagagccatttacgccttcttttcaatattcgtatgtaaaaacgactatctctttttttcggaacacttttttgaaaattttttccggaagagattttgtgacacgcaatataactaacattcgagtcttctgtcatttcctttttataatgcgtatataatttaggctatttgattttatcagcaaattccgaaattagcttgggaatgggcccttttgaggccaacctttttttatgaatggtgtcccattttacgttgtggtctgcggcctatggatgcttcagagccatttacgccttctttttcatattcgtatgtaaaaacgactatctctttttttcggaacacttttttgaaaattttttccgga

SEQ ID NO: 25945 - DNA, 906 bp, Heterodera glycines
ctgttaacacatcgcattgaaaattacaaaatttttcccggcggcgcctatcggcaccgccggccccccgtgcgccccaaaagttttttgggaaaagcgccgcaaaaaaatcaacttcggttttcatgcttagaatttcacaaaatgtttatttcgaacaaaaaattgctcaaattgatcatggacaatcaaaaatataacatttgaacattttaaacgtgttttgaataaatttgtgaaaatgaggctttttgacccaaaatgaggcttttttgcttgccaaatgaggcttttgaaaattttcatctgcgaaccctggtgatgctcgactcgagaaaagtttcgggttttttgggtctcggggtcgagtctcgggaaatttttgggtctcgagcatcactagtgtgtaagtcagtggattaggtcgttttggcgccagcctttttttttgcactgtaactctttttttttctttgtcaaccaaatctaacaattttgggtcggggtcggtttagtacgggtggttttagtacgagcgcaagtatttggctataacttttttactcttgccaacaagatccatcattatcacgatacctcgataccactcacgtgccctctattcacctgaaaaatttgtccaataatctgtaatagtcgtcaaaaaatgtgatgtacattactaacacaaatgactcatatcttcttacgacaattatctatctcgtaaccccgatgataatccgttccacagatactcttcaaaattattccattaccgcaagagctcgcgtaaattgtgaaataattctcagaaaaatggctatctctttttatgacaattttctatctcgtaaccccgatgctaatccgttccgcagagcctcttcaaaatattttccatta

SEQ ID NO: 25946 - DNA, 2851 bp, Heterodera glycines
  misc_feature (1960)..(1960): n is a, c, g, or t
  misc_feature (2209)..(2209): n is a, c, g, or t
tctcggccccatccgccgattgtcactcagtcgtcatcccccccaaatggtttccctctcatcactgatgtcttccaaaactcgttgaccgaatgtctccgacactcttcgtccacaccgaatgtaaagactgaattgccctttcatagtccaatggacaacgccagcaaaggcagcacaacaaatgcgatgccaaatggtattgaaactggcgagaaatggcattcattcactgttcgagagtctcgagcatttaaggcactcaaataaagttgcttcatcaaaagcataattgtgttttcttcaattgtccatttacagccaatcttttgaacatgtccctctccacggaccatctccgttttgcgcagtattcatccgtctctcaaaagagtccatcttcgatcgaacttcttcaacgtgccctggaggcttttgcggtagccaatcagtccaaatttgccaacagttcggcccattcggcaccgtccattgtcggcagccctttgatccctccgcctcttgcgcacagccaatcgcaacaattggccactaatggcgcaacagcagcagcaaccacaatgagcagtgtggagcaacagctggtcagaaaagggagggcattcattcagtaatcacagggggcaaatggcacattaggccagaagcagccaattagtgatgatttcgccttgagcatcgtcctccctgccccccgagggggctgctcagtaaatttgacaccggaaaaattggtttttaaaaattccatgaaatattttccgaatgaaaattataataatcagtcattcgtcggtgccaatcgaaccacgcgaagaaatttctgtttcggtgaccattccggagttgctctcctccctcaattcggcttttgccaaatgacttttgaagttcaattgccggggcggggaatgcttccgatttggccattcatctgcattttttagctgtctctgctcaacttttcccagctgagcagcaaaaatggcaacactttgtgctcctttgctcctcacaatttgctttcttccgatggcttttgcctttcctccgcgacgataacggcgacaacgacaacggcaccaacaatagtttctgaagcgacgcagcaaaataatgccatcgtcgacaaagtcaacgaacaaacggacgaagcattggcaaactccgcctccgcagctgctgacccatcggtgccgattgatctttcctccaaccaacagcagtcgcttctcctctcatccgcccccaatttggcaccgccctccgtccctcgggggcgcaaaagttgcgacattcgccgttcggcttcctccgtttcgtacaaaggaaacgcggatgtgcatgaacatttccaagtctgtggctgcttttggctgtttgcccccaatggactctaatttcagaggacattcagtggaaaatggccgcgtcgacagccatcgctgcgggcgcatttgcaggcgagcggaagggcatcggttgggaagaaggaagcggcactttgcattggagaaaatgaggcggagggaagcggaacagtgcggacggaagagccaatggaagaggaggaggaggagggcgaaagcgccgcacggaacggcgcggaacggacgaacgccgggggaaaaacgggggaaaagggacggcccaagagccggcagcaggtgaagagcgtgtacacagcagtgatccgcaagttgttcaccagcaacgaagtgaaccaaggtgaggcgagaggagaggcaggccaaaacatttggccaaacacagccaaaagcattgggaaaagggccaactcaatccagccaaactttggccccaagattttgttattattggttcaaattagggttgcagccggggggatcccaggtcaaaccggggaacggggagagcaggcatgaactgaaccaaaaggacaaaacccagaaacggngactcataaatcggaaagcggggattcccttatggggaaacggtgatgaaaaaatttcgaattttactgtgaataaaaattttttctttataattgcacatttaacgtagcgcacccgttctaagaatttattttttaaaccgacgggtaccgaaagcggtgggggtcggtatagtctggccgtactgtatcaactcgaaaactttcttacataaaattagcagccctagtaataaataatccctttcncaaaaaggttctaaaataatgtaaaatgacatgaaagaagaatttgatgaaaatcattgaattattaaaatatttgaaaattttattataattttattttttcataaattttcgacttccggtttccgacgttttggagttggaattccgatttccgaacaatttttggtgcctcggaatgccatccctgctatcagcctgggctttagtttcgctttcacctttttgaagtgaaagattttcacatcaccaatgaatggcattttttgttggggaaaggtaaaaaagttcgtataactttaaatatattttaatttacaaatgtttttgtgttacatgtgaatttttcatttgtatccatgtagtcatgggttcaattccggttgatgtttcttcacttttttcaaattttattttctttgatatttaatcacataaattcatttattgctcccattagcctttgggaaaggcttttttcttttttattataatataaaataaaattttcatttattttcttgaaattgtgtatgtcctcaaatgtcgggaatatccgcaaatgtcgggtccttaaaagtcaggtcctcaaatttcgggtcctcaaatgtcaaatcctcaaatgtcaaatcctcaaatgtc

SEQ ID NO: 25947 - DNA, 1137 bp, Heterodera glycines
  misc_feature (68)..(68): n is a, c, g, or t
aaagttgtatccaattcccggtagggatttaatagtgactttcagagatagccatttttgtctagacntatttttcgtgcgtttcaaacacactattagtgtttattcagcgctacaacagaagacaaaagttgtatccaattcccggtagggatttaatagtgactttcagagatagccattttttgtcaagaactatttttcgtgcgttttcaaacacactattagtgctttaatcaccgctacaatagaagacaaaagttggtgtccaattcccggtagggatttaatagtgactttcagagatagccattttttgtcaataactatttttcgtgcgttttcaaacacactattagtgctttattcagcgctacaacagaagacaaaagttggtgtccaattcccggtagggatttaatagtgactttcagagatagccattttttgtcaagaactatttttcgtgcgttttcaaacacactattagtgctttattcaccgctacaatagaagacaaaagttggtgtccaattcccggtagggatttaatagtgactttcagagatagccattttttgtcaagaactatttttcgtgcgttttcaaacacactattagtgttttattcagcgctacaacagaagacaaaagttgtgtccaattcccggtagggatttaatagtgactttcagagatagccattttttgtctagaactatttttcgtgcgttttcaaacacactattagtgttttattcagcgctacaacagaagacaaaagttgtgtccaattcccggtagggatttaatagtgactttcagagatagccattttttgtctagaactatttttcgtgcgttttcaaacacactattagtgctttattcaccgctacaatagaagacaaaagttggtgtccaattcccggtagggatttaatagtgactttcagagatagccatttttagtcaataactatttttcgtgcgttttcaaacacactattagtgctttattcagcgctacaacaaaagacaaaagttggtgtccaattcccggtagggatttaatagtgactttcaaagatagccattttttgtcataactatttttcgtgcgttttcaacacacta

SEQ ID NO: 25948 - DNA, 920 bp, Heterodera glycines
aaaagtttgtttttaagcaaatcctattgctgtcaataataaaaaaaacttattaaaaataaatgaggactccagcagagaataaataataataaggaaatggatgaatgaatgggagaatgccaagcgtgaggaaaagggagacacatttacggaccggtcaaggggcagaggagagagacaatggaagagagagatacggggaaatacaatcgcttggggtggttccttttcctaaaaaaattttacaaaaaaatctatcttttttctgggaattgaaaattttttagaagatttaattttatatgtacacaaatcaatcgatattccaccagtgaaaaaaatttatatttgaattctgtaattaagaacttcgtcatatgtggtcatgagatatcacatattcttgcgaactgtttaaatttatttggatttgagctggaccatgtgcgattatttttaattgggcactctattgtaaaatattaatttggatttaacgactcatacaaaaacacgggaaaacgaccttaggttctgtaggcattgctttaaactcctttggcttaaaactgcatttagagttaagtttaaaaccaaagaaaaaagaggaatctttgtcatttaagcactggggtgagctgggtgaaaatggcacatcaatatttaaattaataaaagtattaataatagaaattattcaccttcccagtctcctttctcttctccctttatcatcctttttctttattttctttctttcattctgacattttttttctcattctctctctatttctgtctcttctctttctcatcttctcattcgcttttatcttctaatattttcttagcaaatatagaaaaaaaaatttgggggaagaatttttgtgaaatttttccaattctttaggggtgta

SEQ ID NO: 25949 - DNA, 797 bp, Heterodera glycines
tttcgctgctcttcattcaaacactccgtcgattggacgacttaattaggaatatcggattagtgctttcagtggggttaattaaattataaggcagtctgtttcaccttttccacttttggttggcctcaacttcaccccaacattggtcttcttctcggaatattctttctgatgctcatgccgcgacttttgctttgtctcgaacattagccgaatgtctgcaccaaaaatgggcaattcgtacagctcatcgaacaacttcttcacatcatccgccctaatctcagttggctcattggaatcttccccagttgcattgtcaatgagttccttctgtattcggtagagacgaagagattccttaaatctcagtttagcattaatccagtttaatcagttcgttcgtttattcaattgtttttccgttctgactcgaagtccctccagtttgtcctcatataggatctcatgcactgtccctttgcattctgcaaccattcgaaaattcaaaatttttgaaattcttacttttggtcctaaattgatctaaataagctaaaatttagtcaaaaaccattgaaacatcgaaaaatggtcattgtgtacaggcaagaacataaaagtgaattttgaattttcgattttttgttcgaattcgggtccgggattcgaaattggtcaaaatgaatgtcagattcttgatcaacgaccctaaaaaccccataaaacgtgttttcacgactttttagaacaaaaaaacttttccaaaaagggggggccatcggcagtattac

SEQ ID NO: 25950 - DNA, 1592 bp, Heterodera glycines
aaaaaaaatttcgaaaacgaaaaagtcatgaaaaccgaagcgaaaatatacattttaaaacaggaaatacaatggaacatattgacggaccaaaaaacaagaaaattaaactaaaaaaatgccgaaaagtgagagacgaaacgaaaacgacacgaaatttcgcatacttttcggttgaatggaccccgagaataaaatatcaaatgaattggatgaaatgaaaaaataaaaatataaaaattaaagaaaaaagacaaagacaaatcaatttgttgaaaaaggagtctgttcatcaaacaaaagcatcaaaatgaatagataaaaaaatattcaatattttcattaatttgtgctaaatttgcaaaaaaaaaaatcaaaatgataagcaccgcaaaaagaaacaattaaaaatataaatgagttaaatatatttttaaaaatttcatttagcaatgtttggataaattagacctaaaaccatgtcgtgatcagggttcatatatatgtctgttttggttttttcctaattttttcagataaatatcggcgtgggaagaggatcggtgcgcgattttccgggattagtcccactggatcccgtcctgcaaaattttcaatcatattaccgcgctgagaccagcaaatttcaaattaccgatgtaaattttaaatctttaactttgttaatttacataatacagtatgttaagtgttttttttttctttatcttattttttattttatttaaacttgaaaaactttaatttacaataaattttcggcataaattttgattttttttttttgcctgtggccaatggccttctatgaaatccatcaaattaatccgcattgcactttttttctgctcatatgtgtatgtatcattcatagatcatttttaaattttctcatatgtatcagtcacggattgattatgctcaaatgttgttgcttcttaaccaatttaataatgcctcatttgttagtcattacaaaatgaatcgctgatgcagcagcaatgttggaaaatttcacatttcaacaccctattaattgccttacaaataaatatttaaaattttgtaccaaacaaattattgccagatgtttattacatattagcatttcacgaatttacaaaaatttacctatccctttccgtccatccatccgtttttcccatctttgtgctgctgctgtgtccccactttatttatgtgtattatcagtccatcccatctgccttggccaggccgtgttgtcctcaacccatccccaccccacacacttaagcatttttcccctttagcccccatcgattggcctcccccccccctccgggctaagcagcagcataaaactgacgactgactgactaaactcagactgctgctggccttgccgccgtcgtcagtcatataagcacaatgatctctcacacattacgctgtttctctgcgcttcatcttcagcccatgctctcgcaatggcactctgcttctctgggcttcatgttagcccatgctctttcaatggaactctgtttctctgggcttcatgttagcccatgctctttcaatggaactct

SEQ ID NO: 25951 - DNA, 1089 bp, Heterodera glycines
attacgccgatactaatggtctggaatttgtttctctgcgcgtttgtttgggaaaaatttggaaaattggctatctcttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgtgaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgttgggaaaaattggaaaattggctatctctttttctgctcaaca

SEQ ID NO: 25952 - DNA, 1280 bp, Heterodera glycines
  misc_feature (94)..(94): n is a, c, g, or t
gccggtattgtctttaaattttttcaatgccaattgtcctccccgggcttcgttggtttgaacaaatggcagaacggaccttgcagaacgcggnggaaaccaaatgacagcaatgaaactagcaggagaagaagcattagcaaaagcctgatgtttggaaaatttaaatttagataattaattctcgtttatggacattgttgcaccagacatttcgccatataagctaaaatctcacgtttcgcaacccggcatttaaaccaatcattctttacataatgagtccattttccggaatttttctagaaatagttcgattcaaggaatttaaaggtcgggaacttaattttgacatccatgttcacttatttctaagacgaggatttctaagtttttacttatttttccaaaatttattaacaaaaatgcaataaaaacgtaagaagcgacccaaaaaatttcgaaaaatatacccttaagaatcgaacaaaacattttcaggaaaagacccttaagaaatgaaaaattttctttaaaattcaatcaccagaattttttggccgatagtcgtgttgtcttttactcatgaaaattataaaatttcttatttgtaactgcaatcagtgaataaaattgcctgccttaatctgaaattattttcataataaaaagaacaatttaaaaaagtatacccctaaatttgaaagcttttcgtccttattttcgcccttattttggactttttcgcccttaaaaatcctcgcacgattaaagaaagtgacgaaatttcgttgagtgacatcattaattaatgataagtttaccgctttgaagtcagcaattttgaacggccaatccccgtcgtccttattattcctgccccacgagcattcgaaaacctttggcacattgtccggatgggcagtgaacagccatttggccaaagcttggccatccgacgccatggcactgtcatcggccgggaattcgggaaacagatagtcataaaagatattgacaacacgcagtggtggacaatcgcagagaaatgacggcacgaatttgcgcaaacagtgaaaatctttggcaaacaaagtcaggccacaaatgcctttgtcgaccattggccaaaagttgagcgcaattaactcaatgtgtcttgtttttgtaatgtccaaatttattggacaagcggtgaaaagaggacgaaagacggcgaaaaaagcgatgaaattgcccgtcatgaaactaaaaaacgaatgggaaaatgtgtctttttt

SEQ ID NO: 25953 - DNA, 885 bp, Heterodera glycines
ttttccattaaaattgaaaagcgaaaaatagttcaaaagtcttacagagcgaagtgtgcgagtcgaccaaaattcgggagctgaaaatgctcccagatttgccgaagcaaatatctcgggcgaactcattgacaaagcccgggtcgcacagctcattgttgttgaaacggaaatgcaggtagagctgtccgtgtgacatccgtcctttttcactgatcatgtcataattgagagcaagtcgtttttgagtttacaaattagcaaactatccacacttaaattaacatattattacaatttggggaagttaagccccccccccctggctacgccctgatatgtaattgttgttactcgatacggatgaaggaggatatttaaccttgtcgtatcgtcttagggttacggttgtgaacatgggtgcatttcaggtgcattcgtgtactaatatgcacctgctcattcatgtttcattttcatgcttgacttgtctgattatctcaccattcccgtttgtttgaatttgtgtgtccaacaggtcaaacggtggctgatcgttgcaattcgcagtccaagctgagaaataccaatcaaagcgaacacagaaagccaacagtctgcggagaggaagctgaaaaaggaaaacaacaaattttaaattgattaggtaatttgttttaaattacatcgttttttccattttttcctctgctgctgcttgttttgggttgtctgctgatgacattttgttgtggccaattaattaagacaatttgtacagatgataaattagcatagaaaaacttaaaaaaatttatggaaatataaaaatccccatatatatgtgattaaaaaacatttatttgtggtcaagtaaatttttga

SEQ ID NO: 25954 - DNA, 2931 bp, Heterodera glycines
gtatttctttaagaatgtgtgccgtgtgttggacatcgatttcacttctcggcatcgtgctatgatcaatacggatcattccaagagtaaccgacccaaataccagcgatggttccagtggctgctgagcgcaaaatttgcaaagaaaaaatacaaattgcactatgaaacgcggacttatttgatggagttcgatgtgcatcacttgacgggaagcactgcgagtgcttttctggaatatatcgaaaggaatatacccgagggagtggccatgaaagttacatataccgagatgtgctttctgccagaaactattgttaaaacagtgatggataattagttctttgtcgtacatgataaaacattttatgattttcaacagtttgttcatgagctgataaattcatttttcgtaacaatccaatactgattggcatctcgattcacttctgctccgtcctttttcttaagtgtggtggaatatacacatttccgcctccagctgccggagtctcttgcgaagtcggttgcggtgtcgccgctggcctattatcatttgtccaccatttttaaaccggacaattgtgataaatgtgttaaactcactttgacatggttcgccaactgttctgggaatccgctgtgctagtgcttaaataatggatcttcttttaatgattcgcgaattttcaattacattccagtcggtttggttctccaatttgaatccccttcattagacctgaaatttgttgcagattatttactatcagacacttgaaatcggtacttacttggtggcattcgtttgatgagcggcgctaactcccctaagcggcctaaaatttattgttttattctgaatagagtcaaatggcttacttatccttttcttctttcggtacggcccgttgcatgtctctccaatttgaagtcgtgtccgattctgttggccttaactttttgtttttgaaaaattaaacggaattggcccaactccgtgtcctgcaattgtttacgctccttgtccatttgctttcgcgaactctctccatctatcgtacgccgcggcgctttgtaagcgttttccctgaatagttttgttggtaacaaaatatgttcgtcgaagcaccgtttcgtcttctcttccctctccctttcctcctgctgtttccgctcttccaacttcgcccgtctgctgatttcctcctgctccttcagtttctgttcaacttcgggtgccttctcaatggaaggaaacatttcctcgctcttcagtccaattgagtttctttcttcgctttgacacatatttcgcgggttcgctcttcacacgggacgcgtctccttcggtattttccttagtgaaatttgtttaaataaactaccgtcgtttaaccattatcaaagcgatttcgtttttatttaaaattgcttattccaaaaccaacttcgctgttcgttttccaagtcctcgccggttcggcgctcgctcttttctcctcttcttcgcgttcgacgtacgagtcggccatctcttttatcaccacaggtacgttcggcttgtcgtcaaatgccaaccgttcagagtcttcgttgtgctcgttcgcgggtcggcttttgctaatgtcctcaactgacgatttattttcattatcatcgagtctcatctctttgttcctggaacaattaaaaattaaacatcaagcatattcgacctaaatgaatattaaaatttataatttttaaaacgaaaaatgcaatcacgattcagagttaagaactctcttcgaggtgaattcaaaaatgttccgttttgttggcgaaaacgaaaaccgataaaaagcctcgaagatatattcgaaatcgtttattttataccttctcttattttgcgataatttcgaaataaagggtttaaaaaataccatcgctctccgctccaattgcacacttatttcctccaatttgatcactcctttcttttttcctttgctagccttcttcgcgaaaaacgcatccaaatcggtcatttttattgtttaaaaatgctagtgtcgcttttcgcctttttgggtttccaattctttcgttttgccgaaaatagagaattttatgcactgttaagatttgggacagtgtgaaacgattttaaataaagaaaaggtaaacttttggctcttgcacagtttaggcgtcaatgattcctaattttttaggccataatttctccattcttgcaaaagattaaagtttcgggaatttataaatacaacgaaaagagaagagaaaattctgtaattagggaaaataaaaagagaaaaacgaaattcaggttttcgagtaggtatacccaatttccttttgcttatggttccaattttggatgtgagataacagaagaatgacgttgcgaagtaaatactacattattttttcaaaaaagcagacgtgctatgtttttttgctatttaagtgccggtaaagcatcagttcattcattccatttatttttcctcgcatccttacttttcctgctgaaaattttttgatgtctttcaaatgtattgctaaaaatccaatatttcatcgtttgttcttacatgtaatcagtaatacacaaacttctttctttagcaatcagtggcatttcaattaattatattgttcattgtctgtctggtcttacggcgtattatggaagaattggtcgtcacgatgggcccgaacttggatcacaactcacgcgaatttaaggagaacgcaaggaaaatttgtggcaaacgtttggggtggtgcttggatgaccgtcccagtggagaatctgcacataaaaaactcacgtaaataacgccaactgtacagatttactatgactcttcagaaggcgggatgagcaacctcctttttcattgttatcttgatgaaaat

SEQ ID NO: 25955 - DNA, 1354 bp, Heterodera glycines
  misc_feature (1307)..(1307): n is a, c, g, or t
ccccggcgaaaaatgttgtagtgattaagcggctgttgaagctgatcaaaatggttgttgttgtcgttgtcattgccgcttttgtgcatgtgtgtgcgtcggaatgccgcgctgagcagcggcgagccggcgccaagttgaagctgtaccaggaacaccaggaggagtagcaccaggcaaaccagtgccgagcagggacctgtcatcattgtcagcatgttcaattgggagtacatcatgtcgtgatttgttaataatgttggaggacagaatttattttattagctaaattaaatcaagaattaattgggaagcaatttaaaatgaaaaattatgccattaaatttcaaaattttacaggaaatttctcgataagcattacttctatactcgaggcgccatccccgccccccccccctcctctttaagcaattaagccactcatttataagtgccgtaccactcactaatcggctgatcagcggctaataataccgggcaagaagctttctcgacattgtcaacaaaaatggtttatttctaccgctgatgacatggcataaaatccgggcggaggggggggggggcttatcgtgccactaagcctgctgtggaacgttttggcagcagatttttctgatcggatttgatcgtatttggctttataaatatccccgattttgatttcgtcaccccacgtcattaaattatgacgatttttttgtgagtgtgtgtatcagggatggcacggaattccgatttccgacttccgatttccgacatttttggagtcggaattccgatttccgattttcgaaaaaattttggacgtcggaattccgacttccgatttccgaaatttttaataaaaagtctgaaatgctaaaaatgccataatatttactcacttcgtcaaaagccaaaagggaagtaaaacaattcttattcacaaaaaggtagctgttaattttttaaaaatgcgccaaaaaaaattgacaaaacaccaaaccaaaatttgtgccaagaaaagaatgagtgtattaaattgttatgactagggatgggaattttatgcacgaaaaatgaccaaaatatgcacataaatatgcaaataaaattgccaaatatgcacaaaaatcgcaaaatatgcaccaaatatacacaaaaaaatgaaaaaatgaaaattaggggtgcaaattcaattaaaaaaaattttttccgcataaattttatcggttatttttgcaattgcagatcaaaaatttttcaaggttttcggcagtaaatctcatcctgttgtctgccanaaatattcttataaaaggaaaatgaacgttccacttcgcaggattga

SEQ ID NO: 25956 - DNA, 1442 bp, Heterodera glycines
ccccccccccgcccacgagcgatgtgtttgctcttcggcctcttatttaagtagcgaaattttcaaaaaaaaaaattttttttttttgagggtagattaggccaagtttggaattttttttgtcaatttttgaacagatttagacgaaaaatgagcccttgcaagcgcgcacgcacagaaaaggcaaaggtggagaacatcgaccaagaaatttttttttaattttctaagtcatttctagaagtatgtaatctgatgcactgagacctcttcttctttttttttttgggggggggtgataatttatctcaaaatctgttcaaaaatcggccaaaaatttcttaactttttccgatggcctaaccctacactcaaaaaaaacttttttttttggaaaatttagctaactaactcaaacaaagttcatgttcttatcccaaaacaaaaaatgaaaatatgggacccccattcttgatgattgccgttttcttaaaattaagaaaaaattcgggaccaatgaattttctccgccattggccacagaaaatttattattgaattactcaatttggaggaaacagaagcgaattttgttgggcatctcgtggcacggaaactgcttatcttttccaccgatctgcaatggaaaaattggtaataaataatattgtggtctcccaatttttcgaaaaaagtcatgtaaaacatcttcccggggttttcgaaaatttgaatgttctatgtttgttcgaattcgggattcgctatttgtcaagcttatgatcagcgacctcgaaaccccaggaaaaggcgttttacacagattaaaaaaaacatttttttttttgaaaaatggggttggagacaaaccaaggtattaccaaaaggtgaggcgctccttcaacatcaattaattttctttcaaagtaaattccttcataaacaaatttttgtttcttgtaaattttgaagcttctccaaattttcaattcgggttgacaatcaaaatgcgtgtcaccaaaacatcgaaacggggcgaaatcagtgccaatttgaagccgagttgaggacgacgaaagaatggcaaaatatccatccaaatgtcgttgcaaatccatttaaaacatggcacttaatggtaggtaatatatagtgccaatggtaccccccccctttttttttgaaaaaatttttctctcgaaataatgatttttagggggttcgcagggccggagactccgattctggcatccattttgaagcataaacaatatttatggtactttttcactttacgccacataaaataatttttaatttttttttctggagttttcggggtcgctgatcatgaatatgacgtgtatttcgaacaattccgaaatccggacccaaactcgaacaaaaaatctaaaattttaattatccaatttctctttttc

SEQ ID NO: 25957 - DNA, 1872 bp, Heterodera glycines
  misc_feature (1836)..(1836): n is a, c, g, or t
acgtccttgttcagaagcattcaaatgttttcggatttcaaatacattttccaatttgtccaactgatcggaagaaatcgtcgacatggaatttattaaaaacctattaaaaataatttattatttccgaatttgacactaattatactactgtttcaccagtgaaattttctaatatgtatatggaaattaagattaggcaaaatgtctttaatcagggatttttataatttaggtcaattaaaacccaaaataattaatttaaaattcccgaactctaggcaaagcctggtaaagtatggaaccctgttgaataaacagggcagggctgccaactgtaatggtcaaaaatcagcattttggaaattttattccaaatgaaaataaattaaaaaaaaatgtttattgcggcgccgcggaaatttttttgatttacataaatatgccatttttaaggattttttttctcaaaaaacagcaaccagcaaatttcttaaaaattcttcaaaaatcaacatctcaaaaaataaataatcatcattgactccttaaaatcatcaaaatgatgatgaaaagcatcagagttggcagccccctattagaataaatgaatggaattctgctgaaaatgtgggagagagtggcggtcgccttaatcgatttccaccgccgacgtccgcgtggcccgtcgaataataaataaataaatgggtggtcatttgaccgtggtcatttatttgtttgaccctggtcagtcgggaaaggaccgtttgggcgccgccgtttcgacgcgatcccaagtctttgactatattttttttaagtttcaacaaaatctaactatcttagtatcatttgaaagcccttcatctgatctattagccttacaaaaagcaaaaaagcttttctaacctataaaaagttaaactaatcgcaaaacaataacttattgttagaaacagcttccaaacattataagcgctcgaatgataccaattttgttagatttggttgacaatgaaaaaaaattataggccaaaaacttgggctgtcgacgaaacgagcctactctggtcaattgaacggtcagcagaaatttcaacccatgaaaaattttattagttttttgaaaaaaatattttttggaattctttccttatattttcacctttaatttaacaaaaattttaacaaaattggttatatttatttctttgaataatttaattttcaaaatttcgaaacttctcgcaatcccgcgcggaattccgcaaaccaaatttttatgaataaattacaacatgtacacatttatacatttttggtgcttacctataacaccgttaaaaagtgttgagaatagacaaatataaaagtccttggagaaataaaaatgatatgtgtagcaaaaattgttatttaattaccgtaaatccgttatttgaaggcccgggccttctattgttcaacccctctataagtcaaatgtgaattgcctattttttgtacgtctacctatttattcattataaccatttttacattcaaatttcatggtaaatttgtaattttgaataaatttagtttaacaaattttgcttatatcaatttctcaataagatggacccatcaaatgaatgtggcaattcagctaatttagtaacgcctcgtttcttattcaattgttcgaattatgtttacatattaaggtctgttgcttttgcaacaaatccacgtctggtgctcaccattgtcgaaaatgctccaggccttgtcacgccattccaccatgctcactctcaagcgatggtgaagaaggatacggatcgaaggtcntctgtgagggatgcgacctcattggtgacagagaca

SEQ ID NO: 25958 - DNA, 1531 bp, Heterodera glycines
  misc_feature (26)..(26): n is a, c, g, or t
attacttcctgagggacagccatttntggtttatttcaaataatatgtatgtctgaaaataaaaatatgcatttaaaaagaggataaagttggtgtaggtaaattgagatgattaaattggaattaaaaaaaaattatgaatgaatgaaggacgtatacgaacgtatgaatttatatactaaaatttctctggagactcactttggctatgggtcaactccactgtgcagagaaaagcatagtactatctcgtcgtttctctttttctttgtaatttttctcactttggcgtactatctattcattttaattacctatataaaaaacaacatttacttcgtgacgtttacctttttatctacactagcggggaagaattttgccgttttgaaattaatccccggcacttcatccgatcctattgtaggcataatacataaaatccatgccaatacgttgccaaaaagaatacaaatatttaaaaaatgacctaataatgtgaataaatcaaaaatgactcatttctatacgttcattaactttattctttccgcctttccctcccttttttctccaaattcattattttagcttttcacttgaagtgttcaattttattacctgagaaatgtctgccaatgctgaattacagttcgtccgaatcaaaacaaaagcagggtcaacggaggctgaagtgacaattggaaatggacaacccctttcgattctggaggcgattgaacttctgcaaaaaaatttcaccgcatttgaaggcatctcgattaggtaaaaattggacagaaatgaattatgaaaatgaaaatattaagccatttcgatggtgatgtcctcactttgctccatcaccttcattcaaaacttgattgtcaccatgtaaatttggcaatagaaacttataacaccgatttttctgaacaaatattggacaccattttgccgttaatccaaggagttctaaaatctatcaaaatggatgccaaacatattgagaatttgacacaattggccccatcactgctatgtgaatgtcccctgcttcattcaatcgccacgaataaattttcgttggaatttacggccaaagacggtgccccgattgaaggacaagcattggcaaaatggctacacatagcgaacccggaaggactgcccaaaatgatcgacttttgctacaacgctaacggcctttggaccatcaacaagagtgaagaaatgaaagacgtgggttaaaaaatttaaaaatatcgtaatttaattttcataaaatttttggttttaagtctttctaccttgccaaaacgtccgccaatttcattgtccgcctttaccttacgcatgatgaggaagatggaggaccaatcattttcgacattaccaatgcaataacaatggaaaggttaaaaatgagcgaatttgccgaggatcgctttttgctcgtccgttctccgattgatcgcgatgagaacgaatgggccaaatgggagaagaaggccaaagagtggacttcgat

SEQ ID NO: 25959 - DNA, 1187 bp, Heterodera glycines
aatgtggggcgtggcaaatcgatggatggataatgaagcaggttagtgccatgccgtcgatgaatgaatggccatgcaatgccaaaattgggcggggaaaggcgaatttgtggccaaattaaaatgtggggctgtggcaaaatcgatggatgataatgtgatcgctacagtgaggcagattagtgccatgtcgtggatgaatgaatggccacaatgccaaaattgggcgggaaaggcgaatttgtggccaaatccaacaattgagaggccaaatcgatggatggataatgtgactggcctccaaagtgaatttgtcatccccaattagaaattttgcaattgtacgttttttttctaataatcacagttaatctaggtatttctaaaattcgctgaattttgaaaaattaaatatcattattattattaatcaattttaaaattattcgcctcgggggattcaaattcaatgcatggccttttcaaaccgcagaaccaattcaatgataaaaacattttttaataaaagaaaaatttgaaaggattaaaatttgaaaaaaaatggataacgtaaaatggatttattcccgaaatccccccaaaataaatgcacacccaatcggtttctctaatttagtcattagggtgatacaaacttttttcccacatcatcccaaaaaggaaacaaattccaacaatcttggtatcattcgaaactttagatgtttaaaagctttttctaagctattgcttggcgattcgacaattcccaaaaaagttatagcatcaaaattacgaaaaagtcgaaatttttaattttataatcaaaaaagtgaggagattagtgccctgaatgaatatataaatgcatagatcatggcatgtcaattgtcccctaatttctgcatttttaatgaatgccctattttgtccaaattctctaaacttgtttcgcattttttacaccttcaatttacatattaaatataccaatctatacatatgtatttgcaattgttcctcataaaatacatttgatcacttaaaatgtacataatgatcgatcatttcttaattaattaattcatttcttctggcgatcactgttgttgttgttgtcgttgttcttgtgtccgtcactcattttcagaagatgcctcgttgtcgctgctttgtcccgcttcttc

SEQ ID NO: 25960 - DNA, 1121 bp, Heterodera glycines
cgacagtttcgcatgcacgtgaccaagcagtgacacgttacagcagacggaatgatttctggggggaccccgcacgcgtcaacgtctcgatcagtcgtgggaagcacggcctcgttatagtggggaatttgttggaattggcggaggccaccatttggaaccgttttcttaaaaaagccttggaatatactgttgtaacttcgccagaatttgttcagatttcggcacagcggcgttcacattatgttaggggtattttgtcggatgaagatggacttagtgtccaaaactttaagtttcacatggaatggagtccatcgaaaccccaaaaaccccaattccaatctcaagctgtgaatttcccaaatccctccccagtcaggttctttccagcaccgccacttccgtcactacagtccaggcgcgaacaatggccaactccggtccagagcaccagtcaagccaatcgtccggggagcagcagtttttctgagcccaccaacagccaagctgatcagaagcgaccacagcaaatccgatgttggcggtgtgacgaacttgggcacgtttcgagtcaatgccgggcagcattttctccatcaaaaacgaacagacgatgaagtttggggacaaacttgtggaaggatggacgtgtaaagcataattcgattatttccataaccaatttcttttctgctgttgttccgcccctttgccttttcccttcacatttgtctatttaaactgatgactttctacactcaagatcagttggccaaccagtgcattatccgttgaccattatattttaatgctattccaataaagcacttatcattctccgccgatttattattggtccggacgcggacggatttgggcttgggacccgggaggttgggagtccagggcccggattttcacccatcaattcccgcttctctttccttcttccattcctctggcactacctccatggtccttaatgggcatctctcttaaactctgggttggacacccggccgttttactggtatcaccggattccagcgaccctggctatccgttggcaagagaataaaagagcagagatgaggcgagtaaaaaattggaaattaatg

SEQ ID NO: 25961 - DNA, 1815 bp, Heterodera glycines
ctcccttctcccaggggtattattttgtaaagtcttttttcccccaatacacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttttcaaaccccatttttcgcaccgtgaatgttatttttattgcattctgaaccgttttgagtagattagactagaaaaaattgaaaattttgaaatcatgtttcccactcccttctcccaggggtattattttgtaaagtcttttttcccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggagtagtataggacccctaaacctcgcgggtatctcgcgggtgtttcccgcacgagcccgtgcctatgggaggggtgcagccctttgaagttgccgcccgctcacatcctgagcctatgggattttctttgaactctgccgccttggggatttccccaaattgttgcgggtgtttttttcacccgcgccgcgggaaggtcatcaatcatccacctgtcaccaaaagtgacaggtgaaggaaattcaattttttctttgccaattaattcctttttgatcccaaaccttttggggtattttctcaaatcctgaatttttttatgatgggttctctaatcctgaaattaaaaattaatttttcgaaaatgtgccaaaacagtgcgggtttttttttgcatttcctcccctccctccccgcgccacgatgccgccgccgcgcgaagtaatcgataacaaaataaaaacccaacagaactataaatttcgggaccgtctcaataaataaaaatttttatcgtctcattaaattcttttgagccattttcaaataagggagaatatgatgatacatttcctcaatttcagaattgtttttagttcccgtaattacgactttaccggtccagaaaattaacgctgtcatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagcccccggacaccccgagcccttaattatttctataaaatttttaatagcattttcacagtctatcagacttttcgtccccagacatatcattttcccggattcccataataatgccgtggctttgatggggcttgcacatttgataaccgcggcattgaattttctagggttatacttaaattcacactcggtgatcgtcagagagtttagtttaattccggtaccgagattagcgagagcaattatatttacgattatcggtttttgcatttttgatacaatgtaccaatcaaatggtccttccactccttttatataccccttctataaatagcaacccaaaataaaattaaattgaaaaaatgaactg

SEQ ID NO: 25962 - DNA, 615 bp, Heterodera glycines
cccgggtgtctctttcttctccgaatcgtttcgttcatttcgctttgcttttcctttttctccgttcgttcccttttctttctttgtttatcccccaatccttcgcaccttccgtcactttttgtccgctttttttgcaacttccattctctcagaccattcaccgaatgaaacccatcaaataaatcagcggatggacgccgattccttcccctcttttttgctcaatcggctggcaaatgcgcaacccccggggacgggtgaaggctaaaccaataaaataaaatttaaaaggcgacattcgccgcccccggcggggggggggggggagaacaccgcggacagaacgaccgatcggcggcggtggcggcggtgtttatcgtccatcgccacacaaatttttgtacaatttgccaaattacaacaaaaaaaaaatcacgaaattttgttttttcttcttgttcttcttttcatttttccgaatcaactgctgctcattacatccaatggggtttggctgcctattcctcttttctttctcatctctttctcttcctttcccccccccctctctctgaatctctcacccactcatcccttcactatctctctccc

SEQ ID NO: 25963 - DNA, 732 bp, Heterodera glycines
aggcacacgaaaagccgaagggtttgccttggcactttgtgtgtctctgtgctcacttttcattttttagctttcgagtccccccccccccctccctacaatatgtgcactgtctcctcccccctctctttccggccaattcattgacctttcccccacccaactcggcggtggttcctccccccgggcgtcgtcgaactcatccatcaaatgctgccacaaaatgtcgccatactctccgccaccgccgccgccgttcacacaaaacgaatggtctcaaccataaaattggcgctgaattgggacgtcaaatcatttcccttttctttttttggtgtgtgttgtgtgaacagaattatcacctcctctctctcccctattaaaggtatcaccccaaaagcgtcgctttgtcattgtgtcaattcgtccgtttgtccgtccgtccgttcgtttgctgtctctttgcgtgtccgtccgttcattgtcaccaataatttgccaccaaagcattcattcccacacattgtgccgcccaaacagagaaaacacgtggaaatgggcggggaggcgcgggaaatggatacccatcggcaccggggggagggcaagggactgcattggcattgccacgcttttacatgccatgccatgccatgctatttgcctttgcctcatttggttcatcattttcatcttcgcccatcccaatcggcccacccacacatttgttgt

SEQ ID NO: 25964 - DNA, 1255 bp, Heterodera glycines
ttgaaatactggtgggttgagtcccggcgattgccttttggtgggttgagtcccagtgattgaatgctggtggattgagtcccgttgattggaatgttggtggattgagtcccagtgattgaaatgttggtgggttgagtcccagtgattggaatgctggtgggttgagtcccaggtattgaaatactggtgggttgagtccaggcgattggaatgttggtgggttgagtcccagtgattgaatgctggtggattgagtcccgttgattggaatgttggtggattgagtcccagtgattgaaatgttggtgggttgagtcccgctgattggaatgttggtcgttattgagtcccagagacttgaatgctgttgttttgaatccctatgattggatgatagtgtcatgacacccggttatgataatgaggttgtttcatcattaagaaaaatgatgctggtgtttatcgtcccagacaacattcaaattccaggccatttgcgcacccaacattaaaatccatgcaattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacattcaaattccaggccatttgcgcacccaacattaaaatccatgccattttcctctcatacaacatgcaaat

SEQ ID NO: 25965 - DNA, 1870 bp, Heterodera glycines
attttatagaaaaattgaaaaatttttaaaaaattacttttgaaaaatattgttttatcgttaaactcagtttcaagtatcaaattaatttgaatttcgccattggtttacatcggattttacagtcgaacgatttattaattttattgtggcctcttaaaaatttcagatttttttagaatttttgtgggaaaaataaattaattccaaaattttcctggcaccggatcaattactccattaaaaatttgcaaaattaacttctaaaaatcctcaaaaaaattgtcattatggaattgtatttcaaaatttgttggattttaaattcatacgaaaaagtcagtgaatttcattgtcgccacattatcactggttacggtcacatccatttgcattacggtagcgcccactgaaattttggttacaaaactctcactatccctaccgtacccaaaggcttactgtttttggttggttccggtatgtcatgcagcaaataaaagctaaattgggtggactttccatcaagcaatttgatgcgaactttcaaatttgaattttcactccatggtgcgtaactgtagtaggatacggtagtgtctggctcaccctaaaaattaataatacaaattaccaaactgtaatatatatatttttttaccagctcttgtcttggaaacacatgtggatcttctaataaggcgtaatggccggtgagctaaaaaataaatttcaataaatttaaatttacattatttcactatcgtattcttataatagcttcgcccaacaattattttattttaatatataatatttatttatttttaaattagcacacaatatttaaataattttcatttaattaccaaatatcttttaattacctgtgatttagtattacataattcaaattgaaatttacagcttctagaagtttaaatttaatacttatttaaaattttattgtatatattagttcaattgcatacaaaattttttgaattttagaatatttgaaaaaattaagatttaactagatttctacaaaattcaaattggatttctgactttgtttaaaaatttacagacttcctgttttaattttaaacatgctaaaatttaaaaattatttataaattttatagaaattcaaaataatattttcaacacattttaattatctatctaccaaatatttaagttattttaattttaataattcaattaccaataatttattatgctcattaaacttcagtccgccccaccactgctggggaaaatatccgcgcttgctttgacttcgcaatgtaattttgtagctgtactgttgtatccaaatttgcagatcaaattcaaaagtttgatttggaaattcaaaatcgtgattaaacgtttcattttctttggattgactaaattttttaattggttttaattaatttgttaattttattctcgatactttttcatgtagacttctaccgattcatcggtaatcaaaaaatgagcactcagctgttcaaaatctaaacaaattttcaaatttgaatacgaaaaattataaaatttattaaattgtaactcgcatcaattttttggcattttgaaaaatttggcacattttttttctgtccatttggcgggtccgataatttttctgatcactgatcggagaaattattttttcggacaatgttttctaaaaaagtttaaagcttttgccacaaaaaatataatttaaagacaaattgttttagtcgaaatcgacataaaaatgtcaaaatgcaaaaatccggatttcggatatttccagtaattctggggagcataaaccattttttttattttgtttacctttttttcc

SEQ ID NO: 25966 - DNA, 1642 bp, Heterodera glycines
  misc_feature (14)..(14): n is a, c, g, or t
atattttaatatanagcggacaaccatttaaaccgatggctccaaaatcaaaattacgaaaaaattttcccaatcccctagggattttttcggaactcgaacagccacacaaatggacgaccgaattcagcgactttctgcttaaatgtctcgtcaaaaaagtggacgaacggtggggcgcttcacaattgctaatggtcagtctttggaatgggaaaaggaaagagccaggaaataaacagtttaatattttacctattgtaaacagtcataggaaggaaaatgttgtagcaccatcagatttttccgggtgcactacgttccccccccccccccggccacttatttgactctcgacactcatttctctttcgacttcaccactcatttctctctcgatttcatatgcttgatcagatttcataaacctgatgaaatgtaagcatctttgaattcaaaaccgatttaaaattattttccaaatttaggtgcgttaacattaaacatattttggtggtaatactatactattgtatatgaaaactgttttcggtcaagtacaaagattaccagttgatcagatttttattgctttaaattttcaaaaattttggttctcaaaaatagaagtgccaattaatatgtagcattgattgacttactttttcatgtcctttggcttgtatgttccctttttgaacagttccaacgccaacttaaaaaatcgataattgcgttgttttctattcattgtatttcttttattgagtctatttacattataataataccagctttttcttatcttgtttaatttttattttgcattttttgtttttacacccccccccccccaataaaaagaaagaaaccgaaaatttcagacatatattaattaacaaagcctgatgcgaggaaataacatgtaaatcagcgactccaacttttttttgttgcttttctcagcattacacaccatcccgaaaatgagttatattttaattgaaaacgaaaaacaaaaacttttggcttttcgaatttttgttctagttcggtgcctaaatggatatcagacgcgggttctccaaccctaaaaacctctaaaccaactttaactcgaaaaaggagttataccctaaaacctgacttggcgcctgcattccatcgtcagaaataataacatttagccttctgctattttttaaaaatcattatttactcatgcaatttcaggttattatcaaaagcaacttaatgaatagacgaataattgctcagcaaaaaaggcgacagcaagaacgcaaatttgacgaaagtcttgaaagggcgcggatgagaaggggaagaaaatcgacccgcgcaaggacctgtgtccacgaagccactcatggatggatattatggaaaacaaaagattgtagcgacacattcgaaatggtaagaggtcggaagaaaataaacaaacggtcataaccattgttaacgaaattcttaccccaaaaaatcaggctggaattttaacgatgacatttttagtttttacacattttttggtgcgctttaaaaaaatgggacgacactaggaaaaattgtatttggcgcctataggcaccgtcggacccactcccctccccgttcctta

SEQ ID NO: 25967 - DNA, 2405 bp, Heterodera glycines
  misc_feature (2391)..(2391): n is a, c, g, or t
gaaaaagcaaaagttactttgctcatgttcaattatcgattattcatctttacatttgtccattctctcgtccgttccttccccctccacattgtttatttaaaggctggactcttccccccatgttcacttcttctcctgtcttcaatttttatttttattcattattctctccaccgaccattcgccatttttattatttattattattgtctcttcgtaaataaatatttgttggtcttattcactcggacaaagacacaacaaattcaaaaatgcaagttttcttgaacatttttggtcttaactagggccgggatttctagtaaaaacttctttctttttttttgctcaattgttttggagaaaggagctcaaaaaacgcatttctgcgttaaaatttttttatttgaacgtcatttttcgtcactataaagcactattatagcgtttcgtcacttaaaatagtgaaattcactattttggcgttttgtcactatttttcactatttcgaatttgacggccgttgaaatgctgataagtgaagaagaaggcttggctgggctcgtgcgcaactttgacaatgctgttctctccaccaaagtaaaagcattgctaatgtgtgtggacgcgatgcactgctggccaacgagacgatggaaacgatttgcgaatgctttgagcgattgaaggccatttgtgagcgttatggccacatttttatctactgggccgtgccgccgtacattcactcacgaaaagctcaatttctcgaactcgttcgacgcttggccaaactctgtgacgacactaatattcggttcggagctgtgacggaagaagcctcatggaagtgtttcgttacggaggaaagaacgcgggaaaatcgagtgaaccagtcgggactcttgactgacacggagcgaaaacaatgatggcctggatttacgaagttgggaagtttcctggtgagaaggaattgggccgcccgcgaccgcgttctgaagttgtgcgacctggtgctagtacttctgaagagcgccgccgtcccaacattagccgcgggtttggtcttgtcgaccaccgtcggcacaacttttctcgtccatctcttcaaacgtctaatcgtgaaggacaccagcaggaatggcgtggacgcgaccgctcggaatgggcttcggcgtcttggcgacgtcgtggttctgatcagtttcgtagctctcgacgtggacaacagtgatctctgctcatccgccacccaaagcctttttgactctgccgaattgcctatttttgatttattttgatctcttgacttttcattctcaacagggacgttgatatttcaaaggggggggtgtgatatttggataattatttaaattagtgctatattgtgtggcattttgtctcttttaatttagttattttcttttctcagtttttggaccattatgttttatgtttttggttgtcttctcatcttctcattaattttattgttttgtgctaaatataatttggattctatttttggccaccaattgactgagtttggaattttggaaagtcgaaccaaaagtgaattgttttcaaaaggagtcgaattatccctaattgctttccattgacattgccgcaccgacatctcatttcgcaccagaaaagtacgacatggcgctcctggacaagggtgagcagagtttgttcgattaatttctattaatttggtggtgcaacaacaattcggggactattagcaattgtccacaccacaaattcgacagagaaataaaggagtcatcaattgacgcgcctgttactcattcttgtagaagagtaacaaaccatcaaaaaaactacaaaatcgccatcgtcccatcgcccaacatttgtgcactttcttgtagaagtgtacaagaaaaagcagcagcaagcattcttgtagaaacttgcaaattcttctcttctcttcacaatggaaaacagtcgtcggtatatgacacgacaggagttgcgtcgtctgttagacaatggagttgcagtcgaaattgaggacaacgagataaacgtcgcacatcagcaaggattgcgcacaaattggacggattacgcggcggaaaacttcgaagcgtcgccgaattttcaaccagccgccgtttttatggaaaatcatcggcgcgaaatagcttttagctcacttcgggtcccaattcgaacttcgagtcccaataatcagaaccgggaccccgttgcaccaccggctcagaattttgttctccaaaacatgctccctcgccgtttagacaacgacactctttcatttggcggcgaggagggtggagtggaccaacacacgagaacgaactgcttggactttccgtgatggncgtggccggactga

SEQ ID NO: 25968 - DNA, 1960 bp, Heterodera glycines
actcgagtagattctcgaggttttcaagtgcttgaccttcggtactttagtccaaaaacacacattttaattaaaaatcactaaattaagagcatgtttttcaaataacatttgcgaaatgtaaaaaatttttccgagactcgtggtcaaaatcaggcctgtaaatagaaacaaaaaaaaaaaaaaattaagtggacggaggggggaaagaaattttttctcaaaggctcttaattttttaaggtgtaatttcaaaattaaagagccaagggcgaaacaaacatttctttaactttgtgcattgttgggtaaaattgtgaatgttgccgggtttgataaaaatttctttttaatttttcaaccccccccccatcagttacattggccaagattctctcgattaaacaacgatcaagaaacagtagtaatttcttgtttgataatctcaatcacctccttttcatggtgcaaaaacactgtccgtttgtccggactgatgttcacgtccaaagtgtgcggtggcacgtcgacgaacagcaccaagcaacaaaatctgccacggttgaactgcgcgtacacctcgtttgcaatgcggcacagctgaatgaacacaccaccacatacactttgcaatgcttaaaccgagcaaaagattttttttggtttttcccccgaaatgatgatgtgtatcgaacgtctcaatttggaaatgcaaccacccaactctttagtctcaagccggagggtgcagcactcttcccaccgtccggataagcaccgcccccggggtttttttttaagttacaggaaaattgtttgaagttttttagcgattttttggtaaaatttttcgataagtaatttattataaaataatataaaaaattttttttttttgtttttttgaaacttataaataaactcgaattgtaagatttttctttatacgttctccaacttcggtttttaaaattttttgggtgtgggggaaaaaccgtgtcccgacatttgcgcctttgtccaaaatctggttcaaaactaagttttttcaatcactgatcgcataaattgctttaaataagcgattaaaagtgattgtacccgatcatttgatcttcaaaaaatttttgaaaaaataataaaattttcaaacaaaaaattattaatcataatgaaccataaaaccgtgttttcttaattttaatgcttattaggctatcaggggttgaaaaaattcaactttgagtccgattttggacataggcgcaaattccggggccgcaaatgtcggggctccggaaaaacaatacggcggtgaacgggggggggggggaagcgaggtgcttcttcccaaaacggaatttattccaactttgtttgtattatactagtaaaagtttggtgccacaaactgtacaaccttggggaaatcaacatggcgttggtttacaaagacaaattgtcggtcagcactgctccgcccatggcgcgccaagcagctgctcacgtagccggatagccttgaaaaattggggggaatgatcagcagcagtgatcagacccagtaaagcccgaaaacagcagaaaaataatttagagaggagaattcgaagacttttttccaatttgacccctaaaaaaattgtgcaatttttcaaaattttagagtcaggcagaaagaaaaaaattactttttagtaggttttcgacaaaaaaataacccattctgcattcttgagtcaaattttgaaatcctaaatttttacagcaaattgtaacaaaaaaaatttcagtttcaggaggaaggcctggacaacaaatcacaccgaatttccgcaaaaattttctcccgctgttccgtcgttgtcgtcggcactccgtacaattggaggcactcatcgcgtggcaccccaacgtctcgtccaacgacaacatttgacccgcgccattgcttttgcca

SEQ ID NO: 25969 - DNA, 1078 bp, Heterodera glycines
ttcgccggtgccatgcgcaacacaatgggaaacatgcgcacttgccagccgctgaactctccgtcgccaaaacggtctccgaccaaccgccgccatttggccgtccgtcggcagttcagagccgtccaaaaccggcacaatgaccacagttttggcacaactaaaaacgaacaaatggacgggaatacaattgactgatgaaaattttctcaaaaatctcaagaattgcatattccgttctccatgctcatcatttttatggaaattgttgaaaatttttttcatgaaattttctgttattaaattgggaggaaacggcgggaggggggggcgtaatacatccatttttgtcttaaataaaagtaacaaacccgtggctttcgtcgttgtcctgccgtgccaagggctgcactcggttggtggccgcccacaacatacgcatcactaaatcgacactttgtccaaagttggccaccccattggcccgaattgtcgtcagctgctcaatgaccgcctttggactctcttcccaaccggactaaacaagaaacaaaatgccattattaaaagaaacgtttagctgcaaaaatacgccaaattccgcgttttttttgtttgtagttttttggctctattacactttaggcgtccattcaatgaccacctccaattcctttggcaataacgttttaaaagaaaagccctaaatatatttgaaaaaagctaaatctctcgttttcccattgaaaatttaatttcagtatttgctcctttcttgagttattactgaaacttttgctttcgattgacacgaaggaagtaaaatctcaccaagtaagaaaaaagttatggccaatgaaaacaaaaatggtcattgaatggacgcaaaaagtcaaatagacgcctaaatgtggttgaaccattttgtgtacagtaaaatgcagagtcccagcggaagcaaaacaattgtacacatgaacatgaacaccttgacattggaggggaactgctcaaaaggcgtcagaagaaagcggtcattgacggaggatgggtcgtcgcgattgcgttgctaaaaatt

SEQ ID NO: 25970 - DNA, 1380 bp, Heterodera glycines
ttttggcaaattaattaaggaaagccaatcagctacggtagactctattacagtatagcaatgtttgatgaaagacccatttgaagagatatatctattttagagtgttgatctctgatctgaagtttttcaatttcctaattagtttttattgcattttttctaaaaatttttcccagattgacccaagaactcgaaaaacttttgtcctaattttgaaaaaaacaggagtttgagcattttcagctgagattgatcacctgatcctgatcagaatctgctcaatgccaatcattcgtctcaacagtgtgtcctcttccatctgttcagccggcacattgtttggtggtgtttgattttgtggtggttgttgttgttgctgcttttttgttgttgtaccaccggcacaaccaccatcattttgtggagcatttgtgttgccataaatgggagtggggaaggacgacgaagaagtagagaaagaggaagtgccaccaacattgttgctggacatgaagccggcggaagtgccgccactaatgctttgagcatttggcctcatgccaaaatgcgacgaatttgtgccattggcgccggtaaaatgtttttgctgttgcgcttggtgttgttgctgttgccataaatggtgttgctgctgagcttgcatgttgttgctggtgttgttgttatagttgggatagccaccggcgaagttggcaccgtttggcccagccaaagggccgagcttcaaggccggaatttggatcgacaaaggtttggtggaagaagccgaagcaccagcggaataggcagcggatgcatgggcaggagcaccgccaatataagccggcgtaaaagcaccggcagaggacgagccggcaccacctccggcataatccggggtataggcacccgtagaggacaagccgacacctccggcatactccggggtataggcagacggtcgggcaccacaaaaataggcaggggtaatggcaccggcagaggatgagccgccggccggaatcaggtaagctgagctgctggggccggagaaagacgaggacggcatcgatgccgaagtcgtcgacaacattgcggactcgcatgggttggccccgtcactgctgtccgtcatcggactctgtttggactgttgctgctgatgcttctggcgcggctgtctgtccgatgggtagcgacgcgtccgttttgtgtacccaatggggtcccggttttgttgtattgctgaaaagttgggagagggggtggcaatggttgaaaaatgccataattctaattcccagtgccggaccaaaatcacaaaacagccctatggaaaatcagattaagtttaaattaaaatttgtgtcttttaaa

SEQ ID NO: 25971 - DNA, 1961 bp, Heterodera glycines
tttttatttaggagtatgaagaatggctcaaagaattttcatgcttgtttttttgtgtgtcacttacatcaaatttgtttttggtttggctatgcttttctgcttatcacgacataaacacgtaaaacgaacttattcgattaggatggaaaatttaaaaaaccaacaaattttaaaaatctttaaatttgaaattgtgaaaaaaccgcaacaaattttacagtcttaacttttatgaaaccaattctgtcgtttgttagaattagagaacaatttaagctgtctaatagtgatgctcgagagtctcggtttcgagtctagacacgagaaaagtcccgtgttttttttgatctcggtttcgagttttaagtctaggtcttcaagactttcgagaccgagacttttttacaccccctaatggttggcttttggtaaacttaaatttttttttaatggttttaaagcgaataagaaacttttttgaaaaaagtcccggggttttcggtctcgggctcgagtctcggtctcgagtctcgtgaaatttttggtctcgagcatcactactgcctaatgacactaaatttgttgaatttttgtttccaagaaatgtcgacaatttttttccatttaaacacatttaaaaaagttataaatttgaacgaataattaaattaaattaatattattttttaaatgaaaagcatggttatgtgcacaccttctgacatcagtgggaaaggactcttctacacaatttcgtttaaccgatcaatgataatgcacattctattgatcattattaacaatacaattgttctggttttaaaattcaaaaaaggtaaagtaaaataaatatttgaatatttcttaattaatttattgtcttaattaaatttacggtttgttcatatgttcagaaaatcagcatttctcgaaaagcattttccgctcattgctcttcctcgtctttttggaaacaattggatggctcccgtcaatttattttgcccaatttttaaaaaccgcaaaattttcaccaattacgaccacttatatcagtgctgggttcacaaccatttcaacatgcattacgtcatcggcaaatggaccgacactttattattttaggtaaaaaactttcaaattttaaagttaattaaattgcattggaaaattagtattaaataaaaaaatttaatttaattagaaaaaactaataataattaaaaattaaatttaattgaaattaataataactaaaaagtaaatttaattgtgaaattagtaataattattcgttgattattagaaattcaaaataaatttaaaattttacttttttaagtcttttatatcgcgaggaaattaatgggtttttggaaagcattggaatcaaaaagtccatcagcacgcaacaccaacaacacataaatacaatgccattaaatgttgtgacaagacataacaattggactcaccattagaagagagtcgggtcgtttcggcgccagcccaagtttttggactactttattcattgttaatctaatccaaacaataaagcctattgttgtatgcatttcttggggattttaaagtccgccacattgacgtttcgtaaaatccgacaccatggacatttcgtaaatacgccagagggcatttcgtaaaaacgccttaggatcgtatcaacgacacgatgataccgagtttgcagctcatcattttgtaggctaatagagaactcttagactattgattcatatcaagaattaaaaatttaatgagcaattatttgtttaaaattttcatttgttggtttttatataactacctagcacaaaatggtgctgggtcgatacttaaaaaccatcataatgggcgatacttaaaaaaccatcataatgggcgatacttaaaaaaccatcataatgggcgatacttaaaaaaccatcataatg

SEQ ID NO: 25972 - DNA, 781 bp, Heterodera glycines
aaatccaagtccagagcctggacctggcttttcctagttctttgtccagaaaaaatccaggtcaggcttttttcagaatgcccaactctaataagcaacactcttttaaaacatcaaattaatatttgttatcacgtacagcatcatcagcacaaaaaaatggtcccagcgacaacgaatgccgcgactcactgaaaacatttggcaaattttcaaaataaaagatggacttaattggcaacgcttaattacctaatcaatccaattagggtcaatttgcgtatttgtgattagaaatttaacttttctttcacaattttgccgccaattgggccattttggtctcattttggctccccatattcccccctcccccctctctccctgaccaaccgtaggacaattcctcaggaaatgccactttcacatttgaattgtgcgccccgacatcgccaactgcgcaaaagcagtaactcaactgttccccccaaatttcggctgcgattttgctggtgccaacttcgcattggtcctccgtcgtgccgcagtggaaaaagccccattgtttgagccatttggacccttaagatttagataaaaagcatttgtgatgaattccttaataaaattaattcccatttaaatttaattaaatttggcacccgtccaatcgattcttttgcgcaaatggacacgaaacagtgatcagccgtatcacttgggcatactttgttcaattcgcttatttccgtaccattcgaaaaagcaagtccgaatttac

SEQ ID NO: 25973 - DNA, 903 bp, Heterodera glycines
aattgccatttttcaagaatttttcagagaattattaggaaatttatttcataatacaactaaataaatgtcattattagggttataaattatatgaactaaaaaactcgacaatggccaaatatggaccaaaatatggactaaaaactgccaaaatataagttttaatccctcaaaaattccaaaaagtgtttacattcaatatttgttattataattaccatcacagcagcgtaaagtaagcacacagaagataaagaagaaaagcgaaaataaatccattacaatttattatgtaataaagtaaaagaaaattaattcatttgacgaacgaataaaatattggaaattattaccgcttttagagaagtgtgaatcatttggcaaaaagcaaaacaaattcattcgatggaaaaggaaatgttaaaacatttttacatcattattaaatttttaaatatttcacataatattatttacaaatgcttcactttttgggtacaattcttttccaaacccagcccaataagctatgaatttccttaaactcttcttgggtttgcctggctttccatctttttctttttttgctccaatggaaacaaatcattatttaatttccattttaattaatagttaaattatttatacgtctgtcatctgtgccaaagaaccaaaatggaagggtaaacttttggctaatttcgccaattttccgtgagagctcaatttggcaataaatgatgacgcattgtcactgcttatttggcgaaatgggcaaatacaaagaacggatggcatggaaattccacagaaattgccgagaattacaatggcttttctcgtggggataattttcgaaaagccagtgacaaaatgtgaattctaaccagttccataaag

SEQ ID NO: 25974 - DNA, 1983 bp, Heterodera glycines
tacggattttccggatttttagttcgtaatccgtatgtgtgcctagtccgtagtccggatcctgatccgtacaatttttgatacggattacggattttttttaaactgaaccttttcttgaatattatttttgaatttacattatatttcgccaaagcactgggaaaattttaccaaattaaaaaaattcaaaatttttatgccaaaaactcaaaatcattactagggttgtaaattatatggattaacatattttttctgcgcatatgctataaagtagggttgcacccccgaccccgccccgaccccgaaccccgacatttttggccatttttcggggttaaccccgacccgaaccccgacgcttccaaccccgacaaccccgaaccccgacccttaaccccgactcggggtcggggttaaatatacacccctaagaatggcatttttgtgagagaaagtcaagaaaatttaaacaagttttgaatttttgaaccattttgccaaatttttattaaataaagaaaatttgctttcaattatgacatgtattgtggtgtattggttagtgcatcacactgacattactgtctttcataagttcgataaccattgacgttctcatttttaatttatttttttgtgattaatactagagttcgggtacggaccggatccgtatacggatttttacggatccgtagtccgtattttttgggccgatacggatttttacggactacggattttccggatttttagtccgtaatccgtatgggtgcctagtccgtactcttggtccttatccgtattttctcaaaataccgatctctaattaatacattttttaaacaaaattatcaataaaaatagaccattcttggcataattgttaacagattaaacccaaattttcaaaaaaattttactttcgttgaaatttaaaattcaattttcatgactaaataaatcatgaaaacaatatatttcaaaatatttacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctttagaaaaagcgcaccgagaaaaaaagatgctttgaaaaagaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttagtatgagaattataaaaaattttgactatatggcataaggtaaaaatttaaaaaccccgaaccccgacccgaacaatttggtcgaccccgacccgaatcaaccttgacattactttctgtcgtgagttcgattcaggttttccaattttgcttgagtaaatcatgataatttaatatattaaaaaaacaaaaatttatcgtaaaaatcttattttttttgtaaacatctgttagaaatcgagcttaaatttaaaaattcgccagcaggcggcctatcggcaccgccggccccccaaaaacctattttttaaaaaattagccaaaaatctaaaatttggtaattctttagacaaaatctgtgtaatttatgccaaaaggaattgaattgaggcgatacattgactaaaggaatgtggagccatcacatcattcataaaaaattaatt

SEQ ID NO: 25975 - DNA, 2137 bp, Heterodera glycines
  misc_feature (2128)..(2129): n is a, c, g, or t
gtttaaaaattatattgaccatttaaaacatactatttatttgtcaaaagaaattttatttgaaaataccccgggtaaattttctgtttatcacaaaatattttggcttttgtcaaatattcgaaatatttttgcgttttttcgtcaatatttattttaatttttttttgtgcatttttgaaaatataaaatcgaacccatgaagtgcattatgtagaagctcctccccacacccctccttaaccctctaattttcttttaaaatacattccctgtttttgtttttaaatatttttgcaaattgtcgcctccactttttctcaaataaaataattaagccaaaaaaaagtccacaaatagtgccgacaaagtatcagctctttgcctgtttttgtccccattcttagcttcttcccacgctttgtgaggccgccaaaagcatcatttaatttgcgggagggccatcatttttagacgagagtccgtccgtccgctaataccccactcttctggcagacaatgaaatttcgtcggctgtttactgcattttttgttggaaaagtttctggccacaccataaataagtgattaattttcatcacaacgctttgaacggattttgagataaagcaaaaaaaaaaatccgctgaattatagagaattcatggaattattggagcaggtaaatttattttttattttaaaaattttttgaaaaaattattgacggaaaaaattaatttttaaaaatttgaaaatgttaaacaaaatctgatcattatttgatatgatgctcataaatttttcaaaaaatgctggtatttttatgacttttccacaatatctatggattttcgattaaaaaaataaatttgaatggctgtgagaaaattgaaaaataccatcattttactgcattaataataataatcatatcaattaaactatttttagaaaataataaattttgaaaaaataacagtgttttttgagcacattttattcattcattaacacataaatttaattttgtgaattgcaaatgcatttaattttgctcgataaaatagaagaaactgataaagatttttgttagttttcatatttttgaacagacactttttcttaatattttactaaatttaaataaatattttaaatttttaaaataattttattaatttaaatcatttttatatttcctaagcattcaaatggaataaatgcattgattaattaaaagaatgtttttgtttttttttcggtaactttttcttcccgtcttaaatatcaataaatacatgcagcagcattcattgctttttcttttcgccattttatcactgctcaacaaagattctttttttttgttgaaaattttcttttaaaatttcaatttaattttctttttttattggcattaattttttatttcttaaaacaagaggccaaaggacagcacacctaaaacacaaaataagtaaatataattttattgtacttttttaaaatattctttttattttttcttaatgtccataaaataatggcctatttatcaaaacaatattttaaattcatcatattatatagaaaaattcgtctttttttaatttctaaaagaatcgcgacatcggcaactttattttttgtcacacaattttcctatttttttctgttgtatttgtttggctcaaacatttgtcgttaattggtaaacattgtgccaatgcagtgtccttgtcccattatttttcttcttcgaccatgactaattttgtggcgtcgccgtacaaagtgctacaaaaaatgggttaaataatttaacgaaattagtgccaatagaccgaagatgacacggaaatatgacgaaattcaagcaatgaaatgcaaattgccatgaatttccgatgataaacaattagaaattttatttttcaaaaacaaacaattttcacttgagcagacctacaaaaatttaaaaaaaaaataattttatttttataattaaaataaatataatatccctataatgtaaaatttgttgcgccacttaataaatggaatagttttatccataaaatttttaattagaaatagttttacttccttcccagtaaaaaggaanntattgata

SEQ ID NO: 25976 - DNA, 1402 bp, Heterodera glycines
  misc_feature (183)..(183): n is a, c, g, or t
tccgcggaaatgatctgttgaggatgcaaatgaagtgatttggacgaagaacaagcagagagagagagagaggagaaagaaagaaagacgagagagaaagagataagagagagagagagaggagaaagaaagaaagacgagagagaaagagaggagaggagagagagagagaagagagagagnagaaagagaggaggaaagaagagaagagagagagagagaccgactgataagagaggaaatgcggcaaccaaatgccgtaggctgatagacaggactgatagatcaaagagtgattgactgatcagcagatgatcagaataagtcaatgctcacatgtgaattggtgcacacttcgtccccctccaattcgccactttcttcctccactcgataaacgtgcggttcggcgagagtcgccgacgtcgttggcggtcccgcggtggcggcgattgcccttttggcgatttcgtccgttagcaattcgatgcctttcattcgcttcggaaatattggcacaaataataaatgtccgttgtgtttattatgtaattgtttctatggtttatattcgaattttgcccatcaaataaatgccttcttttttaggaaaatgcaaattaatttaattggaaaaagagggaaagggaggggagagatcattcattgggttgaaaaatgggaaaaatgagaagcgacacatccaatggcataattggcgaaacaaaaaggcaagaaagtgtcaaccgtatgaaaatggaagaaaatttagagaaagaaatgctctaacgaacgcacccgaggggaagaagaccggggggggggggcacaagaaggagtacgtacgtacgtaccggtgctagggcgtttcttaggaattttttttgtgtcaaattttttgttttataccccttggcggatttacgaacgactcacaaccagctcggtacgtacccctcacaaaggggacaaatttaaaaccgaaaattggccgtaaattattttttctaaatattatccctccaatctaaaaattccaaactttcctccgccattttagtcctccgttttttccgtgtcttttttctcttcttcctcacaatttccccttcatccttcccatctttttacacttctcattttaaaattcaaaagaagaaagtgaatttgaaatgtgaaaaagaacaatggatggtgagggggggggggaggggacagaatgccaatgccaatgccaaaatgatgcaccaaacaaacgaccgaacgaacgaccaccgccaaaatttctttttattctttgagggtttttggtcgaaccgaacaattttttgttcattgagaaaggaaattttaaaataaaaagaaaaataaaaggaaaaggaaaaagtgaaaatgaatgaaa

SEQ ID NO: 25977 - DNA, 1076 bp, Heterodera glycines
aatttatcagaatttaaaagatctgactaattttccccaaaaatcttcaaaatttctcaaaaaaccacaaaaagcctcaaaatttctcaaaaaaccacaaaaagcctcaaatcctcatttggaaaattatagcctcattgacctatcagaaaaccacaaaatgaggctaaagcctcagatctgggaaccctggttatgacaccaattttgaccaaattcgaaccccaaataagcttcagcttgattacgcttaagcctaagcctaggcataggcttaagctgaagcctaagcctaagctaaagcctaagctgaagccgaagcctaggcctaagctgaagcctaatccgaactttattctccgtcccgaaaccctataaaacgactttatttcgaatttccttttaatttacgatttcgaatttttgtccaaattagggttcggaattttgcaacacgaggggagggcgtccggcggaaaactgatttgttaacagactaaaaaaggccaatttttccaattaaaaggcaagcaatgactttttcaaaggaaggattctttgtaccagtgttatctcaggaattgaaacagaaggaagggcacactctgaatttcagtttatctccaaatttgggcggctaaattcgaattccaaacgaaatgtgtgactggtagacttataggaaggaccacttttgtctaactcattttgacctgaatttacaaggagtggaccgagttctacgcgagctaaccctccgaccaaacagacgccaaattttaccgccccacgccccccccccccttcctacaaaagcatttgaattgaagcacagatgagcatttattaagcacaacaacaatacaattacataggcaacaattaaatatacattcatttgaagtgatgatcacagaaatttacatacagatacaacaatttacatgatgggggacaaaatgacaattttgggacggtgggatgggatcctatcatgtccatgttgggtgacgaagcatccttccatcagacgttgtacacgatcggcaagttcttgcggcgcaccatcccgtctc

SEQ ID NO: 25978 - DNA, 952 bp, Heterodera glycines
  misc_feature (869)..(869): n is a, c, g, or t
  misc_feature (911)..(911): n is a, c, g, or t
catagaaattccatcccggctaactataggataatttcgattacaaattaaatatttaatacattgtgttggccaaaaataggtggatgattatggggtgctgtcactcgccccattttgaagcggttgccgtcgggatcaatttgccaagcactttggactgttgctcttcctgggcaatatggaggacgccttgggcatctccaatactcaaagccctccgcgattcgcgcatctcgttcaaagcagtaatcaaagttgtgacatgaaatcaaacttcttccacgatttgttttagtctcattaaaacggaaaagggccattttctcgggaaaaatgcaaatgaccaatacatttcatcatttccaactacacaagataacccccatactcaaaaaagataacgagaagaacggtcaaatgcaaatatattaatgattctcgtttatcaaattttatgggaaaaccattaatttccgttatcaacatttagaatagttctccgaatgcaaatcctttggctttcgtttattcacttagaatgagtttgaaactttgaaaatggaacagagaaaaattatattaaagaccgaattgcatttttttaaattttgattattctattttttaaaaattctctatagtgtcgaaattactcaatgtcgaaatggtccagtgtcgaaaatgcaggaaaacagtgaaagttttagaaataattcagtgtcgaaattacttagtgacgaaaatgtagtgtcgaaattacttagtgtcgaaaatactcagtgtcgaatttacccagtgtcgaaattacatagcgccgacaagagtcaaagtaaggaatatttcttccaccagcaatgctatagtanataaatcgttagaaatacggcaaaaatttgccattttccggncggcggctaccgtattgccggatttcagaatcactattaag

SEQ ID NO: 25979 - DNA, 1272 bp, Heterodera glycines
  misc_feature (1219)..(1219): n is a, c, g, or t
  misc_feature (1252)..(1252): n is a, c, g, or t
tgggggcgtacgccatgtcgaagcgctggtggcgcgacgtacgcttgggcgtgagcgtacgcgtccgaggcgtacgcattgagccttctggggggggcgtgcgccggggggggggggagcgacaacggttggtgttgggggcgtgtcggtcgacggtgggattctgtagcgtaatgtagcctttgggaggcgtgcgcctggtgttgggggggggggggaggcgtgcgcccagttatggaagcgagcggtcgtcagttggaggagggggttcggtcgacggtgggattctgtagcgtaacgtagcctttgggaggcgtgcgccacgggtggggagtgggcgggaggagtgagcgtacgcgtctgagccctaaggcgtatgcatcagcccgagaaaaagtaacaaaaaaatacattgacgaccgcgttcgacaaaacacgagactcatttcgctttaattcacttgcgtgacggtgcaggttcaaatgagtcaggggttttgccaaaggcggtcgaaccttcaatgtgcggtgtcgaaccgtcagcatccgaatgcttcaccactcggccaaacgggcaccggagaaattaaacgaattggggcaatttgtgaggagggtaaagtgccgcgactcttatcccgttgaggtggtgctcgaattcgttgtgctctgcgctggtattgctgctgctaccgccatggtcgctgttaccggcgctcgtcaccccaacagatgctaggtgcggaccagcaaggttatatggggggtggtgagccaaatccaaaccaagctgttgaaggcgtagccagcgtacggcggtgaagaagcagaagagaaaaatgggcactacaacggtgtagtggagtgcgaggatcagtgcttgagcggcacgttgtaacgtgtcgctgtcgggccatgcgtacgcgtcgggctggtacacggttagaaaagcatcggcggccgctggctgaagcggctcggccgtctgaattccaccgtggaagtagtcagcgaccggtggtgttccgttgctgatcatttatgttttttttttttttgagagggagggtattggtatgctaatttagtttcgtgcctctacaaatgaaaagtgatgctggagggtctattttctcatctttttatgcaatttttgaatcggtcacaatatgacggttgtaatcaatcatgattagttgatcgaatttcgccagacaantcatttcaacgccgcccctgcgtatctctctgntgaactgaaggcgtacactt

SEQ ID NO: 25980 - DNA, 1062 bp, Heterodera glycines
tgataggaaatttaaattgatcataatagaagtttaattttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttagtgacaatttttttcaagagaaggataggaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaatcaaacccgaaactgataggaaatttaaattgatcataatagaagtttaattttttttgtcccatgcattttctgggaaatcttttcgcgaaaagtgagaaatttcaaaacggcagacaacagatgcatttcaaa

SEQ ID NO: 25981 - DNA, 2163 bp, Heterodera glycines
  misc_feature (6)..(7): n is a, c, g, or t
ctgcannggtcgggacaaataacacaatcgcaaaatggcaaaaccggaacactttttaagaactttcaagcatattgcatcgactccaccggaaatagtggcgaaggcgaaatacgtcagtcgtacggcgtgtgcaaacgaagcgaaggcgtgcatggacctgctgaaacaggcgcagacgtaccttcaacgagcacaggtggaggagaaagcaaattgaaacattacattatgatgataaagcctttgatattcaggaaaaggacgaagaggagcgacgacagagagaacagcaggaggaacagagacgaaggcttttggcacgacaggcggaggaggagagacgaaggcaggaggagctgaagatgaggttggagaagctgaaccaacagcgacagaaatttgtggacgagacgaaagacattctccgactgccgcaagtaaatgaggggaaacgaattattaatcccgggaaatttgcaccattttcaaccatttcaacgcattgttttcttttaataatgttcattttgcacacaaagattcgagaggaaaagaaagcacgcgtctcgacgagcagaaagaagcgcgagggcggcgaggcggaggatttcgtcaacgacagttcggacttgggcgagtacgaagatgaggagctgaggaacgccgctcggaagatgaaggtgaatgaatggtgctttaattaaggagagacggaaaataatgaaccacaattcaatcacttttttaaagactaagaaacgccccgagcaagaaatgagtggagggtcggaagaagacgacgcgacagtggagaggaggcagaagaagataaaggcggtggagaagcggaaaagggaccgcaacttggacgagcaagtgccggcacgattacggggaaaaagtgagttcgaacaagcagaaagccttcgtttacattttatttcttttcagtcaagagcaaggcctatctgtcgtcctcgtcgtcgtcgccttcccccgctcagtcgggcgcagagaaaagtggagacgaggaagagaaagaaagagacgacgaagaaatggaagtgagggcagagaaaggaggtgaggaggaagaaagagaagacgaagaaatggaagagagggcagagaaaggaggtgaggaggaagaggaagaagaagagaacgaaagagaggagagggaagaagaggagcgtgaaaagatgctagaagaaggggaagagagagaagaaaagggagagaatgagcacggagaagaggaggaagaggagcacgaacggagagatgaagaaggggaagaaaatgtgcatggagaagaggaggaagaggaacaccaaccgagggatgaagaagatggggaagagagcggaggaggaggagagggagacgaaggagaagagatggaagaggaagaagagaaggatgaagagggaagcgaaagaagagaagcgatgggcgaaggagaagaacaagatggagaagaagaggaggaggaggaagagtgattttaatttttcaggtcatcattatttatttgtgcatcccaatttttagaatttttataaattcgatttttacatttttaagtcatgtcaaacacggagcgtaagacgactaacttatttgttaggtcaattaattaccagtgaatgtgaattagtttaaacaaaaaaagtaatttggaattagaacaatgaatgcgactgaataattaaagaagaaagcgagagaatggttaattatttatttttgagtgcggtttatggtgttaattgggccggttggctgcgggtgggggagaaacaacggacaaaaaatgcatttggtttttataagaaggaaatagagtgtaaaaaatgaaaatgcacacgaagttgcaatggaatcggaaaggctgaattgatggggaaacttttggggggagggaaaagtgtaatgaatgggcggagcgattggagagaattttcagtgttttttggccgcgtgggggagggaatgacttacgatgttcagagtttcccactgacaattcgtctttcattctcgcgcttttccgtcccctttttgtcgggacatttcccacttttggtgaagggactttcctttcttcgttattacttttggagaggaacgaacgaagggatggacagggcgaagaga

SEQ ID NO: 25982 - DNA, 1830 bp, Heterodera glycines
  misc_feature (9)..(9): n is a, c, g, or t
  misc_feature (11)..(12): n is a, c, g, or t
  misc_feature (37)..(37): n is a, c, g, or t
gcatgcctngnncaggtccaattttcccataaaaaanattttgtctcaaaaaggccaaaacgttttgaacattataaaataatattagcaaaacatgggtatttgctctgagccggggaaagctttttcaaataattttgtaattccgtttttttttcacgttcccacctgatcgtcttctgcaactttgttttctgatatcgccataaatttctcagcggcacgtgcaattccaaagtattgctcgtaactcaccccagcaagaaatacctttaagaaattaaaaaatttaaatgaacgaacgctgaaaaatgactattagcggaaaaggctcacaaacgttgtgagaattgtttcgcgcttatgttatagtacaaatttactaaatgttggataaatgagaaaagatttcccatgtgaaaattttgtatttttgacatatttataaaattgacctttttgtgctgggcattggccacttcggccaattcttcccctctcataaaacccgaaaacattttccgatagtcgttcatgatcagatgcaatccgtcctccatttctttgagtgcaaatcgaagctgccgattttcctcttcgagtgcaatgatttggcgactttcctgttgcaaattgtgcactaattgcgttctattcctggctctccagcacgagttcaatgatgcgattttgtcttgatactgaaaataattataaaatgattaacttaattagtctgggaatgattagtatggatgaacagggcaatttggagctaattgaagggttgtcaaaaatgaaaatgtacctccttcattagtgtgattttctcattgacaatttgtcctttgctaacggcagaatttgccacgtgaagtttgtcttgcaaattcgatatgtgttgtcgcatatcactgagtattttgtccatgtccataatgataaaagaaagtccaataaacgcctaaaaagaaattatgtataatggacagtataattgcgattctttttggaaaattagtattttatggtgctagggcttattgtcggatagaaatccgggtttagtttttagtagtttaatacataggtaatttaattttaatatttgcttgaaaattaaaaaaaaatatttttttttagaaatgaaaattattgttttattggtacttatgttgtttacagactgtcagattcgtgatcagcgaccccgaaaaccccctagaaatgtttaaatgtatgatttattaaaactatttttttatggtctgtaaacgacattagtaccgttttatttttggtgattttgcagcatcagcattaaattttccctttctcccattttgcggataaaatggtgcttctaaaatccctccttttcttcctcccattttatttgttttctttttccttggtttcttgccctcctccgccagctaaaagacagaagacggaatttcaacatgagaataaagcgaatgataacgaaaatcgggtggaagaagaagaaccggacaaagtaatcaatttatttgtatttgtttgatggattatgttaaattttagaatctatacgactttcactactcaaaatatctggaattggccgtcccaaatcccttgaaagtcagccgaaatttcagcaacgtttgagggaaatgaatgaaacacgacataaaagttcgtttttcgagggtttttttctcctttggaccattacaaaatttttatattccagcagggaaaatagccgaaccatttaaacaaatggacaaggaaaatttttgaccaactgaacaaagggcaaaaattgaagaagttgaacgactg

SEQ ID NO: 25983 - DNA, 1146 bp, Heterodera glycines
cgaacccaaaccaaaaattgcaaagatacggaagtctagtcgaggaccagtgtcagatgcttcgggcgaactttttcttacttcgtcaatacctacattcttagtattaaatgaaggcatgaaatctctagaagttttggtaatatatactacatattagttgttccccattttttagcgctcatattttaaagtcatgtaaaatatgtttgaatttgggcccggggttcagaattcggggaaatggttgacgttgcgacaaccgaaccccctccccccccccccccccctaaaacatgttaacatgctttttaaatttaaaaattttcgccaaaaacgttggaataaactatagaatattacagaagtttcatttaacaaacttctatactcaaaaacagacaaaacattaattaataaaccagtatttgctcgttttttatttaaaattccggagactaagctttctctttcgatatcaagaatgtatactttgacctagtagtaaaagatttggtataagaaactgaagatggtcattgattggacgagtaaactggaatagagcccaggttcgaactgttattgtgtcttgcattatttgttagggcgttttactaattgaaaacccgtgcttttagaaaatgttagtttgtttaaaggaaaatttaaaataaaaataaatgttaaaatgggatttaagtaaaaagggctaaatcaaagttgggggcagaagagatgagataaaaaaaaagtgagaggaggagagtccaaagaaccgcttaaatactggtctgtctggtcgtttagaaggaaaaaaggtatggtacaaacattcgcccggcgaagtttagctggcgcgttttttctggtccgcaccgcgggaccccaaaactcctatttttttcttagaaaaattgctcaaaagcaaaatttggtaatttttcgggacccgacctcgatgctttcaaccctagcaaaccccgtcttttctaaaatttttgcgatgctaatcggccccggcggatgaaagattttagaaattgaaaaatttcaatcttccttgacttgatcatgaaaatttaaagtaatttttaacatttttgacaaagttatcgaagaaaatgttaagggcgacacccaact

SEQ ID NO: 25984 - DNA, 1520 bp, Heterodera glycines
aattacataatgatcagaagaaatttttgggaaaacccagtgaaatggaagaagtcctgaaacagaagagaaaggtggattaagggaaatggggaaataatgaagatttattttataaaaaaacaataataaataattttctaaaaatttagaattttttgtagcttaaaatcaatttttattttaaggtgcttttaaatttcgaagaaaattgttgggacactaacgcttgtagcgacgacctcgaaatcattggcaacgatagtttaactgtccattataaaggaattttttctggtaattcacctaaagtatttataaaaataacttttcttcaaaggttgtgggcattccgtcttcgcaaaacttccgattttgcagaatgattcttcgtccgacatttgttactatgaaatttcaattaaaaatatgaaaatggaatacgagtaagagaatttggaaatttgaatgcattttcagaattttaaaaagtgttaatatttaaattctccatttttcagttctgccatcttcggattcgccatcaaagagcaagaagaattggacaaaacaattcagtataagaaaggcacttatgcttgggaaagtgatggctcggtttggattaacggagaaggaaagggaacaaatgacgaatattactacggtgttggtgataccgtaggaattggtgttcatttaatcactggacagctctttttcacgtggaacgggcaatgtttgggttggcaaacaaataatatttaattaaaatatcggtaatatgttgctcaaaaatcatcataataaaattttgacaaaaaatacaaatttttcgttcttcgtatcattctatagtcccaaatattctctattcgcctgaaaaatttcaaaaaaggttttccgaatacttatggtcaatatattttttaaaacttaacgaaatttttaaatttgcaggctgttcgagcacatttaagtctatttaataataacaagaaattaaaaatttgttgtttctcttaaccaaaccataattttgatggtttttgagtaagttcataatatccaaattaaattccttaactttttcacagattcctccggtcttttcgttgctccatcttttgctgattattctttgtatccattcgttactttgcgcaccactggtgacgaaattgaggcgaattttgggcccaatttcaaattcgatttggcactctctgaaggaagaagaaaacattacttaactgatcgatttgttttcttttcaaccattatgtcatgcttctatacaattataaatctgttttttatagttcatcagaaaaatggtcatttaatattataaaatattagcatttccattctttttattatattataaaatccaaaagtttaaagcaaaaaattaaaatacataatttgctttaagaaggaaacaaaggaaggatagtgaatcatgaggaaccataagaggggagggggggggaggaaggatagggaagcatggggaa

SEQ ID NO: 25985 - DNA, 1122 bp, Heterodera glycines
caaaatatgcacataaagcgcgaaatatgcacaaatatgcaaaatatgcacatggaaagtcatcctagaagcttcaaatcaagctaaaaacatgtttttcgtgcgtttcaggcttcccgcagtccaggaaaaaaaatatgcatgtgcatatttttggcatccctaattatcatatagaatcatgagcggaaattttatggaaatggaaaaatttccaaatcccaaaattgttttatttttatttgtaaaggttaaaaaacacgctgaagcctatggtagcacaaaaatcgtcgttgataccgtatgcacaccagattttgacgacaacaataaagccaattaccggtagaccgtttcttctattgttgaaattcgtcaagaaaattcaattttgaaaacacacatcaatttattttaaaatcaattcgggatctgccgtcttttcccaagttttgtagaacataaaaggtaactcgcccggtagatctcacgataccagcaattcgtgccgtgctctaaccgactgattgtgagctacgggcgctccttttagagatcctctcaggtcctttatcccgctttctcacacactccgcttccttatagcatcagaaaagcacggcatggattgctggggtcgtgggttcgaatccccgcgcgcgagtcaccttttatgttctacagttcggttttttttggaggttcccggcagttcgaattttttggaatttcaacctgagtctcgtcgatacagatcgacaaattgagtccggtaatcggacttttttagattctacaacaatcaaaacaacgcatctgcggtcattcattccggaagcggaagaatttgaagctgaggatggacaacatgatgacgaaaatgatgatgccgtagttgttggagctgctgaggtgacgacaaatgagctgacccgatggaggaggaggaggatgaaggatggaggcggcgattattacgacgaattgggccgccgccacatcggcaggagacgaaagtgccgacaaaaatctacaaacagcaaaagcacagccggtacggaaaaaaaatcgctgaaaattttctcaaaaatttaatttgcccccggaaaatctgagtttttt

SEQ ID NO: 25986 - DNA, 1294 bp, Heterodera glycines
aatttagcaaaagcgacttttacacccataagaattgcattaaattcccataaaatttttcaaaattttacctataaattggctaattttcagtgaaaaactgttataaatgatcaaaatttccaattttcttccccggcggcgcctatcggcaccgctgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccggcgccgcctgcccccccccccttcccaaaaagtttttttggaaaaagcgcgcctcaaaaaagcgttttattgatttttaaatttggaataaaattttaaaaaatgatttttgctttataattttaactattaaaaagtgggaaccgcccacttcggcgccggccttttcggcgccgttgctaacaactttttttttcaccaatgtatatgtttgttattttgagatttttagtgaatccccaatcccttaagcacaagcgagtaaataaaaatttgtttgttacaccttcattgtttacgatacgatacctattagctattacaaatcattcgtcatcgagtagggctggctgggatttttaggcaaataaaaatcgataaagttttaaaatgaccttttcatttcgtagtcgtcgagaatcgtggtgcgacgtttgaggacttgacttttgaggacccgacatttgaggacccgacttttgaggacccgacttttgaggatttgacttttgaggacccgacttttgaggatattcccgacatttgaggacccgacatttgaagacccgacatttgaggacccgacttttgaggacccgacatttgaggatttcaaggaataaattaaaaaaatttcgaaaccatagtgcgaatcctaaaaattttgttgtctgctttagccagagttaatttttgaagtgaaacaaattatgaattttgaaattaactctgtttccagacccaaccacgtggaggcagcagactttgagtccatacaaaccacaacacaaaaacaccacaaaattaagagaatataaaatcttcacaccaaaatttttattaagtgcacctttcccaagggccaacgggaacatattcacacaaaactaatttagggacactcaaatatctcgagccttcctt

SEQ ID NO: 25987 - DNA, 1214 bp, Heterodera glycines
aggtttttttaaactaagcgatttttttgatcagtcttttctaaagtcaaatagaatgggtaccaagaattttctgacactaaatttatgtgttttcatgtcaaaataaaaatggggaaaacccaaatttttgtaattttaactatcatggatttgagtttttgaaacctaaacgatttctttttcccacgaaatttggtgcgaagaaataggggagtcaaaatttatgacactaaatttatctgttttctatttaggtaaggtttttaattatttatatgtcaacaattgctaacaaactaaaaaaaaatttcgttctgacccgcttaaatttgatttgttatggattttacccaagagtaggattaacattttcattttttccaggatttgattggccaattcggtgtcggcttctactcggccttcctggttgctgatcgtgtggtggtgaccagcaagcacaacgacgatgcccaccaatacatttgggagtccgactcgtcccagttcagtattgtggaggacccacggggagccacgctgaaacggggcacccaagtgtcgctgcacctcaaggaggaggcgtacgactttttggagccggacacgctcaaaaagttgatccagaaatactcccagttcatcaacttcgacattatgttgtggcagtccagggtgggtacagagttggcattggcatttttaacggaaattggcattttgcaagaaataaataaatttacacattaattacagtccgaaacggtggaggaaccggtggaagagagtgaggaagagaaaaaggagacggaagagaagaagaaggaagaggcggaggaaaagccaaaggaagaaaaagaggaggaaaagcagaaggaggaagacgaagtggtggaagagaagaaggagggggaagaggaagagaaaaaggaggaggaggtaagacgaaaagagcatttggcaagagaaaaaggccccgaaaatggaattccaccatgggatttaagtagttttttgatcaatttaacaccgattttatccttttaaaaattttcaaattcttaggcatatcattttcccgttaaaaattttttaaaatttttactcgaaaaggaatttaggtatgtctccaaaattaaatgctcttataattatataaaaattatcattatgcacatacattttttaggggggggggggttcgcagcgaa

SEQ ID NO: 25988 - DNA, 1964 bp, Heterodera glycines
tcagtgtttggctgcgagtcggagtcggaatcgggcatttctataaataaaggatacaggaagagagagagatagagagagggggagaacggtaaaaaagcaaaacgatttagaaaattacaggaaaacttaggatgtcgatttaaatctagcaaaaacaaaataaaaggaaaaaaggaaattttggtaagaataaaagagtaaatccaaggatgccctataaataaaaaaacaaatttgtgaagaaaaaaagattatacggaattataattgctgatttttaactcccccccccctttctatggcaaaaacgtaccagcggaaaaaaaatgttgtgccaagtgtttgcaattaaacgttcccaaattatacgcggtatcaggcatattggaaaaaacgcgcgagacatcgtggtaggccatatgccatcccccttccccattccgtacgccactgttgctgttgttctcgttggtcgagtctgaccggcgactgcgtgaccgacgcgggcaaatttgccttcgtccgccctttccccagttgggcttcttcggtctgtccgcggtcggccgtccggttgacggcagaccagcgctttttcgattgtatcagcatttatggggatggaattgggaaaattgaggggagggggtaaaagtgaggggagagaattcaccggtgcacataaaattgagcactttcagagaacggagtcaaatggcgaagagtcagctgaaaaagtcagcgaatgtgaaaattcttaaaaaaatttgtgatgatcagacagaaaggaaaaaacacgaaaaataatgtatcattacaacataaaagtgaaccaggacaaggaaaggaaaggaaagaatgtccactcttttcgctaatcgaattacgccaatgaaacggaagacacaaaaatgatcagagaatggcatttcgtagtgagactaactattacaaaacaaaagcacaccataaaaggaacttatgtaaattttgaaattttatggcaaaatgtcactatttattaagaaattataagataagtggcaaaaattggctatttttgatgaaattctgttaacaaattcgcattaaaaattataaaatctttcacggcggtgtctatcggcgtcgccggatgcccttgtccattccccagaattttttgaaaaaacgcgccgaaaaaaagcatttttaaaagaaaaaaaagtcgtcacttggcttttaattgaaaaaattggccttttttgatgaaaatctgttaaaaaatcagaacgaaattatgcactgaaatttatgacttgctaatttcctcctcagaaccaggggtcttcggggtcgctgatcactaatatgacacccatttcgaccaattttgaccccggacccgaattccaacaaaagccgaaaattcatttttcaccaaaatccatcctttatggtccaaatcgaattcagatacactgtatggaactgtacaaataccgtacctccaaaagcttctgaacatgtttttctatttttttggttaccgtttctctaattatcccccgggggattattttcaacctcctcagaaagaaggggggggggataattagatacggcgggataaatggagacggagcggattatttttcgacagatttatttagtgaaaaatttttgaacatgtcgccaaaaaacggcatcgagtaaaaaatcatatgcattttttaaagaatttcttaattttatatggaaaattataaaaatggcaaaatatttacaaatcattctccaaaatatttaaatgcgaatatgtaccttgttttacgtttcggaaaatttggatttcaatttttgagcctggaaatttaggtaatttttagaaatagctcacttaagagtgacgcctatcaaagagcgaagaaatatttttagatttttttactggaattgaaagtgatttaaacttacagtgc

SEQ ID NO: 25989 - DNA, 1677 bp, Heterodera glycines
cgaagtccaacatcccttgaaaaagcaacaatccggtatttcccaggaaattaagagtcctaaaatttattttttttaaatattaatccttaaaattttaagttttacttacccaaaaatcctgaacgatttgcaactgaattaaaccataggttttttcattcatattaattttagcatcaataattatttttttactgcttcgctttgtctctgttcattctttataattttccgaaattgatccatcaaaattttctcttcgtcatttttattaattaattgataaaatctgcttaaagttaacgcataaaacaaacctaaaagatacattaatatatttattttccatttcccttacaataattgtccgaatttttgacgctaattctccctaattctttaatttcacaaaaatctaacgggttaaatcctaaaatattatgccaaatttatttttaattatatttttttacctgttccacatggtgtattatacgtggttattatacaggaaatgggctcatgttgtaggtcgaactcactatacgattggttaatcctaaatatttcatgcaaacggtgtccgcagtactcatcttcgggtccctggccggtaaaatgattgggtcatttaaaatttcacaaaacaaatcaatagaaatacgctgaattttccacccaattctttttttcatcattgattttttaattaaattttctattatttttttaaaattttctgatgtttcttttcggttttcttttttagggtttttaaatataaatcttgtaatattttcttcaatcccgtaatcgggcatacttttttcggttgatgatatttcgatataattattttcatttaattttatttcgtcgatagtttttttgaaaaaattttttatatttctttcttttcttttttcagccgggacggtcaggaattttttttgcgcctgagacattttttgtttttttattggactttttttttgtatataaaataaatattttattggtaaatttgaattaaaattcaatttgcgaaatattttccaaagcaatattttttctcgaaaaaagaaaattttttgcgcaattgtggcttttatagcggacccggagggctcatgtgataggtggaacgcctggcacgggatggacggggtccagctgttgtccgcatatttcattgacagttggggcatttttccttgacagctgactcattttccgcgcggtgcattgcattacgaaataattggtcacatgaccagtcacgtgtctttttttttaggtccaaaatgagcatttttggccatcaatcattttataaatgacagctgagtcagcactggcagaatttggggaaataagtgggtcatttagcgcgccaaatttgaattttgaatacaaaaaaaattgttttttcagttaactcaaccccctaaaaatccctgtctttttccattatttttcattttttgtaattcatttattttcattaccgcaaaacttttttttcttagcctgatttaaaacggagataaaagctcttcacttcagttgcttttgcccataaaattgtgcgctgtcagtttgtcatttagttatcgaatttttccattttcaatgttttcatctaatccaatttgaggtgatcaatattttatt

SEQ ID NO: 25990 - DNA, 1110 bp, Heterodera glycines
atgcgtgacgacgccacgtactttggacggccgtctgcaagtgcacggacggaagggctttccgcatgtcgtttactcaaaaatatttcgctggccggacctccacaaaaatgagctgaagcataaaagcttttgcgtttgtgcgtttgacctcaaagtggaacaggtctgacaacgagctggaggagtttattaatggatcaatttgaaacaatgaaaataactaatttattcacggttttcttaattaaggtctgtgtgaacccgtatcattatcagcgagttgtttcggttgaaggaattgagttggagtcgaacaatggaaggttggtcaagaaattgctgctacatatttcaatcgtgttaagacatttgcggtccggacaattgcggcctgctgaaaatcggacatttgcggcccgacaaatgcgctcggacttttgcggtccggacatttgcggcccatttcttaagggctattttcggacatttgcggccaaaagaatggaaaattatttatttaaaaaaaaattaaattaaattaataattgggaatttaattcatttgatcaattattcttgaacaaatcaatcataatcgaatctttaacaactttcaacagatttttcaattcttttttattctccacaattttttattttatttcataatgtcgaaatatttcttaatttcttttagggtagtgaacgaccggttattaatcaatactcccgcctttcgaccccggttttctgtttttggcccaaaatgcatgtttccgatttcggttcggtaaattagggttgcgaccccgaaatgtcggagttttatgaaagtcgtaaattgcacttcaaataagatggaaatgtccttaaatgagttattaagactttgttcgggaactttttattttatgcactaccctaatttctttctccaaggttatcatacctgctgaatcaattctgttaatagctctgccactatcaatattcgacagagtaatttaatgaattaaattcccaattattaatttaatttaatttttttaaataaataatttttccattcttttggacgcaaatgtccgatttcaagtaggccgcaaa

SEQ ID NO: 25991 - DNA, 2858 bp, Heterodera glycines
  misc_feature (2797)..(2797): n is a, c, g, or t
atatttaattgaattaattattatatttattttgatcgtttttttctctgtttgcttctttctcacccttttccgcttcttctcgcatttgcttctcctcctccatctcggccatcttcttcttccatgcctcctgttgtgctttctgttgccgttggaattccgcttggcgagctcccgcctcaattcgaagcttttccgcctccatttctgccaatttgcgcttccacgcgtcaatttgtgcctgattttgttgtccaaaagctgcccgtcttaaataatttttaaatatcatttgacagcgtaaagcagcggaaaattttattctcataaatcatccataattttctgaatgtaatagtttaaataaattatgtgcctttgttcatctgcaattctgcgcttagccatttccaattcggcctctttttggcgcaatgcctccgcttgcgactgtgccaatgcgtttgcttgtgcttcttcttcctggcggcgtctctcagcgtcaagttcgtccatctttttcttccattctttctgttgtacaaacacaaaagaatttgctttgttttgatatttttaaattattatttattaaaatattattatgataataatttttaaagtgctaataattattgcctgcagcatttccatctttcgcgcttgttcggctgcgtcgcgttgtgcttgttctttacgttgttttgcctccgtcatttcggctaatcttaatttgtaaatggatggaaatggatatattatttttatctgttaaatctgctgtgcgttacttccgttgataatctgcctgaaggccttggaacagtgcgtcattgctttggccctgtgcagcggcgcgtgtctcctcaccaagtgcctgacgagcgcggtccaactcggcaatttttcccttccaatcattctcaagctgtgcagcttcggcatcttttcttcgctcctttttaaaaattggtagatttgtaatagcagaaatactaaaacatttgctgcacctctgctttttgctgtttgaattctggcgttaattctaatggcacttttgtatcttttggcaattccttttgcacttccttccttaattgttccggggacttgcgcgtttctaatggttttggaattctactaaatgttgttccatttatgtcttgcgttaatatttgtgattgggatgccgttggaagggatgcaggtaatgcttcaactgtattatttgttggcacaaacaatgaaattgttggaggatttgtttgaaccgatgtttgcgttgttgggtaaattgtttggaccggtttttgcgttgttgggtaaattgtttggatcggtgtttgcgttgttgggtaaatggtttgaaccgatgtttgcgttgttgggtaaattgtttgaaccggtttttgcgttgttgggtaaattgtttggatcggtgtttgcgttgttgggtaaattgtttggaccgttttttgcgttgttgggtaaatggtttgaaccgatgtttgtgtttttgggtaatttgtttgagtatttgctgaaattgtttgtggattcgtttgaatcggtggtttggttgttggataatttgtttgtgtcagtgctgtagtttgtgctgtcgtgttcgttaaaactgtcattcggtttgctgctgtcatcgtcccatttgtttgtaccgtatccggtttacttgcaaaacctgggggtgcaatgggcggtgataagtccaatttgtttgtttgctttgtcggtgttttaccgctgcttaacggtgccggtggcattggcagcgatgccaccccattttcatttgttgctggtgacttttccgcatcgctgtccactgatggcgcctctggaaattcttcaaagcctgggggttgaaatgattggtcctcttcctgagtgcttggcgggtgcggtgggcccatgggttgtgaaaacttcgacgatggcggcgagggattattcggctgatgagactttggcggtggtggctaatgcaaaaaaaaaaaatttttttttaaatattaaaatactaattataattaaataatttcgttgtaattacaaagttaaagctgggtgcaccctcttgacctacgccaaattttgattgcgtgccaggaaaaggtgcttttgttggaacaaaacatttgagcaaaataataaaaaaataaagataaatttgaggatttgacatttgaatttctaaaatgtttaattttattaattaaaaatttattgcgtgaataaaaagaatttactttcttttgaataatcaaacataaatgaacgaaggttatttccttttgcaagagaatttttcgtaaaatgcggtaataaatttcctatttttcgttactttttatataatgttttttgatcaaaaatgatagataaatcatgctgatcaaaaaataataagtaattgtgatgagtggtggcctttttaaactattttgagcctgttttattccgctggtgcccaccccaatttgacaaatgtcaatataaacgcccaaaagtgaatggtttcatttgatcatcatttaaaactaaaggggcatcaaagtaaaaaaaaaataataatagtaagcaaaaaataaggaagtgtaaacggaaaggaaacaaatttacgttttctctcttaagaaaaagccgattaaatataatttgttcatcatttaactaattataacacaaaacaagggttaaatatttatttttaatcctagaaaaataatagtaaacaaaataatgtaaaaagaaagatgggtcacactanaatggataaatttcacataatgaaaaaaataactgaatagtatttttaaaaaaacttgatg

SEQ ID NO: 25992 - DNA, 1037 bp, Heterodera glycines
ccccataatctgggcgcatcggctcggggggactgccccgaaaacaaaaaaatcgatttttcaagtgtcgtttggggtactcaacaaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaa

SEQ ID NO: 25993 - DNA, 1631 bp, Heterodera glycines
gcttccctatagcctgtactttaattctgcgttggctttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcgtgctctgaagggcgggggggggggggggggggaatctctgggactcaaatctccggcattccaaacactgggactcaacccaccaactttcattggcattccaatctctgggactcaacccaccagcatttcaatctctgggactcaacccaccagcatttcaatctcggtgactcaaatctccggcattccagacactgggactcaacccaccagcatttcaatctctgggactcaattctcaggctttccaatcactggaactcaaatctctggcattccaaacactgggactcaaatctccggcattccaaacactgggactcaaatctgcggcattctaaacattgggactcagcccaacaactttcaatgacattccaatcactgaaaatcaggccaccagcattccaatactgggactcaattctccggcattccaatctctgggactcaaatctccggcattccaaacaatgggactcaaatctccggcattctaaacactgggactcaacccaccaactttcaatgacattccaatcactgaaaatcaagccaccagcattccaatactgggactcaacccagcagcatttcaatctctgggactcaattctccgacgttccaaacaatgaaatctccagcattccaaacactgggactcaacccaccaactttcaatgacattcaaatcactgaaaatcaggccaccagcattccaatactgggactcaattctccggcattccaatctctgggactaaaatctccggcattccaaacaaatgggactcaacccaccaactttcaatgacattccaatctctgggactcaacccaccagcatttcaatctctgagactcaattctcagactttccatcgctgggactcaacccaccagcatttcaatctctgggactcaaatctctggcattccaaacactgggact

SEQ ID NO: 25994 - DNA, 970 bp, Heterodera glycines
  misc_feature (15)..(15): n is a, c, g, or t
  misc_feature (62)..(62): n is a, c, g, or t
  misc_feature (83)..(83): n is a, c, g, or t
actggagctgtgtgnatgcattttgatgcccaggaaccaaatcgtaatatttttacgatttntaattcaaaaaagcatttttntaattaaataaaacctttttgtctgttgtcaaatgaggcttttgagagcaagagtgtactaagtaaaaatttcaaaaaattattcaaaaatttactaatttaagataaaagatatactgatttaaaaagatttaattatattaaaaaatgttaatatttttcagcagaagacccatcattttataactgcatttacggcataccaaacagtgtccaacaaattatccaggagtgccatgtggaagtcggctgttgtgagaggacatgttgcgacacaaactggcactttttttatttttaaaaatatatttttgttttttcaatttaacaaattaatttttcaattttaggaaagtcaaatacacatgggcaatcattcttctatcattgatttgccttgttgttgtgattgcatttgttgtttggtaaaatatactttaaaaaatttaccaaaattttattagatgaaatttatatattcagagaatagaatgaaatttgaaaaatcaatccctaacttaggaattttatgccttattttcgatgagtttcatgcaataaaataatttttttttattttcaaaaatataccccttactaagcttcatcaataaacagggatagagattcttagttgctaaaaaccgagaaatgttacataaatagttgctaaaatattgaaaaatgcaaaatatatcctaaaaaagttgtaaaaaattggaaataactgacaatgaatgcgaatattccccaaagatacttcattctttattcatttcgctagcacaaattccaatatttatgctggcaattttaatatttgctcatctaaggtaaaacataaaaatcaatcataataaaataaattaaattttttttattaaaaa

SEQ ID NO: 25995 - DNA, 1689 bp, Heterodera glycines
acaacattccattcctcatctccagagggcgtcaaacggccctgttggccttgtatttcggtaaaattcagatatagagaagggttttttacgaagcttatttgggaaaataaattcaaaagaaacctctttgaccggcatagattagggattaatctaaacgaggttcattgtcaataacactaaaaaaagaaacgtgcccaaataaattgctttcgaaaattaatttcacatttgttttcaaactcaaataaaaatggcctttattggtatttaaattcaaaatttagaaattaattagaattaataaattaaaaatttagaaatttaattaaaattaataaattaaaaatttagaaagttaattagaattaataaaatcaaaatttagaaagttaattataattaataaaatcaaaatttagaaatttaattagaattaataaattcaaaatttagaaatttaattagaattaataaattaaaaatttagaaagttaattagaattaataaaatcaaaatttagaaatttaattagaattaatttctaatcgaaaagcagagaaaattgccgtattcctccgcccaatgtatagcctaataatttgatggacaactcagccgtacaataaaacttacaattaagcctaagcttaaacctaaaccaaggcctaagcaagcctaagcctaggcctcgcctgaagcttaggcctaagcctaagcccaaacagcctagcttaagccattgtacgagttgccttttataaattctcgtaaagctgagttgtccatttcgaaaaacaattcctttaaaaatgttttttttcagtaactcactccaacaaactactaatttaattgcaaaattcaatctatccaaaatgaaaatgaactaattgatttatatgtacaaaaactatagcacgaaattttgaaaaaaacggcccggaaacccggggtgaacccggacaggattccggactaaaggggcttaacggttttttcaaataaagaaaaacaggagccagactagggcctgggaaaatcctgtacaaaattgtgtcctatcaaggctctaataatgcatagccctaataataatttaaaatttgtacttgagtttttaaataaataataaaataataaaaaatggaaaaatatttcttattttcaaaaagtacaaaaagcaaatacatcccctatgtgcaaatccatgatgacgtttttggacactgtaattacgcattacggttcaacctttttgagttgaactataaaaatcagaaaaaaaattaatttaattttaacataacatttggtggcgaacaaaaaaaaagtttaaaacacctgcgctccttcattttgatctaaaacacgaaaatgggttcaaatggagaaaaaatcataaacaaaattctgtatgtccgagttacaagtgcatagtcccaatcatgaatttaactgtgtttttgagttttaattaaatataaatttgaaaatgatattttgtttcctaaaatatatattatatatatataaagcaaatcagaattatcatgataaaaaatcgagcaatggaacgaaatattattacctctttaatgttcatttgattcttttccaaatttctcttccaattgaatgagccattgactaattttcaatatctttgcatttttgctttctcc

SEQ ID NO: 25996 - DNA, 1014 bp, Heterodera glycines
gaagataattgagcacgtacgccttttggtcgagtaaaggttcctccggtggtgctgatggcttggctcggtcctggagttcgacttccatcacgatcggatatcgcacttgttcggcaagtcttcttccagaatggaaacagttcattatggtgttgaccaaagattgtagcaaatgaattggcgccaagagcaaagtggagtaaattttgattttccacaaaagaactgtgcatccaaccaaaagtaaaatgatggcaattgtaatcaaaatccatttgatgtatttaatgattccaattgggtcttccatccatgcctttcctttttcaatcgtttcttccgctttttttctgaaactttcttgcatcttttccaccagtatttcgccgatggaaaaaatgtctgtgaccatgcttccgtgaatctcagtctgattaatgtcgactgtccctatgtcagggaagttcaattcaggccgagtgatccttctcgtcagttccttgagattctgttccaggcgggcctgctcggattcaaaaattgatccgcgggtgaagaaaattaatggattttgaaaatttgtctgttgttttgagacaaatcgatgtttcgaattggcttgttgaaagttcagtgtcattgttgttgaagtcagctgcccaagggttgttaccctgctcatcgcagtgagtttcagtcccgttatagctcaagtcgcgcgtccctggcttgacgaaaagtgtgcgccttgccaccaccacgggtagctcgcggaagcatttctcgccaatcttttggtcccatagcacatcctcagccttcagttgcctacaaagtgcaattgaccatttttgatcaagttgtgatgatctggtccaaaatgccgttatgtcatcccttttgtaaagagagcgggctgcatcttccggcatctgacgtgctaatgcctttgcgatggaaagtgcattatttcgttcgtgacagtcgctcatccatttctctcgtgcattt

SEQ ID NO: 25997 - DNA, 1812 bp, Heterodera glycines
  misc_feature (39)..(39): n is a, c, g, or t
aaaaaatggggaacaatttgattttaaaaaaatgaacantgggcgcaaatgtccgaggcgcaaaatgtctggacacgtttggaatgcattaaattaaaaaaaaaattttttccaatttcttttttctcacaaatttttatcaaaaataacaaatatgtgcaaaattccaaataatgtgtgaattgtttcaaattgagaattttgattaaattttttagcagattttcattaaaaatcataattagttgattttcgaaaaaattgataattttcatgtatttatgaaatttttttttggaaaatttggtgaaataatttcgtttttgattgctctattaaaaaaccaaattaaaagattgtcaaacattatgccaatatatcaaaataatcaaaattttaacagatctggcgattttctcctcaaaatttctcaaaaatacacaaaaaagctcaattcactcaaataaatcaaaatttagaaatatgttattgtttctggttgctttgacgttaatttgtattgttgcttcacgatttgaagttgattatgatcaactaaccgcagaacaaaaggagcgtctcaagctgtctttaaacaaaattaatgttggttatgaccaactcactgcagagcaaaaagagaacctgatgcggtctttcaagatgattgaagagtggaacaaaacaccgggaattacttatactgtgctttttaaatattttttatgtcatgtaattagccttattcagcttgggatcaaccaattttcattgatgagcgatgcgaagattcaatctttcgttagaaggacaagggacgatattggcctcccgaaaattccgcatcgctgcggtggagactgttaccagatcaagccaaaaccgttgaaagaagaaaacgaattggcacttgtgggaaaaggtagttcaatatcaataacacttaataaaataataactgtcgtttttctttacagtggacgcggtgactttccgtcaaattgatgagagaaaaggcgagccggagagacaggcaaaatgctctccaatttcacggtttttgtcattttatggcttaatctgctgatgttccattttttcttagtcaaaagagccattctctttttccccaattattatgcaatggctgaaaaaacaaatgccgagcaaaatgtttctccgttttacacggaatattcacattccgcggttttaaattggatgaaacttgggacgaaaaaaaggtaaaaaacaattattgaatggttttataaggtttgcagtcagttgttcacctaatgaggagaaggctaaaggctaacaattcactttttgcaaatccatttagaaattccaaatggacttatcgggagatgcgttttctcctgctaattggcgcattgggacgcaaggacatttgcctcaaagtcgaaaaatggaagaaagacgactctcaccgcgtactgccgaatattgcaaatcgaatgggcgggaaagggcaacgaatttttccacgacgtttgagagacgagccggaattggaattccattcactgggtattcgttattttgtatataaaagctaaaaaaacccggactaaaattcttgttcaacataaatcccgggttctgttatattcaagaaataacggaccaggaacctgagaaaattatttgtaattcgttttcagtcgatcccatttcgtacaaaccaagcaattccgcaccggcatttggcgatgtcgtttgtgaggattatcggttcgatataagaacgaaatatcctcaatgcgccgaaataatgtaagataa

SEQ ID NO: 25998 - DNA, 1853 bp, Heterodera glycines
  misc_feature (132)..(132): n is a, c, g, or t
ttactaattagcatctaaattattttgaccctgtttcgaaacagatcactacaactcctaattttctaattatccaactaattaggcactttgttttaccgtttcctcctccttgtcgaccgtgtgccatcnccgcgtcgaagaggtgtgccaccaatttcggcatcatctgcggttgtcgcctcatcaaagcgagtgccaaaacgagtatggctcagcgcatcgcaagaggaagactaaatccggcttgtcaattaataaggaattaaattttttacaaaatttgccgaaatttggccccggaggattgagacgaagataaaaaaagatacctttactcgaagcctaagccttgattggcactcacccgtttccgtgccttgtcaacccttttcgtgttgctgctgctggccccgtccttcccattgtgctgcttggcgccgtcctcgccctcctcctcctgctcagtggtgccaatccgtcgatgcttttcctctttgcgctttgagcgtcggaacaaattggccaacggattgcgcgaccacagcggtactgagctgccggtgtggaggaactcgacggacgggcgaagctttgccgcgccagcgccgccgactgaggaattggtgccgctcattgcagcataagtgcacactaattgttccttttaatcttaattagtcaattagcttttcattagttaatcgcagaaaatgcatgaggattttaggttcgtaatttttagctttgtataaatttatttttatttttgtaggaaataagttaaactcttttcataaatactaaaataaaagtaaaaattgtaataatttaataattggaacactaaaaagtaagtaaattttgttatagaaattaaataaaatttcaataatgaaaataataggtttaattaattaaaaatattttaaggcaactgataaataagtaaataacgaaatgattttttgtaatcaatttatttaataaaatttcaatcaatatattaatttgtctgcaattcaatatttgcataatttcgcaatcattttgatttaatataaaatttaaaattaaattatttaaatgcttgtttagtgacaattagcaattaattcagaaataacggatattaaccagggctgggcgcaattacggattaattacggcgatttggaccccgtaaaagaatttccctaattgaaaaaaaacatagtaattacagcagatgacggattttgtaaataaaaatccatgcgtataaatagcaagattttggtatcaattttattttaatcacatgtaaaaataaaaattatggaattaatgcgatttttttaaacagattttgaccaaattttttgcctatttttgaagggttttttcaggaaaacaacaaaagtctcaaagcttcattttttagtctgtaggactcgcaaaaatagcctaaaatgaagataaagccacacaactgtgaaccttggattaaattgtattcggaaggcaaaaaccgtccaaaaacaaacaatcaaaaaactattgctgattgtgtaacataaaatttttagtatttgagtaagcaaaaatgggactaattgagttcgattttaattgggtgattagtggctaaccagtgagtaatcactcaaaaattgaaaaaaacggaggtacgaaaggacacattagcctctgcttaaagacttttaaaagtccgcaacagtgggttgattgggtgaaaatgggaagaggtcaaaagcaaaaaagcagaaatgggcgagagtgaggacgaccgacgaaaagcctcaatttccataacaataatgatcagcgagacgaacgacgaagacgacgag

SEQ ID NO: 25999 - DNA, 1933 bp, Heterodera glycines
  misc_feature (812)..(812): n is a, c, g, or t
  misc_feature (862)..(862): n is a, c, g, or t
  misc_feature (1804)..(1804): n is a, c, g, or t
aaacgacttcattatatttatattaaataaaagggtcaaacgcgaaaatttgaaataaaaaacaaaaagaaattaaaaatttcatattaaataattcagatttgaaaatttgataaaattgtaattattaattaataaaaaacaaagagatttatttataagtcactcacgaagcaaaaaataatttttcccttttcataaattatacaaaatattgagtggattttttaaattaaaattaaacgaataacacaaacaaacacaaaaattttaaaaaaaatgcataataaatgaaaattaaaaatttaaacaagttttgttcttaaaaaattagtatataattaatttattgaataaaactactaatcaataatcataattaatttcgttgaaaaattcatatatattctaaagtaaagaaataaatagttaatctatataaatttatttcttgaagtatatcatcaaataacaaaaatgtaaagtaatgaaaacaaaaatttatttattaagaatatttaaaccaaaacatattcgaatatatcattaaagattttatttaaagaaacaagcaatttcattatattaaagcatataataattctaaaaggaatatctatttaaaatgtaaaaaaataataataatcgaggatacattataatataaatagcaaatataaagtacaaacaaactcattgctatatttatttcattaagcatttattaaattaaaaaatgcaatagtaatgaaattattaagaatatttaaaccaaaatatataagaatataagcacaaaagattctatttanagaaattagtgcaataataagaacagtcatataatcttgaacaaaaatanaaagtttcaggatcagaaaagacagctggcttcgtgaataatctaaaaacacaattcttcaacacaaaattcttttattttataataattaaaatgatctaaaaggaataggtttttaaaaagtaaaaaataaaaaattcgaggataaaaaaattgcagtatattatttttggtattaaaagaaatgatttactttttttttaataattaaaagactcgttacagcttgttttataaaagttaatataaaaatataaatcaagtcattaatttgcttaattaaatttatgataaaatagagtaattgtatataaaatttaatttaccgagactataatatgaaatatgaaattaaaattagtaggttattgaaaataaaaaacaaaacataaattaaattatatgctttgaaaaatgaaatatcaaataaaaaatttccttagtggttatattaataacttctagggaactgatctaagcaagagaataattttaatgattaaaaaagatatttcggcatgttgtattaatagcaattataaattaatagtaaacaataaaattaaccaagtgattggtttgtttaagcaaatgtaatataaaatggattaaatatttaaattaatatcgagtttatattaatgaaaattaatgtgttgatgaaaataaaagcaaaatgatgaaaaataaagcaagtaaattttaatgaatttttggatgccaacggtcataaagttgcgcgggaagatttttgaaaaatttctcgttgtttacagataatttattcaaaaaaaaaaaatttttttttgtattttttgcaaatgagctttttagctttttggtttttagagagaaatcctcaaaatttgtcattatttggtcaaaaacccttaaaaatgcattaaatcaccagcgatctacaacggcatcacccaactatanattcaaataatgtgatttaaaaacaacattttttctatggtaaatgagctaaaatgcgtttttaggtcaaaagatgttaccaaattcaccttatttcaaaaaaggcgacaatgccgggccccaaaattt

SEQ ID NO: 26000 - DNA, 1424 bp, Heterodera glycines
  misc_feature (33)..(33): n is a, c, g, or t
ctgaaattattaatcgtaaattttctatgagtnaattttaaattaataagcatttccaaattaaaaaatattgttattaatttatgttttcgtatgcatttttgtatgaatgaatatgcaaaaacacatattttccataatattaattcagtagctttataaaaatgcatatgtattctctttacaataatatttattatccattcttgaattgattatacaaataatattgctattagtgagatgaaaatagtattattttatacaaaaatacaaatgaattattgccgttttttgaggattttttcttatattctgcttagatcaccaaactttctataaaaagcatcaaaagtcagcaaatcagcatctcaaaaaagtcataattataaatcagtagaatggaagccctggaattaatatttctaaaaattaaatatggcgtatatatgtgaaagaacaaatattaaaaaaatcttctataattttaaataaaataatcaacagaagattatacttattatggtacaaaaaaaaagataattcaattctttaaaataatttaattatattaatgataaaaaaataaaaaatttaatatgtagctcaaatatatgtttcataattgagtccctaatttgatttaaaaaataatggtatatgtgttaataaaaaatatattaagttacaaaatacagagaagtatcaaaaaattaaaaaattaaacactttggtttgtaacagataaattcgcaagaatataataaaattagtaaatttatatatagtataatttatgaatacgaaatacagtacagtcaacatgtaaaatgcatcataaatccgataataaaataaattcattaaaatttattaattgactgcttatatttaataaaagtgactaatactgactgatctaactacaattcaatgaaagggtggaaaaaagccgtgtactaaaaaggaaaatctcaaattaagattctttgattgtaaaaaaatatatcaatgatcaggtcaatccatcatggagatctgatcaccctaaaatacactaaaaatcggcaaatttttcaaaaagtcataggtggttggaaaaaatttcagaaaaaataatattgataaataaactaaattttaaattaattaaaattagccttcagtgctacaattctatttgtgagcataattttcaaaaaatctttcaacgtaaaaaacaaaattaaaaaataaaatatgatgaaaatataacattacacttttttggttgacattacttataaaaaaagtatatttattattttttcaaatattatattttagagttttcaaaaaaatattatatattaagagtaaaaaattgatagcactgatgaaaattaatgattaaaatataaataaaatcgaacaattcaaagaaa

SEQ ID NO: 26001 - DNA, 1498 bp, Heterodera glycines
  misc_feature (10)..(10): n is a, c, g, or t
cgaaattaantttggtattatttttctgtaaatctactgtatgtatatgtacatatatgtaaaacagagaacagcacccaccatcaccacgtagtaatttgccttctcgtccaacccgctcagcttgacactcattgaggggaaaattcgcctgtgggcgattagaaattaattaggtaattaattataatttgaggtggctttttcgcgacggggtcatgggaaaatgtacaagctggcatgcatcccataattaacaatcagcggcaggtgatcatcattagagggttccacagcgcataattaaggggtagggggaaagggcgggaaaactttgggactcagcaaaaaatttttctggaacagcctgctagaaggattcccgaccgataccgaaaatttcccgtgactcggacccaagacaatgaaaaaacccccggcaatcgaatcggacaaaagcgagactctcgagcatcattaatttattttttacgctccgttcgcccgtttcctttttcgtttcgccgtaccaacaacgcaccttccgctcgtcgtgatgatcatttcgttgccaaatttgtgaaattcctcccacaactgtttgtcttccaactccaccttcggtgcatcagttacgccgtcggcctgcacaaaaacgtgaagaggcggcccggaaatgccaaaagtaatgggcggaactgcggcgaggccaacggcgagggcgcaaaaatagaaagggtcgtcgggctgaggaagacgcacatagagagacgggggaacaccagctgctgctgaacagtgggaacgcgagattaggggggggggcaattggggggggggcgctatgtcgttatttaaaaacccatcaatatgattgacgaaaaattatttataacttaactcatctctaagtgttctctatcagtttacaaaatttcaaataaataagttttcatcaaatcatattgatggttttttaaataacgacgccgcccatttgggggaggggaataaggatggacagaggatttagagaattctttggggattagtgcgcgggactcggtggggaaaatgcctttctagttaatgccttcggagaaggtataggagaggttgcgacccaacggagcggaccgtacgtaggtatacctacttttttaattttcgaaactaaaatttttatttatagggggatggaggtccaattaagccgcaccacaaaaagttgctgtaaaaaacacttccgaatttaggattttttaaaaatttctagaaaaattaaagaaaccatttaaattttattttgaaaaaatatacaatttcattaaaatatttgaaacactcatagaaaattcatatttgtttcttttaatttttattattattttttgatgaattaaactccaattggccggcttgactacaaatgccttgataatgacgaaaactataacagtatttccaacatgacaaataatatacattcattcgctgt

SEQ ID NO: 26002 - DNA, 1206 bp, Heterodera glycines
  misc_feature (1095)..(1095): n is a, c, g, or t
  misc_feature (1140)..(1140): n is a, c, g, or t
cagaaataaggccttttttgtatgaaacacggatagggaaacggtatcccatgtacagtactttcccagaatcttgccagggccatgggttctgttaagacagaacttcagtccttgttttgtcttttttgctctggtccatcccgaaaaccctgctggtccgggtttttccaataattacgggctgtactttcgaaaaagtgatcattttgggaaatggccgatcatttttgagttacgacgaattggtttgaattgatgatgttttgtttgctctctttgaattgttcaatttgacgctgacattttttgctattaaaaaaatggaaaatttggcacttttttttactttagataatccgatgttttttctttaggcaactgattttttggtcgtgtttttttgtttgtgttcaagtttcaaaaataaatttttttagagtaactaaaattgttttgggtctcggttttaaagtctctggattttatagaggcaagaaaagaacaaataccaagcattcataaaaaaattacaatgagaaaacacgaaattcaactttgttttccgagtgtatttgcgaattattttttccaatagccttaggtaaaaatttaaaaaaacaattcttagactttaagcttatcaattggtaccaagaaattctcacttgaaaaagaagcaaataaatttacataaattttgtatattcgaatgaaagaaaaatcaaaaattgctatttctgctcaccaaatacaattactgccgccccaaaaaataaattggatattgttcaaaatggcatctgaattttcatctttcttctcgccaataattgggcatcgcttcaacagccattcaccaccaccataatttgacagtttctccaatgtcagcatttctttggtccgttcgttcaccaattcaaatggcacaatttgtgacgctgacagagtaaattgaacagtgtaactgacagaagaaaaagtggtggcatggcgaaatgtctaaacaaaaataaagcgtaaatttagggcaattaaatcaatcaattagtcatttaatgaaaatatggctgatcagtgaccacctctcgnaaattgttgagccattcgagatttggtagaccaacataagcacgnaaacacaatcgcttttggttgtccatctttgctccgagagtgcaaccctttggaacagaatttgat

SEQ ID NO: 26003 - DNA, 1904 bp, Heterodera glycines
atacgttatttttgttatacattttacaaattatcagaccattgaaaatattttatgtactgaaattattgccgaaattgaaaataaaataacatttttaattaaaatcactgaaaaaaaaaattctgtatttttgcgaaagcttaaaaaaacgtcaccttttgttggattttttgaaaaaatgaaggttgaaaaatataaccaaccccatctgaatttagaatgattttgcaatatttttctgcgcttatgctatgaagaaaggggctcaaaaaataacatttctacgttaaatttttttgatatggtgaaggtttttagtgcatataaatccatattttgggggttttcaggaataaatccatatttcgacatttcgaaattttggcgtttttagtccatattttggccatttttggcaaattttcacaagaaaaatgcaaaaaatgagaaaaaaaacactattaaagatcgacttttttggaaatttaaaaaaaagtcattgttttggtttttttaagtcaattttgaatttttttatataatttttggcatttttttttgaggattcaaagtcatttttgctagttttaaggcatgttagtgtatatttgggcatttttggggtttttagggcatatttgtggagatttttagtgcatattttatgcgcatatttgccattttttattgcatacaacttataaccctaattattataaatccagcaaagaatttttttttttttttttgcaaaaaattaagatgcccataaaaatttttttccggatgctaattgattattcatattcaaatatttactatccttttttacgtcagtcaatattatgacggaaaattgggaagctatgtgatgtcactaaacgatttttataaagctttttttgtggcaaaaattgattctagccatcgattattcatgagaaacatttatatttcataattaattcattttaaagaaatttttctctaattatacaaataatttttttaattttttaatttaaccaatcataaaattgcaagaattttgagaaaatgtttttaattatcttaatttttaaaatatttgcttttgccaatggccaaccatcaccagcagagcaacacataagttaataaaaagaatttaaatttaaatatccaactaatcaaataaaaatataattttttacgtcccttaatgtcaagaaaacgctaatttgggcatttccgccgatggtgccggcccatcgtcggcatttgaacaccgtattgacatgccaaacgaagtcccctcgcactcattttttgaatatttgagtaagatttacttaattattatttatttttattaaataattttacgaggcttatttaaaatctgacaaattaaacagaaacggcatttggtaatggtgagaaaattgtaattggacacgaacaggcaattgaattcttgaatatgttccctaaattgagcgcatttattcgagaaaaatcattcgttgaagtttaaattgaaatattgatgatgataattataattatattaaaacttgcaaataattatgaaaattcacaaattctctcaaaaaaatcaataaacaaataaatttagattaaaataaaaaaagtttctggatgcaatttttttgaaattaaaaataaatttaagacgcgcgttgtgcagcaacttttttatttgaccacttcaattgacgatgctattgaagaaaatagacataaaattggtgaccaaatgtacgcatttgtcactaatttgtcgaacatttgtgaacaattgggcactgtcggaatggacaatgtaaaaatggacgaatacttaaatgtgagaatgcaaagtttgaataattttagtcgcggattttggtacatttttt

SEQ ID NO: 26004 - DNA, 1493 bp, Heterodera glycines
  misc_feature (23)..(23): n is a, c, g, or t
  misc_feature (66)..(66): n is a, c, g, or t
  misc_feature (91)..(92): n is a, c, g, or t
tttggggcgaccaatgatggganaagcactaaaaaaatgaaattatttatacattatgaattttanatatgaaaattgactttctcttgcnnacaatctggtggtgccgccgttttctccgcaaaattttgcgacaaattcaaatgccaaaacaaatggcataaaatcatcaaaaaatgcggcagaagaaagcgcttcttgaagttcatttccaagtggttcagcatctgtaaaataataattactattcaaatattattattaattttactttacttttggtcaaattaatttccaaatatttttccgtttttttcatttgttcggtgccgaaaatgtcgtcgaatccatggcttaattaattaaatccatattctaaaatatttttctctctcaatttgcctcgattcgtagctgatcactccgtcttggtgcttcgtaatgatcagaccgtgccattggtcttcggcaatttcttcggcacattccacaaatttcagtttgccaatgtttcctttgcccaccccaaaacgtttgctaatttttttgtttttggccatttcactttggtagcagagaagaagcctaaaaatgtttaaataataaatttttcaattattttacttggtgcagccattttccaccaaaattgtgccatttttgccattgcactttttccaaatgccagcgacggatgacaaagggctgaaaatttgtaaaatttacaaaaaaaataacttactttcatttaagaaattaccgtatcggaggagctgagcaattaatgaccaagctcagaaagacggtcagtagattaaagaagttcatttgctaattgattaattaattaatgaatattaatactatttaattaatgaaaattaaaaaattatttgatttaaaatgatcaaatgaaatgaatgaatgaaagtggtgggatggaagcagtgaattgaattccgtcgttggaccaatcactgaatttttgtgtcgacgtgtaaaaaagtgaaaaaaaaagggggaaaagccatagcagaagaaaaagcggacgaacgaccacacatttagcagcagagattgtgaaaatgaagcccaaatatccaggcttaggcctggatcaatgcttggaccccaatattttaaaatgcttttaaattttaaaatatttatttggtttttgattacataagaaattattaccgtattggaggagctgagcaattaatgaccaagctcagaaagacggtcaatagaaaaaagcaattcatttgctaattgattaattaattaatattatgtaatactatttaattatttagtattaaaaatattttattttattttacgaattaaatatttattttccaaatgatcaaatgaaatgaatgaatgaaagtggtcggatggaagcagtgaattgaattccgtcgttggaccaatcactgaattttctgtgtcaaggagtaaaaaagtaaaaaaacaagggggaaaag

SEQ ID NO: 26005 - DNA, 2039 bp, Heterodera glycines
gtcccggtcccggcttctcaggtcccagaaagtcctggtcccggcttctcaggtcccagaaagtcccggtcccggcttctcaggtcccagaaagtcccggtcccggcttctcaggtcccagaaagtcccggtcccggcttctcaggtccccggtcccggcttctcaggtcccagaaagtcccggtcccggcttctcaggtcccagaaagtcccggtcccggcttctcaggtcccagaaagtcccggtcccggcttctcaggtcccagaaagtcccggtcccggcttctcaggtcccagaaagtcccggtcccggttttgcccaaaattcccggtccctttcaactctacttgtaatgatacacaatacatatgtatgacattgataaagaatgaattgtaatgagtttaacaaaataagcatattaaaattaagtgggtactgttaaaaaaatttcgattcctaacttgattaaattttaatatgcttttaattaggtatttgcaatttatatacaattaaaaacatttttattttttaaatccttaatttggtgcccaaacttccgcctccctgtctgtgaaggttatggtggcaaaaaatttatatatgcatgaaaatttaatgagaaattaacgttttaaattattaaaattttgactttgttggtattttacatcgtacccattaaaggcagggttacggtaaaattgaaaagggtgaatgtgttgttaatttctgctcctgtttattaaggcatatacatatctctctcattacacattacagtattacctaatagttatgtagataattactttttgccatttaggcgcattgcgtttaccattttttgttgacaaatttggcaaaacaaaaaacgctccttttggcaatttgcacaaagccggtggtttctttgctcggcggctttttattttctttcaaatacggggatttttttaactaatgtttgatttgtgaattttgcttgccaacccataagcgcataaagcccctccggtggtgttaaatttggcatatgtggtgccaattgcggggatgaaaagcagcgaacaaatgccaatggaggcttaattttgcgaatgccgaatcgcgcaaaacaatttagcgggcaggggggggaaagaatctctaaagccatcggataaacaatgtaaccgaattttctctaattatcactcaccccgtctctatttataccccgggggataaatgaatttttattttttcgaaaataatttttttaaaatttttataaaaattaattattctgaattgaaaccaatttatatatttaataaatagagacaaaatagttatgtgctaaaaattggcaaaatccgctctatttatgcataaaattcaagaaaaatctcattctttatcattttcgcccgcacaatagaattaaatacctttcgaggtgtttgtgggtaaaatgttcccttttctgacaaaataaggaaaattttaacctaaatttttttatcaaaaaaaaaaattaaattttgcgatcaatttttagaaaattttcaattcttaggggtgtattttttgaaattttttcaggtcatttcttaggggtgtatttttttttcgtggagcgacattggacgcgtaaattggaatagagccaagtttattcctatatctagcaaatttctataataaactaatcggtatacgaatcagaaagtaattgtaaaaaaagaattatattttttttaatattacatatctacatatatttactttaaaatttttttttccttttaaaaattcttattttatttcagtgacgaaacgttcggccacccattaaaaaaagtatggtcaaatgggcgcccaaggctgtagccttggctaattttttttacccaaaagtgtacacttcagtaccaggcgaataactcgccagggtttgatctgagcggagggtggccagcgaacttattatagagctttgaaagctcgattttttgaaattttaaaatttcaaaaatattcaaaaatttt

SEQ ID NO: 26006 - DNA, 996 bp, Heterodera glycines
ctgctcaacagtattaggtattccaactgcattctcagaataattacgccgatactaattgttctggaatttgtttctcggcgcgtttgtttgggaaaaatttggaaaattggctatctctttttctgctcaacagtaataggaattccaactgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctctgcgcgtttgtttgggaaaaatttggaaaattggatatctctttttctgctcaacagtaataggaattccaaccgcattctcagaataatacgccgatactaattgttctggatttgtttctctgcgcgtttgtttgggaaaatttgggaaattggctatctctttt

SEQ ID NO: 26007 - DNA, 2390 bp, Heterodera glycines
  misc_feature (71)..(71): n is a, c, g, or t
  misc_feature (2369)..(2369): n is a, c, g, or t
aagtcaaactttttaaaaaattttttgataccatccgatccttcggtgcctgagaggtcagggatccgctncaatacaatcccaaaatcaaattttcccatgccaaaattaggctgattttgatgtgtgtaagggtcgggggcggctgatagttcatctgcggcattgtgggttgttgcacttgaacgcactgttcgttcattggccaagcatatggctgacggggttggaaatttggtggttgaatttgttgagattgagggcgaccaaaattttgttgaatcgctgctggattttgctgacccggcattcgaaccggtatgttattggctcgacgcgcaaaaacagccgaatggtgtatttgctggtggatttcaacaccatgttgcgtcaaatttagtgccgggtttgtgttcggattttgatgagcactatttagctgaccaacgatgaccctcccaatttgttcggctaacaaccctatttcattaaggttttgcgggccaaccccaacacagcggttttcattgaccggagtcgaagttcttctaatgtttggatgatcgaagaagtcatcttcattttgggaatgtccaaagacaaaatttcgaaaaatttgttgggttgggcctgccctctctcccaaattttgtgtccaatccgttcggtttcgcataaaaccttggtttgcctcctcttcttcgttttcgtcaaggctggcacgttcattttgtcgcaactgtccaagtgcgctgtcattgttcgggttcaaaaggcgccgtctcatttccatcgagtccagctgctccgaattctccaaattgggatccgccaccaccacgttttggttcatcacgcctaaagttctatttggtggattctcccgaaaaaaaaacatttccatctctgtcgagcaatatcccttcattttgagctcgctgtctagtcaaacgagtatgattgagtgtccgttccaagttttccatttcaaaatcgactatttgcaccccccaggtgacttgagtgtcgaaaaatttccgaatttgtctcccccagagaacttaacaaacaattggtttttgtttgttcgttttaagcgtttttgtttcgtctcccccagagaacgattgttgatgttgattgtctcccccagagaacaatatcaaaagtcgaaaagtttatcgtctcccccagagatcgataaaatgccgaaatccttcaaaaatttgaaccgatgtcgttgttaccttgtgttctgtccaggagcgccaaatagtaaaacttctcgccgttcggtgctgttcgctgcttatttgccttagattaattagggcaggggcacgggaacagtctttaattaggacaggagagattggggacaatattattattagggactttgaccaattcgttcggcttctttccaattatgccgactcagtcaattcgcaataaatgcaattgactgcacaattaaaacacaaacaaaattattccacagcacacaaatatccgcaattaccacgaatcattattaaaacaaattactacaattaacgactaaaaaaaacgcaaatgaaaaagctcaacaaaaataactaaacaaaatgccaaaaataataaattaaaataatatcgaatggtcaaagtcaaaatatcactacaggtgggttgagtcccagtgattgaaatgcaggagaattgagtcccagtgattagaatgctgttgggttgagtcccagtgattgaaatgctggtgggttgagtcccagtgattgaaatgcaggagaattgagtgccagtgattgaaatgctggtgggttgagtgcaagtgattgaaatgctggtgggttgagtcctggtgattgaaatgttggtgggttgtcccagtgattgaaatgcaggagaattgagtgccagtgattgaaatgctggtgggttgagtgcaagtgattgaaatgctggtgggttgagtcctggtgattgaaatgctggtgggttgagtcccagtaattgaaatgcaggagaattgagtgccagtgattgaaatgctggtgggttgagtgcaagtgattgaaatgctggtgggttgagtcctggtgattgaaatgttggtgggttgagtcccagtgattgaaatgttggtgggttgtcccagtgattgaaatgcaggagaattgagtgccagtgattgaaatattggtgggttgagtcccagtaattgaaatgcaggagaattgagtgccagtgattgaaatgcaggagaattgagtgccagtgattgaaatgctggtgggttgagtgcaagtgattgaaatgctgttgggttgagtccctagtgattgaaatgatggtgggttgagtcccangtgattgaaatgcaggagaat

SEQ ID NO: 26008 - DNA, 2085 bp, Heterodera glycines
aaatcagaaatgtatgtggaaaaaagtgatctttgcgtgccaaatctcgttttgtgttgctgcttgaacttctgccacgtcgattcaattgtgttcgtatgctgcccagtgaaaggatccttgaattaatccatttgtagcgcatttcgttgccacagtcacaaaaacgagtggtgtgtagaagcttaagttctctgagccattcttcgaattcttcgtctggtagagccaaaactttgaataaagcatcaagtttaaaatttttaagtgtttccattaatctaaaagcaattgtgacaataaaaaagtaaaaaaaactgaaaaatgtgaaaaaaaaaaagcggacccaaagtccactagtacctaaaaatcaatataccaccgaaataataacaggcgaacgtaatataataaccttctctaattaggtgcgaaacgttcgctgtgtcaaatgtcgcgcgtggggtcatttgaacacggaccgcgaatgcccactgtatggtatgagtggaaatgctgaagaccatggctgtgagtgaatcattggcatttaaatttattgttggttttgtttatgtcaatccattttttcagatgcaaataatccctccgatatcattcgtgatttaaatgtcgaaaagaaaacaaagactgtctctgatgtcacgaccaatgagcagattgatataaaaccgaaaattgaggtgcgcaaaagctacgaagagaagaaaaagaagcgacaccattactcatcggaagaagaggaagaggggacggaagaaaagaagccggaaccgatcgatcaggaacaattgctggtgaacatgcgtgaggagcacaatttgaagttcaagaccggcattctgattggtcttcgagcggacgaacacataaaagtcggcacaactttgaagtttcgggcttatcaatcaattacctttcagaaaatgtcagcgatggttggaggaggagaggaaaaaacttttgaggcttttctgaaaggactggatgagaaaaaacgaagaaaattaatgaagtaaacacatggatgatagttattaatgtacaaaagtcaacatttagaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaggggaagcggactcattcttcggattgccgccatttgtataataaaatgtaatcgcttttttctgtctttcatttacataattattttatcgacaatggtttttctattccattacatttattttttacgtattcactttgcttggatcgatttagcagcgtgaggatgactttgaaaatagttagttctcttgagaatttgatcagattgactccggatgtccattcgattcttgtcctcgatggggacggagttccggttgtcagtgcaggcgaagaggtgcacagttcaactttggtataatgatttatttcggtgttaatttagatacgaaatcggtcccagtattcaatttcttacaattcgcttgtcgagcaggccaaaaagttgggcatgggagaacagaaattttgggtgtttcgctacgaaatgaaccaggtgagtgtcaatatttcaaatgttttaaatattttcgatgcaggtggttatgctcaggagggatgcatttgccgtattcattatggcttctgcaaatgccaatatgggaattctctgcactatgtcagcgcaacttggaccaattttggaggaatgtaaagtcatcgtaaacgaagtcataaatggacagatggccgggcaaagtccgagataaatgaccaaatttttcttgtcgagaattttacatcataaagttttaactataatagaatagagaaatcatgcttctactatggttctttattaatttagttatagaatcaaaagcctataaacgcacaggcaaatacttgtaatgctctccattgtcttttttgactctaga

SEQ ID NO: 26009 - DNA, 1139 bp, Heterodera glycines
acaaatttgagggtggtgttgagcgccctccaaatatttgtcgtctgcaatatgacttttgtcgtaaacccaatcagaattttagaagacaaggtcttccaaaattctgattggtttttacaacaaatgcctaattttatacgacaatatatacatatatactataaaatttgctattctgattgtacgatcattcggacgtcaaagacaaacaatatacatatttggacgatgatatatttttttgtcgtaacgataaattaagaacggacgacaaattgtcgtttgtcggtcgatttgacattcgtaattctgaaaggcgccaaatggtcaatttcattccgaatcattttcagtgaagcccgaaatgaaatacatcggaaatatgcacggcaacgaggcgatcggcagggaattgctgctgcgattggctcaattcctctgcgacggatggcggcaaggccaacggtcggtggtggagatgctcaattcgaccaacattcacattatgcccagcatgaacccggacggtcgcttttccttttgccatttggcaaaacgtttcatcgctgtcgcccattttaggctttgagttgacgctgaagacaaagccggaacagcgcggatgggtgacgggtcgcacaaacgcgcacggggtcgacctgaacaggaacttccccgacttggacgcgatcttttacaaggccaacgcacaacggctgccgttctttgaccatttgctggaagtgttccacgactccgacaacggccaacaggcgagtgacagcaagaaatgtggtcaaacagagcatttggtgctttagtttgagcccgaagtcactgcagtggccaattgggtgctttcgtggccttttgtcatttccgcaaatctccacgagggcgatttggtgagtcattcatcagcaggacttcggaatgttcgtcgtttcacaggtggccaattatccattcgacgaaagtctgaacccgaacgaacttcgcgcctattcaaagtcgcccgatgacgtcacttttcggttagtttttggcacttttccttgggtttttggtttagcctctgatttaaattgttcacaaagatacatcgccgagacttacgcccgtgcacacgcgcacat

SEQ ID NO: 26010 - DNA, 2033 bp, Heterodera glycines
tctggaataactttttttgtttttgtggtataaatttcaaataaatctcataaaattctccctatttttctcgattaaaaaaagatacaaaaataaaagtgattttggggttcgggaccaaagggggtggacaggattttgattgaaaaaattttttcacaaatttttgttaaattgttgcgatatttggtgggagttgatgatatgctgccggttaaaggctttttggcaatttttgccctaaaattatcaaaaaagtttacttttaatttcttttttaagtttagtttttaatgaaaaaaattatatttggaaaaggttttcattattttggcaaaattatgaattttgcccaaatttatttttgagttttttttgcacgtatttttgaaactaaaaaattgttcggatgcgtctcataatctaattccgaaccctctgcttaaatctgaatttccaagccaaaaattaattaaattttgaaaattttatttagaataacattttaaatttttccattctttcaattttcgagtcctacttcgagaaaggtctcttataatctttgttgtacctctcctaatctctgttgtacctcttctaatcactgttttacctcttaaaacgggcgcgaatccgccctttaaggccgcgaagcggcctaaaaatctaaacccaaaatcaattttataaaataaataaaaataagaaaatagtcctttagcagtcacaatataagtttttataaattgaaatattaaataaattctacaattattattttacacaaattagaagaaggaagaaaataatgatttgacatcagcttttaaaattattaaagggttcaccagccttggtgctggtaaaagtttctttttctcggaaagcgcaggaggcctttacttttgcgagtaaagcgccacacggccaaaactcaaaataattttttccataggatagtaaaaaactggaataatcttccaatggtagcggtacaaattaataaggcaaaggaattcaggggtttattaaaagcaatgagttctgagtaggaattttctgtgccacatttacattacatattcacctgtgaatttattattattcaaaaccaaatgaaactcgagactatgcaaaacatccaaattttggctgaggttagttgcattattcgagctaggccccctagaaattttcgaaaattttttttgggttgaaaatgggggtcaaaaatatttttctggggtattttgatgtgctgagcacgaatctgatgttaattttcagtttaggaaattttagaattttttaaaaattcaaaaatatttggcaattttttgaccctcaggattttgggctaaaatttgaaaattcataactcaatggaggaccggtcaatttaagtgatttaaagctttaaaaatagcaaaaaatcgggagaattttatgggatttatttgggatttctatcttctaaagaaaaagagttattccagaaattctggaaattttagatttttcagaaaaaaattcagaactcccttctgaaaagtcattctgtaaaagtaaaatactacaaagattcgcaatttttttctctataatataaattttattttacatttttatcacttctttaaaaaaagatattaaaataaaagtgattttgtgcttcgggtccaaaggggggtgacaggatttttgagtgaaaaatttttttcacaaatatcttccaaaaatatgtctttaggggtattttaggacgctgatcacaaatacatgatcagagtttacacttatggtagaccgtaattgaaatatgctcctgaagtttggaatctatctattcaaaaaaatattaaaaatattgaaaaatgtcaaaaatatttcaccaaaaaaatcatacaactttgaaccctagttataatcatttttatgagaggttattttttcgacttaattattttattccttttaaattcacaaaaattctaagattcaatttttctcattttattttttctgaattt

SEQ ID NO: 26011 - DNA, 1186 bp, Heterodera glycines
  misc_feature (80)..(80): n is a, c, g, or t
ggggttataaaatagagcccctactgttggtggccttaaaaatgtattgaaaatattttttaattatgtaaaatttcatnttaggcgtatgaagctaaagaactcacaaccttggcatagaaaaaatgacattgccgacaatgagaatgccgtgtatttataggggaaatcttgcccagcaaaatgccatttggccccttttggggggaatgccattgacgaaatcatttggataagaatctcaggaagttaggaagaagcagcagcattttttatctgtgcgaagaagcagcagcattttttatctgtgcatatgcaagtaggaaaggaagtgcgtaaacggcacaactcatttgggggtcatatggtagaagccaaggcaaagcatcccgtttgaacatgcttaattgggcgggattgcgtgagatgaaatggcatttagaagagagtaacttaagacacgaaaatgccaaaagcatcacaaaaagagaaggacacaaaaatgtggccaaaccaaatggaagaacgtagtgttccttcccgagcttcggggggagagaaaattcgaggatcggaaaggaaattccccgaaaaaatttgtaggggtaggcttgagcaaatttaaaatgtacagggagcaattttttaacggggagtaaattttcataaaaattgaaaaaggtatcagaaatttttctaataaaaacacttagaaatcatctcatgctatctgaagtgcaatgttttgttgttttagttttttttctggcttaataatcgtttagatgatgtttttttaattttttggttactttttttacattcgcaattccccgaattgggccaaggaaaaaccatagaataaaatatacaaaaattgtgtatgttatgcatatacctaatagatatgagaatttcgaattattatatcagactatgtacatacattaaacatgcatttttctgttattttggccgaatttgaacatttcagagcaggaaataaatgaattaactagagtccggcgggatcgagactcccgcgcgattttacgggagtcccgctcccgactcccgcttttttcggtgaacgggatctttaacgggagcgggatttttacgggattcccgttcgggactctcgtcccggaaaaattgaactcccgatcccgctcccggaaatttt

SEQ ID NO: 26012 - DNA, 2062 bp, Heterodera glycines
  misc_feature (27)..(27): n is a, c, g, or t
  misc_feature (2005)..(2005): n is a, c, g, or t
  misc_feature (2015)..(2016): n is a, c, g, or t
  misc_feature (2042)..(2043): n is a, c, g, or t
  misc_feature (2046)..(2046): n is a, c, g, or t
ggggttcctggggccccggcgtttccngggtgccagggctttccggaaggaccgggcggtccttgtcctccgggggttttcgggctgtccggggctgccgggctggcccggtgctcctgggtttccgggaggtccaggtgggccgggaattgtcgtgctgacaaaaaacatttcaataatttttattggctgagttcgattctctcgccttttgattcctggttgtccgggttgaccgggctggccaggtcctcctggttgtccgggttggccaggctgtccctgaggacccggtgggccaggcgggccttgtccgccgccctgttccaggctgcccgggctgtccatcgtttccgggtggcccaggcggtccttggcttcctggctgaccggacggcccagctgggcatttctgacacgtcgacacgggcggagggcatggcggtgcttgttgtccgggctgtcctgggcttcccggctgcccggcgccgccgggctcgccgggtgttccggggggcccaggcgggccaggaggaccaggaggacagcttggctgctgcagttggcaaacgcattggggaggcaatccctggcgcttttggcgtaggaaaatggagttgaagggattctctcgcggacgggtcggtggagtgacactgatctgcacctccatcagctcagtccacgcggaatccgtgttcacgcggaaagcctaagaggcaaaaggattggatcggatgatcaaacggtgtttgtttgtcagttcacctgaacaccgtccatcacgcggttgttcatttcgttgatttgagtgtatagttgcgggatcaccacgagagtggccaaaatcgcggccagcgaacaaagggaagcaattccgactataattttcgcttcgtgcattttctttcctgaaatttgacttctgttgcggagggtttagcagaagaagcagtgaattatgttctgttttcaaattgctgcgctatgaatagtgagtgaatgaatgctttccaccgaatttcgtctctcttttatacgccttttctgaggcggacccatcagaaagaacgtgcttttcctttttttcctttttcgtgtcgtgcaaacgtttcgggacttttcagcccctcaattattatcggagctgcgctgattgtgcgcatgagcagcgaccgaagcttcgctgttcttccctaattaggaggcaaagagaaagaagcgaattccgccagcggagtcagtcgcccttccccgcctcgtaaaaatgaggacgggttgtcaacgatgctttgtctcccaaggacattttgcagactgtttgcccacgggcaaaaactaattatttttggagaaacgacaaattggagaaggaatcattcggcggttgctgatcacagggaaaaaaagaaaattcaggaaggaattgagagacgagagggattgagagagagagagagagagagaaggaggggtgattagtcattgaaacagccaaacaaccgtcagccaattaattacattctgctaatgattggctaatgatagcactcccaactgtgatgacagagtaaacctgtctttaacattcgatgcatgttttgtaaaggtatgttgggccataagctttgatcattaagtgtgatatgccttccatgatttataattttgctcagtatttttgatagaaaaatttttattctgttgattctgaataccgaatgtgttatgtaattgaataataattaattcaataattaattgctttttcataccaattttttaaattttaaattggatccgatgcctaaagtctctctccgatccgatcgaaagcttctgtattcctggtacataggtatgtataaatagcattaaactgttcaacatttaaaaatataataatccaataactgctgaagagtgtttccctctcatggccacccgtttctttcgtttcaattttggcacttttgtggcgctgatacattccgccaaacttcgntgtctgtcanncacgaatctgtccaggaaatattaanngtnagatgtttctgctgct

SEQ ID NO: 26013 - DNA, 1881 bp, Heterodera glycines
ttgtgtgtcagtcaggtaggcactttgataaccccttcgatttcgtgacatttatccccaaaaaatcaccgaaataggcttatgtcggaaaacaaaggttttgccatgccttatcgtattcgacccccatccacagaacagttcacactgcacgcgtgcataaagggcaacaaattggactttcatcgctcaatgggcccggagaaggcgcccctcatttacgagcagtttctgcagcgtctgaggaataattacgcgccggagagagtgaaagtgggcgggcgaacccgaattccaccgttaaagttccaaaattttcatcattaggatggcaaatttggtgcaatgatgtcagtacaaattgaaaacgacggtccagtgacaatcaatttggacagcaaacgaagagatgaatgaaggggacaattttattgacaactatcgagatttgaaaacattttcaccatccaatcgctttatcatctgttgtgttatgtacaaaaaatcgaggacattaacattgctgagcaaaaccagtgacaatcgaagtcagtggctaaaaacagagtgtgagaaattatttgatcaattaggcatgtgcactctatcatttgtgtttttaacacctttagaataatgcaaatagagcacacataaatttaaacaaatgtaaatgttgtgggatgaaatagcccatcgaaacacacaaaaaacagtcagaaagctcttctcgcgccacctgtgaaatgagtggaggcatttacccgccggtcaaatgatgtcagccttcgttctttggaggcgtataccaaccttaacgaatcggaagggggcaaatgatgggaatagcgtaagataagacccgttgcaaatgatacactcaaagacagactaggcaaccaacccgatttgttgtggatttgcacgagcgaccgaaacgactgctgcgccctggccaagctgtagttgatgtgcgcgttgcgctcaaacgaaatgcgtgcattgcctttgacgagtgtcgcgccgagttgagtgatcagcgactctacgctgtacgcgctggtccagccctgtttggtcagcagttccatgcaaagtgcgccaccgctaagcacaaatcctaaaaggaaaaataaatcagtgaaacaaaataatcgaatcgacattgcattccgtgtgcagtttacttctcccccttgtcatggaggatcgctaattatgggaaataaatctttagaaaatagcatttcaatatctcaggagaactcaaaaacaaaagacagcaagaagctcctattaacgcaccgtttgcaactaccggcgaaacaagacggacaaatggaggctcaaagcttaaattgaaacgtaaaaacgcattattgaaaggaatccgttcaaaaataattcacgagccaaaaacgcacgggaatgaattggcaaaagtgaagtggaagagcaggtggtcttggttgtgcggcggtttggccaactgtcgcatgtcagcagcaagcagactgtcgttgtccacctaaacaaattgagtgagatggacacggaaccatctctggacattatcataatcgttggattattttcccttattcgtttgatccaagttttaaagtgttcccgacctttttgagcttcacgtcccactcgtataggttgtcgttttggagttcgacggtgaaaacgccttaaaatggcaaatttacattatataaagtacaaatgcaaaaacagtgaccgtttttgtagttttggcatcggtaaatttccttcagctccttcatcaggcgatcggaggccgtcaatgagccggtgggatttccgctcaaatgttgctggcgctgcgcttgtgcaacacgcgtcaaagtggca

SEQ ID NO: 26014 - DNA, 3154 bp, Heterodera glycines
  misc_feature (97)..(97): n is a, c, g, or t
  misc_feature (2698)..(2698): n is a, c, g, or t
cttaatcactttccttacggcaacattcccccttctctccccacgggttaccgcgcaattccttctgttcgtttgactgcttttgataatgttgatncgctggaaaagcacatatcttactgacgcggttcaaacacggcttcagatcatttgtgagttcgaaatggccataaaggagaattcttatgattttcgaaaaggaccccccccccctcgcgcaaaaaaaagattccatttctcatttccttttatatttttggttaatgcccttaaaggtccccattcttgttcttctcgtttataccattatcggtgcactgatattcatgctcatcgaaggacccaatgagaagtacgagttggaacagttgagacagcggcggctcaaactgctcgaagtcgtcctccgatcatttgctttggctcccgcctccctaatgccccccccccgcctttaggacacggcttttcgtctgaataccatcaaatcgatgactcctctccaagcatacaatcacacggtgacaacgctgaacaattacagagaacgattgggcatctccgaggtgtttatgaaccaaacaaaatggaccatttggggttcgatttacttctcaatgaccgtctacactaccattgttatggcctaatatcgcttcgaaaagtacggtatttatttagggttacggtaatattgttcctgcgacgacgtcaggacgcgttctgaccataatctacgctctaattgggtgtgatgcgcagatagtctcgtccattgtaaacaaagtgttttcagtattcctttggcattgatcgcactgatcactatgggcggacttttcgctaatctttgtctgatcgtttggcgactgatcgcgcgttcattgggctgcttttcaaaaaagttggaacgaaaggtcactttgtgtttaaacttaattttgttttttaaatcactgataaatttgacagttgacgatagagcccaaagataacaacgaagacgaaattgaaactgagacgagggcaagccgagaaacactttccacggagtcggacgaaggaaatgatgaactgttgcaggtcagtcaggcttccgttagatcgatcaggcgttcgatcgatcagaaatctttaaagtcggctattcttctgtcatcgttcggtcttccgttcaatcggccgctttctcgaattgtctcgaacgaaagacagatcaatcggtcgtccgtccgatcggtcttccgttagatcagtcggtcgtccgttcgatcggtcttccgttagatcagtcggtcgtccgttcgatcggtcttccgttcgatcagtcgtccgttcaaacggtctcgaaagaaagacagaacattcggccgccccttcaagcggtctcgaacgaaaaacagatcagtcggtcgtccgtccgatcagtcgtccgttcgatcggccgccccttcgaatggtccgaacggaagacagatcagtcggtcgtccgtccgatcagtcgtccgttcgatccgccgccccttcgaacagtctcgaacgaaagacagatcagtcggtcatccgtccgatcggtcggtctgattcccaacgctcttagctcttttagttcccagtttggtttctgatcgcggtgaccatcatctggatcctgctctgcgcttatttgtttcttctctgagaggatacgtgagattacggttcggcttccgtttcctttgcgattttgcccttttcccaggtctttccctctatttcgtgctagtctccttcctcaccattggattcggttcgtcccttcccttccctccctttgtctaatccctttccccccagggatgtgatcccctccaagcccgatacatcattctcgtcggattatgattctgatcggattgcccctcgtttccactgttctaaccacctaaaaaagcaaatttccgcgtttggaaaaaaaagaaaaacaaaaacgaaaaaggattaccaaaaacattttaaaagggggggggggggggggggggggggaaaaaaaaaaaaaaaaaaaaaaaaaaaaataaaaaaataaatatttttttttttttttttttttttttaaaaaaaaaaaaaaaaaaaaaaaaaaaaaatattttttttttttttttgtggagaacaaaacaataataaaaaaaaaaaaaaaaaaaaaaaaaataattttttttttggggaggatttccccaaaaaaaaaaaaatttttttttagaaaaaaaattttttttttttttttttttttttttttttttagaaaaaaattttttttttccaaaaaaaaaatttttttaaaaaaaaattttttttccccccaataaaatttttttaaaaaaggggaaaattaaaaatttgttaaaaaagaaaaatggttttttaaaaaaaattttttaaaaaaaatttttttttttttttggggggttttttttaaaaagggtttttcccccgggaacccatttttttgtcccgggcccagtttaaagctttttgggcaaaaaggtgttccccaattgggggggttttttcaaattttttttttaaacaaaattttggaaaaaaaaaaattcaagggacattgtttgggtcggtaaaatttccagggcctcgggtttttttttttaaaatttttttgtttttcagggggccatgtttggattttggcaaaagtgcattngattttcactaaggcctttgccattgtggaccaattcattcgcgctcaaatggcattgccacgcggcgctggcgtgtcctttgttcgccttgaccgggacgactttcacccgctgtaccaggtgtactgtaaaaattcagaaatgcatgcattactgtagccaaaaaataaagcaaacagtacagtagtcgattgattgcacattaatcgctttttgccatttaaacatgaacagatttccgtgttgtcaaaccatccggcaaactttgacgagtccgagtactgctccattatgtggtccgtatttcgcaaaatccagcaacggacaatcaatggtcagaaaggcatacatttgtataatttttaattataatatcatccatttctgattatattactataacttccatttttagggtcttgataaatcgctaattatttctaaattagacatta

SEQ ID NO: 26015 - DNA, 1955 bp, Heterodera glycines
gcacgtttttctcagacttttgggggacaaggagggccggcggtgccgataggcgccgccgggaaaaattttgtattttttaatgcgatttgttaacagaatttgtaaaaaaagaccaattgattaatttttaggtttttaggatgcttaaaatgaaagaaaaaaagttggaatattttttttaattaatatttcaattaaaataatggtaaagaaaatatgaagaatattctatcccagtggggaattgaacccaagcgagaaataataaagtcagaaggttttagccacttgaacacttatgcatatgaacaaatgctttaaatgtttgttgtttctctaaaagtttagcatgaacaatgaactttttctaatgtttttgataaattttccaaaatctttttaacatttttataatgagaaggcaaaattgggtaattaatttcctggctgttatgaagcaatacgccgagcagggacatgccctgctctatacctagaaaatttttaaaaaatatataaaaatttgttgaaaaatattttttggccattccccgaccggggccaagcccacgatccccgacaattttgcgatcaccgaatccgatccatgaggattttagtggaaaaattagtgacatacaaaggacattttaatcaacctatttgaatattggttttttattgttacttttttaatttttttaatttaattaacaaaattagcaaaatttccaattttctgtcgtcggcagctccgtaagacctatgattcttgataatttttagaatttacacaagattttgtaattttaagtttttttttgcaaaaaatgaatggaaacacaaataaaacgttttctagaataaattttcaaattagagttttcagggtcgctgctcactattataacatttattttggcactgatttcatctgttcataaatttgacttaattccatgcatttccaaaatatataaaattaaaataatgaaacgaatcagtaagcaggtggacataaatgcaattaattttataaaaccgatcaaattcatttaaatttagttgaatctttgatcagatgacatcaaatagaacaaaaatgaaaaacccccttattccttaattattgtttatctcgtattaattactccccaattcgttgagaaaagcaaaatataaataaatagaattattattaaaatgttgtagcatattgatgatataatgactaaacgtggctaataattgattgaatatataatttagccagtcttaaaattaataattacaaattcattgggaaataaacattttttatgaaaattattctttatttttttacaaaaaatcatgaaaatgttactaacatttttattattatgcgcattaattttcgaaaattcaattgatcaaattgaagctggcaaaataagccaagaaaaaagttttgctgaaatatttggccaaagatgggacgacggagcagaagaagaaaacatctgtcaaaatgatcaaataattcatggagaaacagttgatcagaaccaatatgatcaacaatttgatcatttggaagtgaaagaagaggagagtgaagaaatgtccacagattgtgatgaattgggccaattgccaatgccaacaaataatggacaaagttgtgataaattttcaaatgaaactaataaaaataaaagagaaactgtggaaaaatttcataaaattaaggagaaagttaagcaaatgggaaagaaatattcaacaaaagaatgggtgaaaattgaaagaaaaattgcaaaaaaattgggcgtcagtcaagagaaaatttacaaatggaaaaaacaattgggattgaatatcataaacagattaaggatgaacaaaaacgtaaaatattaaaacaattctcgggaggaatgcaaaattaaaaacgaaattaaatgaaaaat

SEQ ID NO: 26016 - DNA, 1541 bp, Heterodera glycines
aggtgcctatttcgcgattttttgtgcctaaaaaaggaagccctattaatggcattccatcacaaaataatatttggcattattatttggcgttctgtctcactttgtgtggtccaagtccaaagtgttgatggcacacacaattggacgtcgaattacgttggtgcagtcgtactcacctgaaaccaaataaatattaataattttttaaatttaaatatttttgtcataccgccaattcccacctccacaattgcaacgtccacgcgctcgtcgcaaaaaatgcgaaaggcgagcagtgtcaaaaatttgaaataggctggcattagtttgaccttcaaaaaattaaaaaaaattttttagtttcttaaaaatttttgggacaaaaattgctattttttccaaaaaaaaaattcattttttgagtattggggttgaattattatttttttcttgagggactgtccccaaaggccaacaccaaaatgaatttcgagatttattctcgacctgaaagtccgcagtctcgagaaataagtttaaattccggaacaaaaactggtcgatcttggagcctcgagaatttctcagtttccagcggcataaaaaaatggtcaaattttgtttatttttaaatgcacataaaaatggaaaactccgctaattttgcaaaaatcattggtacttttccgcttgggggccccacatttatttaaattaaaaaacgtcaaacaaagagcgcgcgccatgcggatccatttgattatattttggcccaaattgttgtttttatgactcccaaatagatgaagcgctgtttttgactattcagcgcgctttttgttaacgttgcttaatttaaataaagatggggcccaaaagtaccaaatcctttttttaacagcagcaccattattaatttgccacctcttttttgtgctcaaaaagtgtgttgtaaatgtgaaaaaattgctgggtgaaaatttgctttgaaattggtcgtccattgatgcgaatgcgttcacggacatggaccaaatggggagaactgtaaaaaattaaatttaaaattgaccaaaatttccttaaaataaaaaattttcatgtcttagattttgtaattgggtgcctgccacccacccacacctgtaaaagccagttttgtagccaagggaacgcaaaatggattccagaaaagcggcggttgaacctgtaaaaagaaaataaatttggattttaattgattttttaaacaaaaaaaacaccttttccttttgtaccggtgatgtgtacaacattcagacggtcaatgtcgtccagctgaaaaaatcttattttttttacaaaaataattttttgcgaaaaataaaatatccaaagtggcgtattcgagttgaaagagataaactgagagacaataggaaataagaagaggaacacgactgttatagatagatttaagaaattgaaaaaaacaaaagaaaaattttatcaaattttttttaacccaaaagttattaaatctgtgtaaaagaaatttt

SEQ ID NO: 26017 - DNA, 915 bp, Heterodera glycines
ttcggtactttttgcttaaataaaacatccaatacgacattcagcattccagtcttaatctggtcgataatttcatatttaacttattattattattaatcttcagtttaatctttttaaaatggaataattcgtaattctcaagtaaaaacgaattctgactgagaattaattattttcatacctttggctgggctattttttattaaatttatttattttcgggcataaagaaggtttctatgccgctttgatggattttatagaaatcacccataaaaaagaattatgatgtggcaaattttaaattttttctttagttgtatttttatcggtgttttttctaccagtagttttttctttattttttaaaatccaaatcgagggaatcatttcggtattttttgcttaaataaaacatacaatacgaaattcagcatttcagtcttaatctggtcgataatttcataattaatttattatttttattaatcttcagtttaatctttttaaaatggaataattcgtaattctcaagtaaaaacgaattctgactgagaattaattattttcatacctttggctgggctatttttattaaatttatttattttcgggcataaagaaggtttctatgccgctttgatggattttatagaaatcacccataaaaaagaattatgatgtggcaaattttaaattttttctttagttatatttttatcggtgttttttctaccagtagttttttctttattttttaaaatccaaatcgagggaatcatttcggtattttttgcttaaataaaacatacaatacgaaattcagcatttcagtcttaatctggtcgataatttcataattaatttattatttttattaatcttcagtttaatctttttaaaatggaataa

SEQ ID NO: 26018 - DNA, 992 bp, Heterodera glycines
cccccgggtacttaagtttctggtcttttcaaaccgaaatttttgaaaaaaaaaaattagaccaatagcaaaaattttcaaaagccccctctttaaaagtagcgccgcatttatttatgctgaaagccaacgattaaaatgacgacgtaccaaaatggcaagcaaaatgatgttaatggggaacgatcgacggattccatggccgcagcacatcaacacgatataaacgacgataaagatgagactgaaaaagaaagaagcgcgttgttttggcaagaaaagtgtggcggtggaaaacgaacatttgggagaaatgaatgaattttcaaaactcactatgccacaatcgcatatactggatgctgttgaacaaactccatcattggctgacacataaacggaaaagcgctcatcagagtgacaacggacaactgaaaaaatggggagggaattggaaaggaactgaacaaccaatcccagaaaaaacaaacaataaaaaaatattagaccttttctgtaccaaaactagtttttttttaggcgataaattagaaaaattattattttaggcgggtaggggcgggcaagttagtggactagagatgttgctcgcctcgcttctcccggtattctgaattctaaaagtcggacaaaattttgaaaagcatcattttaaaaaattataaattctatcattgttcatcaatttggttttaaattaaaaaaaacaatgactatcgtagtcgcccaattattcacttaccataatgcccacgatgaagaacaccttgcgcacaaaacgcgaacgaattgtctggtcgttaaagcccaggtcgttcttcggcatcccggcctggccttgctccgcgaaatgttgcgaattaaacggctgttgttctgtataaatgcagtggataattattgtcaattaactaaatattttgtttccgaatgccttgggacggtggcggcacatccaaatccgcatgctg

SEQ ID NO: 26019 - DNA, 1340 bp, Heterodera glycines
tgctcaaacaattatttggaatgtcgaacaccaaaatatttatttaacacaaatggaaaaataatacaaaaaatatttgtcggagggacggagcaaattggggagcaccaaaaaaggaaggaaaaataacagaatgaattgtgggatggacgaagggaagggcatgaataaatggggaaaatcaatatggggtcaaagagcccaagagagggaattgcaaatatttgaattatttgcctctctaacacctccccttttaagtccaactgatcagtgccatgatcagtcacacataggacgatcggctggggtcgatttgaaggcggtcaacaggccggcgatttcgaatcggataacggcggactggcggtgattgattggatggcgggacttctgccaaattttggtcccttaatggaattgggaggccaaaagtgccattgatcacatcgagcgggtcttcgatgtcctcatccggaatttgacgtgcgcggatttggttggcatgaaatcggccgcgagaattgtttggcatcggcttgaccatttgattgtggcatgtacggcgctgtaaaaatgtgttcaattccgttcgatttaacgaaattttggaattggtggctttggaattgagtgccgttgtcagaaacaattgtttccgggatgccgaagtgcgcgatcagtgagcgcattttggaaattgtggccaatgcatttgtcgaattcatttcaaaaatctccggatattttgaaaatgaatcgacgacgattaaatacatttttccatggaatggtccggcgtaatcgatgtgaatgcgcttccatgggccatcagattttggccatgactgcagtgtcgtcttgattggatttttggcgacagctgcgcatgacgtgcatttttggacgaacgtttcgatttctgcgtccatcattggccagtagacatgcattcgggccaaagatttcattcgcttgactcccggatgtccttgatgaagcatcttgagaatttgcttctgcagtgatttggggatgactgtccggtcgccgaacatcaggcagtccttgacgattgaaatttcgtcgcggcgccgataaaattgaatgaatttggcttcgtccagcccttcaattggctgaaaatttttaggttctggccaaatatttttgacaaattgacgaatttgttgaagtgcctgatcatttgccgtttcttgggccaaattttttgaaggtgatcggcaattggttgacattgttgatcaaaattctgtccaatgccgattccacttcgaatgaggcaataatgacttcgtcgtcgtcggattttgactttt

SEQ ID NO: 26020 - DNA, 873 bp, Heterodera glycines
gcatccatgaaattctcatgcatatttcttggtcctgcagtgaaagaagaaggaagaatgacttttttctggatttctgcaccgctttttaatgcacgtcttttaagaaaatcttcaacatttgtgtaattgctactgcataattctgcttgatgtgatcttatatattctaacctatcccactcaattttcgctgcttggtctacaacccattgttgaaaaagcttaccagcgtaaaaatggggcaaaaatttattttccttaacatataaatgaaattttgtataattacaaagtgttatttttttccctgttgtatctttcatttctatactgtatccttcatttgaaattggatacagtaatggataacacattggttcaatgcatttatctaagtgatgtacttctttcaattttttttcgccttttggatgaactacaattttgactggtggtatgtcgtcgtttgcatcacataccattattgcgcaaacctcgttactttctggtatattataccttctttgatcaaattgattttttaggctaaaaagtaaccttatttcaggaacatcaattccttcattttgacattttgctttctcttgttcataaatgttcctcattaattgatacgatttgagcaaatttgttatttttcctcataaacatatctatataattcataatattctcatcacaaacattattcaatttgcaccgaatatcaatggcttcctcagaatctagaaaataaagttgaccatttggttggaatttcacactcagcaagtggcatggcgtttgaattaaacttatgataaacttgtccttgaattttatagcatggaggaccaggagttggaaatt

SEQ ID NO: 26021 - DNA, 809 bp, Heterodera glycines
tctaaaaatattttttttgcaaattagttgaatttggcattttgtaagtgataattacacattcaacatgagtttttcctggataatagtttatttgccccccccccttttgaaaatttttttgtttttcttaagtttcagatttttgtttaaacttcgtttgaatatacggaaacgaactaaaaatcatgtgcttcaataaaaagtaactttaaaccatttttagactaaaacggaaattcaaaaattttgaatttataccatattcgtgatcaccgatccctaaaacccttaacttttgaaaacaaaaaaaaattttcttcaaaaaaaggtggacaaactgaactataccttttatgccattcctcgtcacacaaaaccatcctatcgattattgcacagtcggtccccttgtcaacggtattttcttaccttttgtgtattttactgtcgaattgtcctcattgtcagattgcacactgtcgaaatatccactttcggattgtccactgtccagttgtccgggaaccttttatttggctaccgaaaaagctcattgggagccaaaaaacttttttgaaaatattatccattaaagagaagcaaatggaggaattaattaaatttggaataagcaaaaaacaaaaattgaaaagaaaaatatcagggcataagaaattgatccattaatttcataaacatttcatcattactatattatgtttttgggttctcattgctaacgaagaaaaatagaaaataagaatgtttacgcttcgataaatatttcaaaaaaattcaaaaaaagt

SEQ ID NO: 26022 - DNA, 858 bp, Heterodera glycines
aatgttggtggattgagtcccggtgattggaatgttggtggattgagtcccagtgattgaaatgctgaagaattgagtcccagtgattgaatgctggagggttgagtcctgttgattggaatgttggtggattgagtcccagtgattgaatgctggtggattgagtcccgttgattggaatgttggtggattgagtcccagtgattgaaatgctggtggattgagtcccgttgattggaatgttggtggattgagtcccagtgattgaaatgctgttggaatgttggtggattgagtcccagtgattggaatgttggtggattgagtcctgttgattggaatgttggtggattgagtcccagtgattgaaatgctgttggaatgttggtggattgagtcccagtgattggaatgttggtggattgagtcccagtgattgaaatgcagaagaattgagtcccagtgatataatgcaggagggttgagtcctgttgattggaatgttggtgaattgagtcccagtgattggaatgctgttggaatgttggtggattgagtcccagtgattgaaatgttggtggattgagtcctgttgattggaatgttggtggattgagtcccagtgattgaaatgcagaagaattgagtcccagtgatataatgcaggagggttgagtcctgttgattggaatgttggtgaattgagtcccagtgattggaatgctgttggaatgttggtggattgagtcccagtgattgaaatgctggtggattgagtcccgttgattggaatgttggtggattgagtcccactgattgaaatgctggtggattgagtcccgttgattggaatgttgg

SEQ ID NO: 26023 - DNA, 914 bp, Heterodera glycines
ttccttgtagaatttctttagcatttttgttgcgataatttaaaaacgatgaatatacaatatagttggtcctcattttagcaacgccactcaatcaattaatagatactcaatgaattcataagcacatcattctgacagttgccacaataagacgttgggttgtgagtctgctgcagaagaaacaatacagaataagtcactaattatcaaattcaaggacatgaatatgaaaataaaggattaaaaattgttgtgtgctcgataaaagaaggagaaaatcagtaaatttaggaacttaaaaatgcaagggtagagcatgcataataagacacaagtaattgtatattataatatgatgcatcagcacgatttgtagaaagtgtatcagatcgttaggcagtttcatttaagctgaacgatataatagatattcagtacaattctatcgctatagctcttttaaaagcaatgatacatttgattgtacataataaaagaaacccaggacaaattgacgaaagtgatcattttgctgggaagatacaatcaaaggacataataaaagaagaccaggacaaagtgacgaaagtgatcattttgctgggaagatacaattcaaaggacataataaaagaagaccaggacaaagtgacgaaagtgatcattttgctgggaagatacaattcaaaggatataataaaagaagaccaggacaaagtgacgaaagtgatcattttgctgggaagatacaattccaaggacataataaaagaaaaccaggacaaagtgacgaaagtgatcattttgctgggaagatacaattcaaaggacataataaaagaagaccaggacaaagtgacgaaagtgatcattttgctgggaagatacaatttaaaggacataataaaaga

SEQ ID NO: 26024 - DNA, 1429 bp, Heterodera glycines
tgggcactgcactaaattgagtccgtaattttacccttttgatgttcagaattgttggcaagtcgctggccatgaaaatgtgtttgactggcgacccgatcaacgcgagcaaagcactcgaaagcggacttgtcgcggaggtgagcaaaaattctacaactagagagattaaattaattaatttttgcatctgcaggtgtttccgcctgatcagttggtgtcggaggcgatcaaattgaggcgaaaaaattgcagcaaattcaccactgatggtcggaatggcgaaacaggcggtgaaccgttcatacgaaacgacgctccaagaaggtgaggaggaggggcacagagactcatacctgtgcctgtgcaagggggggggggggtcagccaagaggtcttacgatcgactttggccctcccatgggagggtcagagcccatttccattacgatcgaccatttcttgcctgctgaagacctctttttttttgttgctcttcgggtcaaaaaaatttcatcggattgcatttccctttaagtatccaccccttaaataatcagtcctttcgctcgtgtatatgaaatttgctctttttaggccttttgttcgagcgacgacttttccacgcttcttttgcaacggcaaatattaattcatttttcaacattttttaaagccattttcagaatgaccgcaaagaaggcatggaggcatttcaggagaagcgcaaacccaactggcaaaactcatagggacagggaaaggaaagatacaaaatgagaagcggcggtcgctgttggcaaaaggactctctctgtgtgcctttcctcatagaatgtgccgtacaataattgttctttccttaaaaatcctttcaaattgtaatttctaatttatttatatcaaataaattttatcggggaaattatttcgatgaaacaaagcaaagacagcgcaatcggcccactgactgtattaagtgggtaaaccccccccttcgtcggcatgtgcaaaattttttcatctgccgtttccctgcggcgtttctctgtggggagggaaagtcgaaaatgccttcgcccccggcggcgggggtgtggccgacgatatgagccgcggtcccccgggagttctttcccccggggcgaattgggcacacggaagagacattcatccgacatctctcctctcccactctcctcaatctttgcctgttccaataaaggcaatggcatcgcccggaggaggaggggagggaatgagtcccatccctccggcggcggtgccggtgaatcggcgctaatttcttttccctcccattcattgggaagcgacgagacgaatgatgtgattggtggtggtggtgttgcacttgggataatgccaagcaattattttcagcataatcgcgccgttggcacttcttccc

SEQ ID NO: 26025 - DNA, 1879 bp, Heterodera glycines
  misc_feature (13)..(13): n is a, c, g, or t
ggtcgactatttnttgaatcataatatttaactattttaattttttataataaagaggtagctcagcttgaaattggatccttttatattaaatttaacatcagatttttcttcggtattacacgatcgtcaaatatcgctatattttaattttttcatatatctttttctttttattttttatattgttttcgagtttaaataaaaatatcgataatctttttattttttattatttttttttgataatttagtttgaaaaataaaatcttatatttgtttaccttcaatttaatcttagtaactcatttaatctttgaatccacacgcaattacaatattaaaaaatgttttattccacgatccaagacagaagttcacgatggaaaaaaatcataaattgaaaaatttcattttgagttagtaaaagctcgtgtacgtcgtcattgggatcacagaatattagcaagacaaaaattgaatcgccaattttaaattacccaataataaaaacaaatttgttaaattaattgattttacatcttgacaccgtgctacagttgtatttatcatcggaaataaaatattattttgaattacgaaattaaattgaaaggtaaaatataattaattttttcaaattaaattatccataatcatataaaatagaacaactatctattttttagtcttaaagaataataaaaaaaaaattcgtaaaatatcttattaaatttgcatttaaaatatttgaatttagattattaaaaactttttgattaaaaaaataaacaatttaatttatctctccctattcaccattgaagaaaaatatggatttatcgatgtaatacattttttcattaattttttcttccattattaaatagtaaaccaattaatataataattcttttaattcaaatgattttttttaataattcttatgtaagatattgaaattttatctattcaattaactaacgaaaataacataaagaataattttaaaaatacaatattaatttggttcctagttaaaattgaaaaaacaagtttatatttatattaaatttatcattaattaaaaaagtctttgaaaaaaggcaacagaattttaattaagaaataataaaaattaatgattttaaaaaccaggctatgtttgcctgatttcaaccaaataaaatctatattcttattattaattctaaaatgttaactcatttttatataataataaaaataacaattgcaagtcatctgatagatagatccattaatttaaatcgaacatttcagcatactctagtgaattgctttagttattttgtgtgtttttttgccatagaatcgcacggtgtgatatgtaataacttaatttttttatttattgggtaattaaattgactttcagcccccttttttgctactccattcttcactccgctgatcgctgatcaccacttggaccattctctgccaatcatttgatcaccaattggaccgttttgcgctttcatctgatcaccgccacctgatcaccgccaggactgttctctaccaatcgccgtcgccaactgatcactgcccacaaaagtcgaggaccaattacgccttaaggaacaggtcaagcacagcaaactggctaattagacggttatttaaccggctatagattcgggcggccttaacggctcattcattcacagttacgcaggcatccccgcttaaacccatactaagcggtttgcgttaggagcaattctatggcctgcctgtcgatctcggattgcaggagcgtgatggcgatgaggttaaatgaaatgaaattaaactcaattacccattgtcacctcttggaatttgttgccttata

SEQ ID NO: 26026 - DNA, 1824 bp, Heterodera glycines
  misc_feature (1819)..(1819): n is a, c, g, or t
cttaataaaatttttacaggcttgaaaaacttttcgtttttgataaggctaatagagcatgttaagagctttcgaatgataccaagattgttggatttggatgccaaagaaaaaagcttaagtggaaaaacgagctggcgccgaaacgggagcgccgaaacgcgagcgccgaaacgcgagcgccgaaacgcgtgggtccccgattcttacgggtttatttttctattttattgcatttttgttaacaaattttgggcaaaacgccaaaataggtgaaaatagtttttaaaattttttttaggttttttaggtgctaataataaaaacctagaaaataggtgctaataactcgaaaagtagcttaacaacagccaaaaaaaaacatgtttttcgtgcatttcaggctacggggagctcaggaaaaatagtgaaaaacctaaaaatatcatccctactcgtgactccctggggatttttttgggagtcccggtcccaatctagtactttctatcccagtatgattttttttacgggaatgggattttatgggaatcccgttcccacttcctggaacgggtttttacggacccgtagcccgtaatccatattttttcgaccgaatgggtttacggacttcggattataaagcctataagtccgtactccattctttcgcagcccgtaactcttaccctttaccgtacaattttcgaatagattacggttttttaaattatttattggttgaaaaagtaaacgatttgatttattgcattttgccaaaaagtaagcaatcaattaatttaaaatgaaaccgttgttttaaatgtccccttttttttcattttcaagcgcaaatacttttccattagcgccgagtatttaaatccattttttgaatctattaattaatggggatcttgccttatgcattgatttagttttgtgtcgttccctcccccctcactgaggctgtaatttaaattactaactttagacaaactcaatcacaaacaaaattctcggcggcaataaaaaggctgacaacacttatcaccaccaacagcaaaacaaatcgtcgtcagcagcaccgtttggcggcggtctcttgggcaaaatctcttcgacaatcgcttccgctgtcaattcgacgaatcaacaggcgaatgggggaacaaattaaaaaaagaaaagaataataaatgcccaattagtaagagaaaaaagggttattaaataattttaattgataaaatgtgtcagtttcagcattatccttcaactcagccccaacaaatgtcttccggcggttacaacaatcaatcgaattatccgggaggcgcccatccgcaacagtacggcaccggaaacactggcaacgctggtggatttatgtttagggtaaaatcaataattaaatatttgatctttcatatcttttttataaatattgtataatttatggatcaattaaatgtttatttttaatagtcgaattattattgtttttggttgtcaaatgaataaaaattattaatttgaaatttacttattttttactcgtttgcgagagctaaaaatcctgttgcagcagctgggtaatgttatgcttgataaagtttatgataatgttcaaataaacatttttgattgtagtttattcaaaattaattaatttattcttatttgtaatttttaatttaacttaatgcaattgtcttttatttctaaccgtttttttaaatttaaatgcgtgacgtgtattttatcataacttatagaaagtgcttatcaatcaaaaaatttaattagcaaaganttttt

SEQ ID NO: 26027 - DNA, 1629 bp, Heterodera glycines
gttattaccctaatgaatttttaagttttgttttaaattgatttaaagaatttgtttttattagttctttatcaagttgattccataattttgttaccctcccggcaaagggaatgaattttttgcctattttatattttgtgttaaatctgtaaaaggggatgttaaagcgtgtcgatggattaaaaattgaaaatagtttcagatctgttcggccataaacaattttatgcgccatgaacagatcaaatagctttcgcctattctcaagtgtcggcagttgcaggtattctaatcgattttggtatggaattggtggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttattttgtttacataaaaaatggctttgaacaataaaaaatgcaaaattgaataataataattaataatcgattttaaaaacatcaaaacaataactaacaaataagcagcgtttttagacaattgcaaaaaagattttcaaattttttttatgcatttatttatttaatttatcgagcaaaccaaaggcacattagtgctcttatatggcgccaaaaagaaacaaacaaataaaattgatcaaattaaaaatacaaaaataccgaaatataaatgaaaataaaataaatcaaatgttgaattcacaggtgattataaattgtaaatgtggcacagaaatttcctactcagaactcattgcttttagtaaacccctgaattcctttgccttattaatttgcaccgctaaaactggaaggttattccagtttcttactatcctatggaaaaaattattttgagttttggccgtgtggcgctttacccgtaaaagtaaaggcctcctgggcctttctgagaaaaagaaattttgctcagcctctaggctggtgaatcctttaattattttaaaagctgttgttaaatcattgatttttcttctttcttccaatttgtgtaaatcagtgattttaagtctttccatatattttttgtacacaaatccacatttttgaaaagcttttcttgtgaaaaatttttgtacccgctcaattttgtctatatctttttttaaattagggttccaaacttcggtagcgtattctaattgaggtcgaacaaaagttttataagctgctgttagagtctttatttccctgcttttcaacactctcaaaatctgaaagcttctaagatatgcgtttcgtataattttgcttatgtgttctgaaaaattcagtttcgagtcaattataattcccaagtcacgaacattatccgattctgaaatcctttgtgagttaataaaatattcttttttcatattatttttccctaaatataaaacaaaacatttttcagttgaaatttctaacccatttatttttgaccattttccagaacgtcaattgctttatccaactgattcgaatggtcatcat

SEQ ID NO: 26028 - DNA, 1563 bp, Heterodera glycines
gtttgaaatccgtcggtgctgcttccgctgtgtgcacggagtactgcccggcgttgtggctgcgttcgctcacacggcagcattcccagtgccattattgttgttaatgttcaccaccagtgttgaggaggaagtcgccgtggacaacggatgcaggccgtgcacaccgcccggctcaaccaaggtggagttgttgtacatgctgccgtcagcgtggtaaatgcagtgttgctgcagttgttgggtttgcggctgatccgagccgaaccgtgcgccatgcgaatggataacggaggaagcggaacgcgtgtagggcgaagcggccaccatcaaattggaggaggacattgctgtttaaagggagaaattttaattgattatgagtaaaatgatggaaaccatttaatggaggacatttttttatattgcaaaatttgaaaaaaaaacaggaacatatggaaaattgtgtagattaagtgtcgcatatgtataccaatatgtgtttagaaacaaatttgaaggggcctgtgtttagatggaaaaaacaagaataagaaaatcgcacgagaaacgctgaaaataatcacaacgcttcgcgcacaaaattaaaaagagttcaagagaatggaatgaatggtggcccattactttaaatggtacctccctcccctgcccattctctctcccttttctaatccataaaagcaccgcttcgtgtggcaatatgtgcattcaatttaagagggaggcacctgttggtgaagtgggaaggaaggggcggggaagtgtcgttgaaaatgatggaaagtatgccaagtggacgcgtggggggggaggagaaaagggaaggagatgaggtcaaaaggtgagcgcagcttcagctgctgccttttcacattacaacacattatgaaatgaaaatagacaaatattatcagcaacggctgaaggagggcgaagagtgtcaaatggccacgactgccgaagaagcggcttttcacccccccccccccctcaccaatgcttttgcacgccatttggcagcaaaactgttgtgacattgctgattgccaatgttgtaccactgtcgcggtttgagactgactaactgtgacaatccgtccatcccgacgaacgatcgaccgaccgcttctgctgcacaacatcaacagcagcagcagagcggaaaaccagtcggtgggtcatcaattgttgtaattgcagcgtaatgcttcagcgtgcaccgttttttcaattgttcaacacacacacagaaagaaaaatgtgtggcggtgtcagtgaaccgatcaaacatagcctggggcgggggagatgagggatggatatggatacatatgcgaaccaagaaccaaccgatgagcaattaaatggctatatcattttttgggataaatggcggcaaaatgtcgctttgaccctttttcagcagggagatgaaaaatgggtctcccccaattaaatacatatttaaaaagggattgtttcaaaaaataattcccaaaatttccggtgccagtcatcaatagagaagatgactctaga

SEQ ID NO: 26029 - DNA, 963 bp, Heterodera glycines
  misc_feature (827)..(827): n is a, c, g, or t
tgagaataatatattttttttaaaggtcatgaaaatttcaagaatttttatatgggtacgacagtatgatatggtactttgggtataatttcctctaagcagcacaagcttaacttcggaacttttagtacatactctctgaatgagctgagaaataatatatatttttcaaggtcatgaaaatttcaagaatttttatatgggcacgacagtatgatatggtactttgggtataatttcctctaagcagcacaagcttaacttcggaacttttagtacatactctctgaatgagctgagaaataatatatattttttaaaggtcatgaaaatttcaagaatttttatatgggcacgacagtatgatatggtactttgggtataatttcctctaagcagcacaagcttaagttcggaacttttagtacatattctctgaataagctgagaaataatatatattttttcaaggtcatgaaaatttcaagaatttttatatgggcacgacagtatgatatggtactttgggtataatttcatctaagcagcacaagcttaagttcggaacttttagtacatactctctgaatgagctgagaaataatatatttttttttcaaggtcatgaaaatttcaagaatttttatatgggcacgacagtatgatatggtactttggctataatttcctctaagcagcacaagcttaacttcggaacttttagtacatactctctgaatgagctgagaaataatatatattttttcaaggtcatgaaaatttcaagaatttttatatgggaacgacagtatgatatggtactttgngtataatttcctctaagcatcacaagcttaacttcggactcttagtacatactctctgaatgagctgagaaatatatatattttttaaggtcatgaaaatttcaagaattttatatgcgcacgacagtatgatatg

SEQ ID NO: 26030 - DNA, 793 bp, Heterodera glycines
aagaacgtgtcggtctgtggggtgtggttatgcatagtttttccctggcgttatttctataattgaaaattctaccggtgaaattgaactgctcaaattcatccaaaaatggatatggaaagagctcgaaataaccaaagccaaattcgacgaactttgtgagttgtccctttattcattgaatgagtgtcgttttattctaaggctcaccgctttttgcgaacccacctcatgatctttcgccaaattcgcaaggctacgtccaacatgcgcggctgttcttcaaacgcgcgtccatcgtttttaggctcattcactcggctgtggacaaattaaatgaccccggtctctttcatagaagctccattttcaaattactcatctataaacattcagattggcttcactcgattattgtgcaagagacaacggttcgccaagtccgtctctactcgacatgcatcgcttttggccttctttacaaacttttgccaattgacccattgaacagtcgtctttatgccactgttaccgagaaattttcaagacgggtggaaaaactcaacaaaattgggtgatttatataatatcatgctactcgttactataggggagggggcagagttataaatcaaatttgaaaacattttaatgaaataaaaagcgaaggggtccggtcatgtaaatcggcgacctgaactttttttttttgctttttaaaccgttttttataatttaattggtctaaagggagagttgtttaggattttgtcacatttaggaggaagcccca

SEQ ID NO: 26031 - DNA, 1496 bp, Heterodera glycines
  misc_feature (112)..(113): n is a, c, g, or t
  misc_feature (1405)..(1405): n is a, c, g, or t
tgcttttgcgcaacaattctccccctctggtgtccttcattttagaaaggcactgaaccgtatacaaaaactctcacattctaaaataactcagttaaaacagcttttaatnntaattgttctgaaaccaataattttgtctgtaaaaaatagtctcatatgaaccacgacataaaaagtgccttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccatctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcttttgcgcaacaatctcccctctggtgtccttcattttagaaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtataaaatagtcccatatgaaccaagacataaaaagtgcttttgcgcaacaatctcccctctggtgtccttcattttaggaaggcactgaaccgtatacaaaaactctcacattctaaaataactcagttaaaacagcttttaattttaattgttctgaaaccaataattttgtctgtaaaaaatagtcccatatgaaccaacacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtataaaatagtcccatatgaaccnacacatagaaagtgcctttgcgcagcatctcccctctggtgtccatcattttagaaagcactgaaccgtatacaaaaactctcacattcta

SEQ ID NO: 26032 - DNA, 1159 bp, Heterodera glycines
  misc_feature (60)..(61): n is a, c, g, or t
  misc_feature (135)..(136): n is a, c, g, or t
  misc_feature (1132)..(1132): n is a, c, g, or t
agcaaatgaatcaatgaattgaatgaatgcgaatgaatgaatggcttttactaacacaanntgaggagaggacggcagcccatcgctgttgctttttgtgttttacagaaacagaaattttggctaacggcggcnncaaacaaatcttttgttgaaatttttcacaaattttaatggaaagccattgaaaagcaggcttatactttattattttcgagattttagttagtgtgtttttaatccttttgggatgtttattcaaaatttttatttaatttaccatgctttttaattgaaaaatgattggaaacaaaagaataaaaatatatcattacttctataattttactgtcaaagaattatccatgttttatcattttaaaccctttcataataaattaaaatattattttattttaaattttaaatttcatataaattattctttatttatttataaatctcctatagactaaaattactaaaataaaatattttttgttgcaatgtttgtttgcttctcatcactggctttctcatttgtcagcacaaacaatgaaaatagtttctcttttgccaaaagcagagcttaatcgatttttcctctcagtcattggcattggcattttgtcccgctttttttcctgcagcaactaaaataaacatatgcggcttttgcttttgctgtgccacacatataattgttggaaccaataaaattttgtttatttattggtctagtctttactccgttaataatttattttatttgttagcctaggtttttcggtattcgtcattttccaattgaatttgtttaatgcatttaatcagtctcgacaagtcttagggtctttgaccgtaattgtaattttagacgattaagcacattccaatttgttccattgtgtggcaattaaaaaatgtctgttgatcagcataataatcatctgaatgacatgggtcctccgcctgatccggtgatggaagtgccgccgccaaaagagatcaaagtgttggagagcgcggacgacattcagcaccggcgaacagaagcaagttgttcaggactaacagtacacagccattaattcgggcgctaattggtcttaattagacgcataatgcctgnggggattaatttgatttttaatggctt

SEQ ID NO: 26033 - DNA, 1489 bp, Heterodera glycines
  misc_feature (1384)..(1384): n is a, c, g, or t
  misc_feature (1389)..(1389): n is a, c, g, or t
  misc_feature (1398)..(1398): n is a, c, g, or t
tggactgtgccgttaaaattctacatgaaatgtcaccggcagttcgcctggacttagcttctgaaatctcgacgatgcaaagattgagacaccaaaatctcgtacaactcttcggtgtcattttttccgagcatattatgatggtcatcgaactttgcgaagatggctcacttctggacagacttcggagtcaaaccaagccgcgacttttggtcacgactctgctgaattacgcccagcaaatcgccagcggaatgagttttttggagtcccgcaaatgccttcaccgggacttggccgctcgcaatgtgctcctaacccacgaagaacaagttgctcttctgtcgattcgaactacactcaaatacacccccccccctctctttaggttgtcaaaataggcgactttggactgacaagaattctcaaggacaacgaacgcctttacattatgagcgagccgaaaaaaattcctttttcttggtaagtgaacaaatttaagtggattgtttggaatagtacagcaaatgatccaccccaaaacaccctcaccataaacgctgtctaaaggcactgcccgaatttttggatttattagtagattttgcactaataaaatctttaggtctcccccagaaagtctgagatttcgtgaattttcgcataagtcgggtgggtttctttgtttgcttcttatttgttattttttctctttgctttcagatgtttgggcatttggcgtcactctttgggacttttcacttttggcgaagagccgtgggccgggcatcgtgcagctgaggttcgattacacaaaaactcattcgacattaccataattctcgtttcacatcttttccttttttaggttctccaatttctcgaaagtgaccttcggttgcgcatgcccgacttttgttcgcgagaaatttacgatattatgaaattgtgttggcagaaagaagcggaaaaacggcccaaatttttgcatttgcgcactttgttgaatgacgttcgattgatttgactttatatattcgcgcccattagtttttagtgccaattcatggcgatggtttgtcgttcaccaaatgccgaaacgtcaaaatcacaattgaatctttctgttggcgacgaattgattttaattggccaaacagatgaggaaggcatttggtacggacaatcagtgaaaagccgaaatttgggcgattttccgagaaataaagtgtcggtgaaatgcgcaacacaacctcagactgtaaagagtgcagtgaactcatctgattacaaaaaggatatttcacgccctgtcgcaggtgggcaatctaaaaaatgggtagagatatgagtaggggttttcgctctaactaaaaattattanatganaaatcttanatctttctcgaaaatatctcccttatttgtcaatgcgaaaactcggactatttgtcatatagaaacgattccgggctctatatatttttta

SEQ ID NO: 26034 - DNA, 1078 bp, Heterodera glycines
cccccccccccccccttacgggcccagtgggtttttttcaataagaaaattattaagttttcaagatttccacattttaattttttcaaaacaaatattatcaaatcatcagttaaaatgtgcctggactggcctgtgtttcattacctttaattgaatattttatttcaccttccttaaggttctttcattcacacgggacatggcgacattcgcgagaataaatgctggggacacgttgactatattgacgaaatttacttgaagaatccactaatcacacaaaattctgtgtaaattaacgcgaaatcgcaaagttgattatttaaacgtaaattcagtgccaactccgaacagaaaatggcgattgtgccgtctctgctgatgctcgaccagaaacagtacggccttcccctccccggtcagcaaaacgagcgtaagaattcattcaaactgaaaaggggacggacccctcttctcctcactttcagtcgcaaaccctttgcaaatgccgaatgaattaactgaccaccaacgaaaagattgtggtcagaaattggctgcagaagcaactttggcaattggcagcagagggaattcggcaaatgaactcaattcacatcgccattcgaccgccatcgaatggctttccgatggacaaagccaacaaatgggaacaaagcaaagtcaaaaaaggatggagcacaaatgcgcctcattgccacaaaatgaaattgtcgctgtttcaaaatcaagtgggaacttaaattaatgcatctttttaatggattttaagaatacgacagcgcaatttccattcctcggcccaatcgcttttcgaactttcagtaaagtcaaaaattttttttgtcatccattatttttatttagtttaacacctccgtccatttctgtcggaaattttccggttggcattggcgaaaaaagtcctcaaacgatttcactatttttggagcccaaaattaccacggttgcatagatgccttctgtcatttcgacttcaaccaataaaaccgaacggacgaataccaaaaatgttcatttgctaatgaaacag

SEQ ID NO: 26035 - DNA, 1131 bp, Heterodera glycines
agctcaaccattcgcttcctcacccaaccaaatttttttctgtaagaaatggaaaattttaaggtgccaacgatgaaccacatcatgcagcaagtgaagcaataaattgagtttggtgcatgcgcgttgtataaaacaacatgtgaatgaatgtgtttgtggtgggaagggtgttgacgattgggcaagcaaaacattgggaaaatggacagattagacgagagtttcaattaagaaaaatgcaaaaaattggagtgcgctaaactaattagccgatcttaaccacatctggtcagcggaaagccggaaaataatgaaaaaaaaatgaaatttgaaaaaataagtgaatatattgaagaaatgaacagacagacagaccaccatgatcaagaaggaaacagaaagaaatggactatttaaaaggaaaaaatgtttaaaaaataaaggagatgtccttatggttttaaaaaagggctcgattatatgcatggtaagcaaaatttaagaggagaggaggtggaaaagtcaatgaaatatattcaatatctgcttataaagcgcgtttcgctagctcagctgacgccgttatatgtgcagtggtggaatgatggagaaaaagcgcgccaattattatatagacatcaaatttttaataataaatattaatgttattattattatgactatgtaaaaatgctgttttgtggatgatacaatttcgcaatgtcgccgcttttattatataaatatctcagtacatgcacattatgacagctaatgattgtctaaataaaaccgggatatttgaacagccaagatcgggatttggaaatgatcaccagcaggaatcaaatcccgatttgccagggtttgagatctcggattttttcaaaaaatgttttgatcatgcatgatcaggatcccggcaaagaacagtgggattccattccggtcacatccagtctctatagagttaaaatgccaatcaccaaaaaggtaccgatgccgatggaaaatatcaaacaaaataattcatcaaaaaaatctgtctcttccttccttctcccctcgccacaacccaaaaaccagcgctccataatgggaaactaggtgaggaaaatgacgaaattt

SEQ ID NO: 26036 - DNA, 916 bp, Heterodera glycines
tgcctgccattttcgaccttctcaccttcgtccctccttttcgcagtcagaatcgccttcatgaagcaaatgttcggcttggcataaacattggtattatcggtttcggatttgtcattcttgttggcggattggtggtgaatgtcattacgatggctaacaaagaggaagattggaagtgcgctgcaaatgctacgactagcggaaatgtcacggcgacaacgcaatcgtacaccacaccgatttaattatcttaatcgcatttgcttaatatatattgtatgtaggtatatgtgtaatgtattggctaataaaaaaatacagtttcatacgaatgtattttaatttacctaattaataaaattactagagaccggacgggcccgggggcccggcgggcttttgccgggccgcccgggcccgggcccgtttatttttggaaaaaaacgggcccgggacgcccggtaaaacgggctttttttgaccaggcggcccgggcccggccaattgtcggagcccgggcccggtcattttgaccgggctaaaacgggcttaaatttcaccagcgaaactgcccaaaatttgaaaaataattattatttttggcgaaatgtctttaattcaaattttcaaaatagaactttgtatttttgaaaatttggggcaatttcaactgttaaaaagaccccaaacccatacataattgagtaacattttcataactatttcatcaaaaagatttccaaaatttatgaaacaattaacaaattttcttaataaatttcattaaaagtcaagatttttcctcagcgtcgccttgtacaaaaatattatttttttctcaaaaatttagctcaaaatttcaaaatttggtcattttttggtgtaaatctgctaacaaatcacacacaaattt

SEQ ID NO: 26037 - DNA, 1480 bp, Heterodera glycines
tgtagcggagagtgcccgacccgtcgctggtgataaagaacgccagccaggctcaacctgattttgtttcaaaaataaattcaatttcaatcttatttttcaattgcattattaaaaaaatatattattagaaaaaaaaattgaatttgtttagtgaaataaaaatttttttagatttttttatctaaatattttttcacttttcggtaagttcctccgcgaattgttgcaagtgtggcataatcccagatgggctccgggtgagcattaggatccgatgggcgagtgtacttaattaagcatttggaaacaaaatttacaattcaaaaaatggttacggattccgttttaaaatttcaataattaatccaaaatgatgattcaattttataatgacttggtctcttgcgctgtcataaagcagctcaaattggccagctttgcgttctgcgtctgtgacctgtttaattaattaaattagcgttaaaattaagtttgaatttcacctttatgacagtatctcgcgcaaattcgattcgaaccactaaattttcggcacacggttggtccaacggggttcggaaaaccttaatttaaatttaataaaactaaaatggtaaaaaatgcatttcgatgatgcaaatgtaaaatattagtatcatttattgacaatgtttatttttttattaattttgaattcacttgtttttaaattgatctattaaaataaaaatgtttttttgttttttcaatttaatttggttttatactttaaaaaataagatttttaaaagttgacattttattttaaaattaaagcatttgttataaaaataatgtccacctgcgcatcgtccaagtcgtggtccagcccgacatttggagttttgtcatcaaagtgaatggtcaccacggtttggtccgccgtgcccacctcgtggacgcgcattgtctccaccaacggttcacggttggccgcccattttttgtctccctgctgctccgccaggaagggctcattggcaagcgggatttcggcatttttctttcctaaaaattttaaaatatcatgataaattaactagagtgccacgggaccgggaatttttgccaaaacagggacggggacttgccgggacctgagaagccgggaccgggccgggacctcgattttttttcgggaccgggaaccgggaccaaccgggaatttttaaaaattcaaaaaaatcaaaaattaaaaaaaaattcaaattttaatttgtttttcaactgaaaataatacaaaattaaattttcattttgttttttatttaataaaaatccaaaagttaagctaaattaaattaatgaaaattttcaaacaaatttctttaattatttcaaacaattaatcatttctgggattaaatgattgaatattattataattaatagttgcttttcccatccatttttttcgcgcgctttttcaaaaattttt

SEQ ID NO: 26038 - DNA, 1755 bp, Heterodera glycines
tagggcagcatataatggtacatttcgtccatttcagaattgttttttgttcccgtaattacgactttaccggtccagaaaattaaagcagtcatgcttttaccccgcttgaaatttaaaccgcaaaatatttcgggttcataaaaggcacggcgattttttcgaaactcgttcagttcaatttcatgtccgaatttaaaggtcgaaacaatattttcaaccgtgtgtccggtgtaagaagcccccggacaccccgagcccttaattatttctatcgcagtctatcagacttttcgtccccagacatatcatttttccggattcccataataatgccgtggctttgataggagttgtacatttgataaccgcggcattgaattttctagggttatacttaaattcgcattcggtgatcgtcagagagtttagtttaattccggtaccgagattagcgaaagcaattatatttacgattatcggtttttgcatttttgatacaatgtatcaatcaaatggtcctttcatccctttatataccccttctataaatagcaacccaaaataaaattaaattgaaaaaatgaactgtccacataaaattatgtgttgtcattactgtccctgtcattacgagatttgtagcaggtgtaaaaagcacagtcttttgcatttcggtacatcactatttgataatttctggctatgccccaaatgcgcgaaacatgttccctatgaaaatataaataggtcaaataaataagaggaattaaaaatgtttcgcggtccgttcactctaattctctcgggggctactgggagtggtaagacccgttggctattacggtttttaaagcatcataagaatctaattgaaccatcgcctgaaaaaattctttattgttatggtgagatgaatgatagtattttaggattaatcgggagtagtataagacgtcaaaagcgcacggttgcgcacgggtgtttcgcgcacaaacccgtgcctatgggaggggtgcagccctttgaagttgccgcccgctcacatcctgagcctatgggatgttctttgaactctgccgccttgtggattttaatttacccaaatccgtgcgggtgttttttcacccggccgcgcagcgccgcgggaaggtcatcaatcatccacctgtcaccaaaagtgacaggtgtaggaaattcaattttttcttttgcaaatttaaatctttttgatcccaaatcttttgggcggttttattttctcaaatcctgtgatttttttatgatgatttttctgaattttgaaaatttgccaaaaccatgcatttcctctccgccccgccggtgcgtcgcgatgccggcgccgcgcgaagtaatcgataacaaaataaatacccaacagaactataaattgggggaccgtcccaataaatgaaaaattttttatcgtctccctaacttcttttgagccattttcagatagggaagaatataatgatacatttcatcaatttcagaattgttttttgttcccgtaattacgactttacaagtccagaaaattaacgctgtcatgcttttaccccgcttgaaatttaaaccgcaaaatatttcgggttcataaaaggcacgacgattttttcgaaactcgttcagttcaatttcatgtccgaatttaaaggtcgaaacaatattttcaaccgtgtgtccggtgtaagaagcccccggacaccccgagcccttaattatttctat

SEQ ID NO: 26039 - DNA, 1568 bp, Heterodera glycines
taaaatggatttaaaatgctttattccatctcacatgtgttttagtggtttggatatgtgtttttcatccacacggcacggtttgtttcccggcatggggaagagattttttctaaaaaatttaatttcatactttttataaagctaatttcaacatttattctggcattaagatcttagtaaaataattttaaaataaaacttagccatatataaaagtaaatctcaaagaattattcaaaacatttggccaaaaattcaaaaaaattactctacccctccatcaggtgtaattaaattaaaaagtattttatatttgaaatcttaggcgaaaaaattcctcgtcaccaccagcagattaaattctattaaaaattattttacatttaaaatctttgtcaaaaaacaatttataaaattcctcgacgtcaccaacatttttcattataataaaaattagttttagcgtatttattatttcgatattattatctaatttcatatatcaaaaatattttcccacatacatattgatgaagatgcaattttatgtttttcctttttactccgtaatgagggtgaatgaacgaatgtttcgtttgtttgtgcaaattaacaacaattcccatgcgtacgacaaaaccctctcctctcccaccctctcctgtcccctctcctcccctcacctctcctctcccctctcctctcccaaccctctcctgtcccctctcctcccctcacctctcctctcccctctcctctcccaaccctctcctgtcccctcacctcccctcacctctcctctcccctctcctctcccaaccctctcctgtcccctcacctcccctcacctctcctctcccctctcctctcccacccctattctgtccccaaaactaagcattccccaaatctattaccttctttttatcaaaacagacatttttgagactaaatttacttaaatccacggcaatggatccagcggggcccgcaatatttacaatgagaggcaaaatgacaattgctggatggcagcagcaacagaagggaatgaaagagtgaggcgaacaaaggcaaaaacttaaatatatttaatatatatttttatattttttattatttctgaagaccttaattaatttgaagtgaataacagtaattcatatgttagctgatttgttcatctgtttatcttagcaaaattttttgtgccgtataatttgatctaacgattgggcagcataaaatcgcttaacgcaccaatgacattttctattttttttgaaaaaaatggaaagtaggaagggagaattcctgactcggtgaaataaataaatttaattaaagaaaaggcacaaaaatcccgaaaaaggcatgaaaaaaggcatttaaaatttttattaaggatttttaaagagcaaaacacgaaaaacttaatcaaaagcttagttctggttattaaaaagattattaattaaacagtttattattttttcgaaaaaccgaaaatgttaaacctaaaaattttttatcaacaaaaaaagaaattttgacgatccattttt

SEQ ID NO: 26040 - DNA, 1064 bp, Heterodera glycines
aatttaattcaaatgaaaatttttatttattattaatacattaaaaaatattttaaatgaataaaaattgaaaaacacaaaataaatggtagaaaattaatgtacaccgtccggatccgaacttgccccccccccctcaaaatgatgccccagaatccccaatcacacagggattctgaggtcttaacgaagtctaagtaaaatctgattacgtattcgtgatcagcgtcctaaatagacctaaagataacttttttgtgagatgtttaatctcttagcttctgcttaatcatcgcttctaaacatggagagcattcgaatgatattaaatttgaagaatttggttgacttaaaaaaaagatatggccacacccattaaaaattatacgagttgcctttgtacgagttgccattgacgcctcccgccgtcgggagccggaaaatccgacaccaactttaaattcaaatttttttagatgtttgagttaatatctatctgtctaggcttagcaagttctcgaattgaatttaccgagaattattttatttcccgtaatccgcaatccgtaattttcaaaaatcaattttttttttttttaatttttaaaatttttattaaaaaaaacttatcaaaaaattgttaaaagtaatttatgatcagaataaagctttgaatgattttttgggtcgaaaaatcctaaaatataagcagaaatcgcgagaaaaatagcaaaaatggcagattcagagctgtggacgaaatttaaaaatttttttcattaattttcaatgatctcacccttttagtctcagatctctacagtatcaactggtcggtgcgagagttggtaaactgactagcaattttcaaactggtggaggtttgacaagcccaatttttgaaaaagaataaaaatgaataaagttcggcgtaaattttaagaggaaaagaattttcgataaatgaacctattttgattggggtcgaaaaagtcgggaagcaaatatcgtttttggaattaaaaagtaattatttgtgcgttccgttggccgcaaatgttcga

SEQ ID NO: 26041 - DNA, 686 bp, Heterodera glycines
aattgatgacgaaaaaacaaacaaattaattggggtaggcgggaaatgagtggtgttccccttcccccagaaagctatttaaatgccaatttttcacagcagaaccataaagaacggcaaaaaataaatttttaggtattttagcaataaaaaatttatttaaatcaatgcatttaaaaaacaattaaaacattattctgtttttaattattttcagtttttctattattaacaaataataattcattagcaaaaatggcagcggaacagcagatggaattggacttctcaactgacggcaacaacagcgagccatcactggccggtgattttgatttaaaaaatttaaaaaagttcaaaatgggacagaagaaaggcacgcgtcagacaatcattagccatcaagtgtggtgaaatccatagatttgctcataaattatcataaataagtttttaatttttaagaattaaaacggtctaaaaatatggccattttttgaaaaatcctctattagaacggccccatttcaaagcgaaaattgaaaattttagctttatttagtatttttttagcagcaattaaggcattttgacggtattttgcgatttttaagcacttaattggcaacaaaataaattattattctaaataaattctgttgcagctcgtattgtcggaagttgag

SEQ ID NO: 26042 - DNA, 1165 bp, Heterodera glycines
ttactataataataataattaataaaattatgttaatacttttaattgacaaactaatgacatgcaatcgccccccccccaaaagctattgatggtggggacacctcgttcccctcaccctcttcctttttacccataccgtttcctgtcttaaaaaaaatattaaaaaatttcaagaaaattttttttttaaatttatggagaaatttttgtaaaactttgaaaaaatcaacaatttcccgaattcttttttttgaaattctcttataaaaaaattttttatgcttttttcaattcgaaataaatattcttctcccaatcctcaatttttcgtctcttttcagaattaccaagttttaatgctcttaatttttcagaaaaattgtggacagccccggaactgctcaggaatccagacgcacacattcagggcacacagaagggagatgtgtacagttttgcgctcattctgcacgaaatgctgtacaggaagggtgccttctacaggggcgaggaagagaacccgagcccactgggcaagtttttttaagggtcaccaatttttctggaattttataaagacccctcataattacggcgtgatgggtcattttgtagattttagctatttttcgacaaaatatggcataattttacatttttttttttggcttgcaaaatttcaaaaaaaattcggtcaactttcgaaaaagttttatgaagatatgtattatttctgccataaattataataaattagataattttatttggaattttccaggttaatggagaaaaacctgggctattgaacgataacaagaatataaaattattacttttaagaaaaagccatattttgtcgaaaaattagctaaaattgcggattttcgggcttactttttttgcaattaaaaaatttactctgtaaaccttttttttctgtattaagcccaataatcagtaattttttttgaagaagttttggagcatttgcaagtgatcccacccattgacgcggagctgtacagaccggtcattcccgacttttcgccggtggacgacacgccggacacagtgagaaagttgctcgacttaatgatggcatgctggagcgagaacccaacatggacggcccgacttcagcaccatacgcaaagtggtg

SEQ ID NO: 26043 - DNA, 1658 bp, Heterodera glycines
  misc_feature (1616)..(1616): n is a, c, g, or t
aaaattaatcaacgacagctttttgataaaattgtattaaaaatgaaaaaataataaataaattattgattgtgtcattcataagatgaaataaatagtttggcttaccttttactatattaattatgtaaaacattttatattatacaaattatttttcattttaattttaaaataatgaaaatattattgctattaaaaagaatcaaacggacgctagcaaaataaagcaacaaataatttttgataaaatatttggccaaggatggggcagaagaaaattcatgcccaattggtcaaataattcacggacaaattgctgtcataataagcattatgatcataatggtcattaaaatgatttaatttttgatgaacatttggaagtgatataatcgcttacagaaaagacaggtgtgatttaaaaacagtttttgtttcgtttccattgataataatcttatgaaatcatacatgtatgatgaaattttaaatttgttttcaaaattttctaatgtaaaaatcgatgcacacgacgtgaggaaaagggcgaactttgcagctgcactcggcaacatataaagccattgtcttggcctgtgtacagacatgcagaattctctgggcaggccttaaaaattcaaaaattcttgatttaaaaacgcgttaaaataatgtgaagaaaataaataagaagaaaggaatcactgacctgtggggtgccggacctggcgtatggattacaggtacggtagttaccggccaattcaacgggaacaagatttgctggttgaggcggacatacatctgaaaattcactatgcattcaatttaaaatacttaatgagacagctttttttaatttttcgcgcattatttgcgccgcaggcacggacatttgcattgccaagcataatcaacatttgtaccaaacaatttacaggtaatttgaaaatattaagctttccaagaatacagcatatttttaaaaacaaaattaaaatttctggtgacaacttgtttcagaaaaaaaagatgtcctttcactagagatttctgttaaatttaaaaaattttaagtagaattttaaagagaatcattcatttcccatttttttcttaattttctgtttattagtaaaaaaaattgggtcgctttacaaaaaagttatggccaaaaaagctcaaaaaattgattttacttggctttttggcgccgcatgtcataactttttttagtcttgtaagtcatcaaagaaaaaagttatggtttcctaaaagcggaaaccgaattgccccccaccgataaacccccccggctacttggtagtcggacatcgctctcaagtccgcaacaaatgtagcgttcgagtgttgttgagtattggcaatgtctgtttataccgcatccctttttcaaatatgtattattatatgtgattattttattaaaaatacaatttaaacattaaaaaatactattataaatataatatgtctcggacctgaatgccatcgttaattggtgccgacggagagcaatatctgtagggtgtagcgccttcgccaggcaccggcacaagttgtggaggacaatctaagttaattttttcctnaatatttactgaaaatgaaataatttcataatgaaaatgaat

SEQ ID NO: 26044 - DNA, 1058 bp, Heterodera glycines
attttttctccatcctttgccccttcattaattaattaatgctatcgatcggtttcactgatcaatcagagtttatctcctcccattaatttgtgtgtgcgcttttgtttttataatatgaactgactgcaacaataagcccataactttcagagcagagcaaaaagagtgagtcagtcctcttcacccctctctttttattatattttgtttcttttcttctgattaccaattaatatatgtacacacacaaagtgagaatggccgtcgtcttcgtctttcaccgttcaccgcccttttctcacccactcgtgacgtacatacgttttgatctgctgctgctgctgtgtgagagatagagtcgggtgaagaagtgacgagagagtgtggggagggaggaaagcggaaaaggccgagatcggatgacgagaatcggagagaatgatagtggtggtggtggtggttggtggacgacggagaggggaccgagagggcatggcgagaggatgggggagataaacacacaacatagataaagtggagaatgagtgatgatggtttagggagagggttgaatagtggaatgaatttgctcctctgccgtttggttgtcccccctatcacatcactcctatcactatcactatcaccatgcccttctttctttcccttttttctctcttataccctcgtaacacaagaacctcaacccactgttttcatctttgttttgttattgttgtgttatgttgtgtgtatctcatcatcactctatcacactcatgggcttacttaaatcactgccgctctctctctctcctcctcctctctctctctcattctcgagaggatagggctcctcttcttcccgttcctccccaccagcgtttcccccccctcaatttcgtttagatcagcaaaaaagtggcaaaggggttggagcaatgaatggagcggggtgcgggtgggggggggccggagaggtggcgacgaccacgagaccaaaccatccccccacaacgaaacgctacgtacattaaatataaatagccccatgc

SEQ ID NO: 26045 - DNA, 971 bp, Heterodera glycines
gcgaaaaagcaggcattttaagtggtgatatgccaaaaaatgaacatattatccatttgggggcaaattttcaaatttaataatggaataattagtgctggctgggccagtgggcgccgccgggaattttttcttgaaattttaatttttctatttccgctgagagggcaattcctccccaggcattcagtgatctttttgacaataaataacaaattttcatttttcctaatttttagaatgtagaggagaagcagccgttgaatttcgaatgttgtgctgttgctgcttatttattggtccgtcgtttttgcttgtaaatttttaaatattctacacagaattaattagtgtgtgcatagttatattttcttacggcacaattatacaaattattaggagctttggcgaagtaacggcatcggtcctccgaaacgcggctttgtcgacttggagtgtggcaaaggcattttggcacacattttgcaaacggagggagtgccgggcgttggcatccatcaaagagaaaagccgcaatgggccgctttcaaagtgtgttgaccgagcatgacgattgaatttaaaattggctcattaatgtaattagtggatgttacgagttggaatctctttttaattgcccgtttcatcattacattcatcgcatagggcaaaggcacgcgactgctcgaaatgccgttgattcgcgacatttccatggccgaccgaatccgaagtgttgtccacgacggagcggattttttaattggcaaccgaagcgaccaaattattccgtggataccattaattgcggcaaagtaaaaatggaacaacaaaattctgtttttaaattccttaccgaggagggtggccaattatggggcaccccaaaacgtcgctggccgaaacgtcgccggaagactttttgggccataactttgttcattgtaaatcaaattaagcattcttgg

SEQ ID NO: 26046 - DNA, 1684 bp, Heterodera glycines
cgagccaaaccaaagccaaccgaaacaattagacattctttacgaagtgctaaagggacaaagttaagacacaaaaaacgacaaatttaaaatgagctaagaaaagatgaatgaagctaaaaatacatttttattccttaaaacaaaacgccaaatttaattttttcaaaatttaaattcaaaataataacgtttgacgcaggaaagcggaaaaccaaaccatttgaaagagtaaacattttataatatgctaatgtaagtatttttcaatttttgttggtaaaaatgaaataggtagtgcaactaattatgacctgggacaataatcaaagactattttttggacttttaggctagagtagtcctcccctcccatttacgctgcaattcatacttttcgttcgttcgtttcggtgcctttggtggattgttcgtcagataaatgtccattgggtctgtcgggtcgtaatcgttgtaatagtaattgctttcccatttgtccgaacttctcctcctttgttcaaaaagttacaatcaactgttttatgatatgctcaattaaaattatcggttccattttcttattttccgtgatggaaaggcgtacgatttgttcgtggtaattgttgaccctttgtccacgcctatgccaatgccgagggcacttcgaagcgttgagaaacgcaacgatccgctgactctgtttccggtgttcatgttctgatacgtcaaacttttgacgtccaacaagtcgtgctgagtgtcataactaaacgaatgaaaaaggctaatcaaaacagtcatttattggagggaaatcaaatgaaaaattaaagtgataccaggaaatttgaaggaaaacacgacaattgatcaattcattagttgctgtttttgtgtgtttactcacgtcgtaattgtattcgtttggctgagtggcctcgaatagacaccgctgcgtctgttgcctccgttcctcaaattgacgcgtgaattttgcgaaagaacgtccgcttcctcttcaatggtttccaaattcaatggtttgaagaaggccgaacgcaactcacacattgaggtaagtctaatttctttttatctaaacggcaaaaaatgcatcacaaaaaatgcatgaaatcagttcatccaagttgtaatccaaactaaaaaataatgcaacacaaagtgtaaataaaggaaaaaataaataaattctcaattatttcattgagtcgtgcgaaatggcaagaaaaagagaaaaaattcagaaatttgttgagctcattaaattactggggatgcaatttttaggcgctaaaaactgccaaaataggtaggctttaggctctaaaaaaccccaaaaataggcactaaaaaatggaaaataggctctaaaaacctcatttttagggggtgtaaaatgacaaattcattcaaaaaggtaaaaaaataagtcaaatcagtattgagttacatattttttaaattcaaaaatttgtccaaaaaaaaaaaatttaaagacgatttgagaaaatttttcatttcctaggaggtttattttcagaaatttttgggtcgatttggggtgtatttttaaaattcccaaaaaatcgattcttaggggtgtatttttcgtttttattgcttttttgttaacaaattttcggcaaaacgccaaaatagg

SEQ ID NO: 26047 - DNA, 1655 bp, Heterodera glycines
agcgcgcgcatcggctggcggcgcgacaaccgcaccttagcaaaggcgcgcgaaaagggaggggtcgaagaaaggctcggacacttcgccgacaacggacggacaaagggccgactcagcggagaaaaaagcattttcacgggacaattggcaacgaaaggcggcgaaatttggggtggcatttatctgatggaaagagaaatggcatttataaattaattgggagaaaataaatgaaagagtcccaacttttgaacaattccctttccgacagacgaaaatgaaaatggtgcgatggaatgcgtgggagggttcgtcgggacaataaacttgcagcagaaatgccatcggagagccgcaaacccaaaaaggaaagggggaggttagatatattttgggcaaataattcacttggcatgccaattctgcactttgcggaatggtggcggggttaagccacgcggggtgaccgccgcatttgcccagggggaggaaatggcgttccaaagagaaaagttgggacgcatcgaccggacggggaaggcccaaatggacaacggaagacggagaaacagcggacattcgaaaagggaaaagacagcgaattaaaataagtttacaaaaaataattaacaaaagaaatcaaatgaaatcagcagaaaagtgccaacaatttgttaatttgttgctttttattttcgtaaaaaataaatgtacaaaaagcaaaaaaaaacaatggaacgaacacacacattaattaattgatcaattaggagggcactcttttggcgcttctctctttgccgcgttcggtggtgcctttccctcactttttgatcacttggacaacgtcttcgtcgttcagcaaatgggttttgcccacactttgcggattgtgttttacgctgcttccccagacgagggcacttaagcgaacaattccttccgatttttcacaaaatcaaaaaaaaatttaccatttgaagtcctttgacagacttttgtgaattttcataccttaattagcaaattcatttaataatatgtatttaaataaattaaacgttacataaatcgtcgagaaagtttttttctgcgtttaaaatgatcggtgcgttataatccggcaattggccctttggctttgtataacttaaattattaactgataaatcaaaaagtcagaagggggtccctcgctcacactctgatcagattcaaataggcccaaatcttttccaacaaatcgtcaaagttccatttgtgatgtgccgagattggcacacaatgcggcacagtgtaaagaatgtccaactcttcgacgctaatttggtcgattttgttcagcacgtaaatgcagggaatgtaaattctgtgagcaaatccatccattaaaaatgcacaatgacgaatctcttcttttaccgattcccctcaatcacatcgatcaaatcctccgtggtcgcgtcgtatttcagcgtaatgtccgcgttgtgaatgcgatattcgctgagaatggttttcacagtgtccgtgtccaactccgattggggcacctttgaattggaaatgccaataaattgacggctgtgtgtgtccccccccaccaaagtggtcaaattcagtccgcctttgtctttccgtttgaacgaaat

SEQ ID NO: 26048 - DNA, 1309 bp, Heterodera glycines
gacccaacagttcgtacccgaaccgaattcagggtttttttcacccgaaaataggcgggcccgacttttgtcttttgcccaattccgttttacattctgtgcggagttcgagtagcagatggacttcttcgacattttaattcctttggacaattttaatattaaactcattaattttaacaattactgaaacgataatttaccgttttagcgtctcatcgactttttaattagttgtttaattgctcccaatttattcctgaaaaacaactcatgtcgagaagtttggtggatcggatgaaagtgttgttgagcacagccaaaggggcggacattcactttttggttggggagggagaggaaaaggaggcgagttggcccaacaaaatttgacaaaactcctaaatctaagtaataattatttatatttatttaaaaacattttccccccttttccaattccggtttgattttttctatgcttttcaaagcgcacaaatgcattatggtgaatgcttcggatgtgttcgagtcgatgttccgttttaatggcgaaaacgcaaagaaaaaaagtaaaaaaaaaaaaaattggaaaatcctttcaaaataaaaaaaaattaacgagcatctcaacacttttggcacattgttcggctgagcagtgaaaagccatttggccaatgtttgtccatccgacgccatggcactatcatccgtcggaaattcagtgaagatatcgccggcatataaacagacaaagcgaagtgatggacattcgcagaaacggcggaaataatccgtaaacgcaatgccataaatgttttttgcaataattggccaaaggttgtgcataatcaactccaaaatgcggtcattgttcgtgtggattaccaaattaatcggaaaggcggcgaaaagtggacgaaaacgtcggagaaaagtgatgacaattcggtcaatataactaaaaatgaatagaaaggactgattgaatttatttatagtcagtcgtcaattttacgatataatgatgcatttgaatccgatgactttgcgtggcaattgaatttgcggaattggcaatcgtttccaatagttattggcaatttccattttgttggtgccattttctccaatgttgggccaaattcgaataaattccaatgtccatttgcgcgtcttgaagtttatatccatatttttgacatccctactaatgattgtgacttagatttaaatggattaaaagctagagtttaagacaggagaggcaaaactaactaaataataacaattggtcacctattta

SEQ ID NO: 26049 - DNA, 1510 bp, Heterodera glycines
caaaagcctcatttggcaagcaaaaaagcctcattttgggttaaaaagcctcattttcacaaatttattcaaaacacatttaaaatgttcaaatgtgatattttctattgtccatgatcaattgcaattttttcttagaactaagcattttatgaaattctgagcatgaaaaatcgacgttgatttttgcggcgctttttccaattttttggggaacaggggggtccggcggtgccgataagcaccgccgggaaaatttttgtaatttttaatgtgatttgttaacagaatttgcccacaaaaatggcttaattttgcaattttaagcaaaaattttaagaaaataaaggatttttgggtccggcggtgccgacaggcgccgccggggaaaaaagtgagaattttgactatatttttggactttttgtgcttattgtgactatttttaggattttaaaaataatccttaacaaaaatgcagtaaaaaaaagaagttttgagttcaactttctcttccactactccgacgagtacttcgaccaccaccaataaattgtcctctacgcctcccgcggaaatcaaaaataaattgcaatgtttggcatggaatatttgcaatttgttagtttatttctaatttgaaagttaaaatttatcattttcaaggagcacgaaattgaagcagtcaaaggtttcgcgacggtttttaattggtcaaaactgcgaggaaatggccaaagactggggacagattgaagaagatgaaaaaatcggagatgaatacgaccaaagtgccgacgacaatggccaagtgtttttgacggattttttcgttgggcgaattaatgcaaagatttaattgattttctaacaaaaattcaatttgatttagtttaattgaaagtagagtgccacgggaccgggaccgggccgggaattcccggtcatccgaggtcccggttcccggtcccgggttttgaaaagctcaggtcccggtcccggtagggcaaccgggaaaaacaagcactggtaagaatgggggtctgacaaaggaggggtcggcaagtgaccgtgggatttccaaatgaaatttggtgggtggattcgcaccaggttcgaatccgctatatgcaattttttttttaaatttttatttttgctttttattttggtacatatgataataaaaaatatttttaattttactttcattttgatatgtacataagataataaaatatttaaaaaatacgacaggatatttattgcacctttatgtttaatgtagtaattttttgatttctaatggaaaaaaatttaaaataaaaaatatgtttttactaaaaatttttagatagttaactttgcatgaaaatcaaaaataaaaattataaaataatatatacatgcatgggattcgaacctgtgacataaaaaacatttgactaacctactacctctacaccaatggcttctttcttggccaaaaagaattatatcttttctaatt

SEQ ID NO: 26050 - DNA, 1034 bp, Heterodera glycines
aaatttgacatccataaaactccattttttctacgttagcgtgtttaaagcaaacccgaaactgataggaaatttaaattgatcataatagaagtttaatttttatttgtcccatgcattttctgggaaatcttttcgtgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagtttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattcagaaaacgtgttttttttactgacaatttttttcaagagaaggatatgaacaatcacttataaggctcatgcttggagataaaggaatcgggaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagttccaaaatttgacatccataaaactccattttttcataggccagcgtgttaaagcaaacccgaaactgataggaaatttaaattgatcataatagaa

SEQ ID NO: 26051 - DNA, 1763 bp, Heterodera glycines
  misc_feature (150)..(150): n is a, c, g, or t
  misc_feature (227)..(227): n is a, c, g, or t
cagagaaaaaaataattgagtttcagttaaagaaaaaaatattttcttttaaacaatacttaaggggtgtgcattcacgggtgtccgagatgtttttaccttggactatagcgccaaacggacggacaatggaagagaatcaaagtaganccgaaattcgcatggaaattttgagggaaaagtgcaaaattttttcatcgggagaagtttgggtagaataaaacatntagaaatatttattaattgttagttttaggagtgtgatgtcagagaggaattgaagaaaaataaggagatgaaaaagttctttgaaagtgtgccggacaagggaccgatcaatccgagggatgcttatgctgggggaagaacgatgccattttgtttgtacgcaaaggctaccgaagaaattgagatatcaatgttcgacatcattagtttgtacccctttgttaattatggtaaaaatctgcttaatttttgttagtttcctttcgcttcagacaccccataccccgttggagtccctaaaattgtagtgagcaggaattttaatgtgaattggacagcacccgacgacgtaccctatgatggacttttgaaagtaaaagtgatcccaccgaaaaatcttttgtaccccctcctccccgtgcacatcgatgaaatgctcctcttccctaattgttggtcttgtgcgagaagggccaagaatgaatttgtgatgacaaaagatgtgaaaaaatgtaaccatcgtcccacgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagatttggtttaatcccggactaagaatgattgcaaaattggtgagaaattataaaaaatctttaaaaaatgttcgaatttaagggattaaacagtttgtggggaaaattttcgatgcgcaacaccctttcaagtacggaaattgtgggcagcatggaacgttggatggaattagggagagacaatacaattgagtttgggcgcccagtaaaaataagcgaagagatatcaagagtcgtgtaccggaaaaaggaggagttcatcagggagcataaagtgtcgaatattgttttgtcattgtgaaccacgagtgctgcgaggctaaagctggacgagtacatggagccggtccaccagatggcatggggtcaactggattttagcttaattatggccaactttcccagggggtcctcggaaaaatcatctaaacaatcgggaaacatttgaaaaaacaaccgataaggctgaaatttctcacagacctttgacctcatcattgactagaataggcaagaatactggcattcatcagcatcgagtcgagcacaaagaaaggcacttggaaagcgccgaaattgtcagtactacccaccgccaattagtgtgacgacaagtgaatccgaaaatcgcgacggtttccttaaagccataagaaagggattaatttgcttttaatgcactcgaaatcactcacctcaataacggatattcgtctttgaaatgacttgtgagcttattgccaacgac

SEQ ID NO: 26052 - DNA, 1116 bp, Heterodera glycines
tccagaaaaaatcactttcttttttttggaatattttacgtgtcaaagggtgtgcattaagcgactcgctgtgcttgcccactgcatttcaaatagctggtatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatatttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatcccagaaaaaatcactatctctttttttggaatatgttacgtgtcaaaaggtgtgcatttaagcgactcgctgtgcttgcccactgcatttcaatagctggtaatatttatttctccg

SEQ ID NO: 26053 - DNA, 1039 bp, Heterodera glycines
ccagcacctcttggaacttcccgggaaaaattcgggttggaggcatcggagtcggggataagccacaaaaaatggccaaaaatgtcggggacgaagtccctttccaagcttgaacatgtctcatattctccgcccacatatataaaaccgaaatttgtttgtccgaccatttaagccgctggcgctgctgctcctccccccaatgtgtctcaatgcgaaaggcaacgccgacggcggcggcgctcgccgacgacgaggacgaggagagcattgagtcgcgcgtcgccaaagtcgtcgctgtgcccccggcagtgcctgcggtggccgtggccgccccgctgtccctctcccgtctttgctgttgttggctttggcatcggcgtttgccatttgtcgccgttcccatgggcatttcctttgcatgtgccatcataatgttgtccatcagctgcagttgttgccgcggcggtgacacttcgccacaccaatcgaacgaatcgcagacgcgcacggacactttctgccggggggggggggaatttaagagttaatcattgcatttcgaactcatagaatagactcgaaatttttaaaattaattggaggtaaatgaaatttgcactggtgacaaaacgtgcaaaaaaatgagaaaattaaaaataaataaagaccgaaaaatataaaacctatgagaaaaaatgagattttgcagcacaaaaagacatttaaataagggtggattccattcccggccccgccatttccccacgaaatttaaatttctaagttttataaaaaaaaatttatgaaaatttcaaaataatttttttgaaaaaaacgtgttgttagaattcattaaattttggaaagatcgccagaaaatttcgcattattttttctttaaattttcttataaaaaaattcgaagattttttataattttagaacggaagagatatggaaggtgggacctgatccgtttaaataatgcaaaaaagcaataaattgaaaaatgaacgatttcaaacattgtaatgca

SEQ ID NO: 26054 - DNA, 1615 bp, Heterodera glycines
  misc_feature (496)..(496): n is a, c, g, or t
tttaatacaaaaaagaaaacaaaaaaaagaaaaaagaatgactcaaagggagggaaaaagcattgaaaagcattccatcccattctttgcacattcctccgaaagaaatttacaaaagtttgtgccaccggtgctgtccgtattgtgtccactgctcggctcgaccacttcacatttcaggctttgcactgcgtctgcaccacggaattccgatttccgaagagatagaaaaagtcggaattggattttttagggctattgtttgtttcgtttggttctcttttctctgttcctttcctttgatctgtccttcccaaatgaacactttcttccacatactaaatatttatattcttcgtaaatatcaaaatttgcggatatttagtccaattaagtgaattatcaggttggaacatggcctggaaaagtatgaaattgatgagcaaaatgaatagaaaaaggacataaaaagggggggggggtgggaaatgatcangaggagggaacgacctgatcagaatagaaaagtgaagcaaatgaaaggcagtaacgaagaaaatagatcgatcggtgaggaaaaaagagacccagcgattggatgggtttgggtgccgtactgcttcaactgctcgtgctgtgttctctctccgttttctttccttctttttctgttcagtcatcgtcgttcagctccattgcccgaatattcctgaacattcctcaattagtattaatctgtcccggtggattgatcagaatgcaattggcgcatttccccgatcgatccgttttggctgatcacctctctgtacgtgcgtcggtatttctcctccactttttccgattcggctgctgccccctcgcgcccctccacgttggagagggaagtgctgaagcgtcgcattctgtccaatgtatggcccattggctcgtgcacaatttcgatcagatcgtccggccattggtgcgtcaccgctgcaccagacgcagcggaagtgccgacgacaccggcagcactttctgagggaggggcaaaataaaaacggaaggggagggggggggggtaagcgtaagagggaaaggaaagaagcggaggaaaagcaaaaaaaaaaaagggggggggaaagcaaagcgcaatgagaaaaaccaaacaagaccatcacacaacacaaaaacggggaatgtcggtcgtttctgtgcctcttttcagcttcagctgataatgcgtccgatcagtgccggtgatcagtgagtgacgagtgaaagggaatggcaaatgatcagagagaagagaatggacgatggatttgttggattgaaataatcactttgtgaatagcaaacgaatgggtgggtcaaaagcatgtgaaaagcgttccaactcatttgcgcgtgtgttagtgcctttccgtgccgccgccgtgctgcgtttggcaccgccacctccgcgtgtccgtgacgcttttgtccgtaccatattcgtagttcctcgtgccccccattccgccgattggatgcggctgataggtcgaagtcgcgcccgcgggcgatctgctcgccaacgagtccaactcgcgctgcagttcctggagtgcgtcccgtcgcgagtgcgtgc

SEQ ID NO: 26055 - DNA, 1192 bp, Heterodera glycines
ttagaggtatagagttgggggccattatataccccccacacacacacttagcgcactgacgcgcttcccgttgttagaaaaaaggacaaaagaatttacccacaaggacccctctctctctctttctctctctcacaaacactctcttgttttagacgaggaaaaatttccaagtccaaaaaacacacacagtgtgtcttctctctctctctcactctctcgtttgttgttgtcttcttcagctgtctgcatccatctcttctcgctctctctctctctctctttctctcactctctctgtttctctacccccattggtttgatgatacgtcgtcgtcgtcgtcgtcgtcgtcggcactgggtccctcaggggaggaaacgtggaagggactacccacccgtgactcacccaccctccgccggaaatccaggctttccaggtgaaagtgagcactggaagtgaaaattcctcactttatataggcaatttcagcaatttgagcaatttcagcaatttgagcaatttgagtaatttcagcaatttgagcaatttgagtaatttcagcaatttgagcaatttgagtaatttcagcaatttaagtaatttcagcaatttgagtaatttcagcaatttaagtattttaagtaaaaatttaagtatttaagtaaaaaaatacttaaaatacttacattttacttaaaatacttaaattttacttaaaatacttaaattgcctatataagtaagtgattttgttcagtctcttcagttagtcacttacagcaggaaagcgcggagatctggcggaaatcaagagacacacactttctttcagattttgacagccttttctccaatttgaatttggcattggcacacacggctgtgggtaccactctcggtggtgtttggctttgtcgggttttgattgagagtttctggagttttcggttcatctcttctccgttttattttcattctaaattgaaaattaaggcagactcatcaatcaacctgtctctatctatctatctctctttgtctttcccagcgatgggctctctgacccgtcgtcttgtttttctcattttgtactgatccatccatgagcattttgagcaattgagtaatttaagcaatatgagcattagaaatattgaagcgaatatgagtagttttggcccatttatc

SEQ ID NO: 26056 - DNA, 975 bp, Heterodera glycines
gggatagggtataaatttaaaaattccccccaaaaataaaaggtctattgcgcacccccctccctatcatgctggagagcatttgtatgtgtataaaattatcaaaaaaaagagatagccattttttctgggataacctctaaatataaaaatcctctgtgaaataaaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtgagtgtataaaatttctcaaaaaaagagatagccatttttctgggatagagtatatcaataaaaattccctgcaaatacatacaaggtatattgtgcaccaccctcactatccatgctcgagagcatt

SEQ ID NO: 26057 - DNA, 1742 bp, Heterodera glycines
aaaataggcactaaaaaatggaaaataggctctaaaaaatcctcatttttaggggtgtaaaatgacaaaattcattcaaaaaggtaaaaaaatatattttttaaattcaaaaatttgtccaaaaaaaaaaattttaaagacgatttttgagaaaaattttttcgattcgtagggggtgtatttttcgtttttattgcatttttgttaacaaattttcggcaaaacgacaaaataggcaaaaatagactctttcaaaaattttttaggctttaaaaataaagcctagaaaataggcactaataactcgaaaagtagctaaacaacagcccaaaaaaacatgtttttcgtgcgtttcaggccacggggagctcaggaaaaaataggctaaaacctaaaaattgcatccctattaataataattagagaccgacttttgaggcatatgaaaagcaactttttaatattaaaaaatttttgataaaataaggaattttctgaaattttctttgggtggcggcttgaatatacggcatggaattcatatcaaattttaaaattacccgtcgaaaaatcgcactttccgtcctttggacacacaaaaaatttctgcagtgaaattgtacgccgaaaaaactgtttacaagctaaaagatagatttaacatcttcttttataaaataatattttaaatatttcagcaataaaaatttcatattatctttttataatttaagcgcttttttttgatttattttcaattttattaccttcacaactgagcacattgtaatatttaaaggtgcaaactccgccacaaacggtacatattctgttttttgttgcttttattgtgttcaacaacattttcttcttgaaacatcgttggaatttaatggaatagaaatattaatagagaaaataaaaataaaaaattgcaaaaattaaataatttatgtatgcattacctaactaattggattaagtaaatgaaaaagaattcagtgaaaagaaaaatttatacataaaatggtttctttgattattttttccaaattgggagtttatggtgacccattactcgtcacttttcatttcgtcaccgagaaatttactgtgtttaatgaaaatttttcttacccaaaatttgtagacttaataataattattagagtaaatccgattttttaaattttctgaaagcaaatgttttataataaaaagcatcaaataaattattttttcaaaaataaccaaataataaaatatataaaaatcaacataattacccaaacaaaaaaaaaaaaaagaagaaatttttgaactttccaaatctaataagcatgtgcgcaaacaaatgtgaagcctaaatagatttaatggccaacactgaaaaaatgaaaaagccacgaaaatagagaagaaaaaaaggccaaatgagtcccaaagatggcactgagttgccaaagctcactcgaaacaaacagaagagccgattaaatgctcacaaaggaagttccccaggtccccatggggatttccgaatgaaacgtggtgggtggataaagcacccatgggttcttaagaaaaatgtttttattttctgccaaataagcacgagtgccattatgacatgccagagttttttaatgaacaacaaattaataattttatttgcacctttacagtgtacaatggtgtagctgcagtgcgctagttagcgttttatgaacagcaggttcgga

SEQ ID NO: 26058 - DNA, 1809 bp, Heterodera glycines
  misc_feature (9)..(9): n is a, c, g, or t
  misc_feature (20)..(20): n is a, c, g, or t
  misc_feature (26)..(26): n is a, c, g, or t
  misc_feature (33)..(33): n is a, c, g, or t
gttgtgccncatttttgtcncaatcncaacggnataatttgtgccaatggctccaaattcggcggcttggaagaagaagcattgccaatgtccttgattttcaatgggtagtcaagactgtttgccgccgcaaccgcaaattgactaaatttgtaagcgattagcgatttaaaaaatgattttgactgattttattgcgttcaaaatttaggttaaattttttatgaaaaacataaactatctttaatgggctgggatttttagtttttagttatttttttcttcaaattgcattttatgataagcacacgaataacatattttctcccccccccaattaattagagcaacttataaatactaaaaatacctaatggggacttggcacctgaaaacccaactaattcagtcgtttagcacctattttcacagtttttgaaaaaaaatattgaagcaaaatgcaataaactcaaatcaaattttactcggcggtgccgatccaaaatacctatttttggcaccactttttcagcacttatttaggtatgctaattttgttatttaagcgcacctaaaaatcccagccataattttttatattttaaattaaaaaaatgaaattacagtgcagcaaattgggtcacatcacggaatttacagtttccactaaattcattgatcgctttttcgtcaacaacaataaattcgtcaaagatttccattgattatgtgcttttaattaaaaaaaatattttattaaaaaactttggcaataaaaaacaaaacaaattttcaaagaaaaagttttaataattaaaaatgtggaaaacattttaaaaagatgcaaatgcaattccatgatcaatatttttaaggtcagagaaacgttgtttattcaaatgatttgtttacatgtgaaaagaataaaagacatgaaggaaaatagaaaaacaaaaagcgttattttcttaattaactcataactaaacaattgccaagtttattcatgccatcactaattgatttcataatggaaaaacgcgtgactaattgaccccgctaattgaccccgctaattgaccacggcaataagctttgtatcgccagtcactcatcaaagctaaaatgggcataaaatttgagaaaattaccaataattcaaagtttgagcaaaaatgacaataaataactaaggcgggaaatatatggaaatccattttttccctagactgtggagggcctgaaacgcacgaaaaacatgtttttagcttgggttgaagctcctaggaaggaacaattaagaaatttatgtcaaaaataagcaaaaaagctaaaatttcgcttttcgatttgatttttcgctaaaaattcaaattttagctttatcgtctttttgttcttctaaaatgatttttaataccgtatttagccatttttgaaggttttactttatattcaacaaatttaaagaaattttgggaaagtatagtcaattttgaaaaatttatttcaatatttgccatttatgtccttattttggctggtttttgggccatattttatggccatattttgcgattttatgtccaaatatttttccccgccctaataataactccatttttaaataaataattttaacccaaaagaggaaaaataatacaaactctcattgaaaataagaaaaatataaaaaacacacattttatgatatgccaaagaaatcagttgatcaagccgaacccatcagcagagtttacatttaaaaaatgcaaggtgtttaccgaaataattgaaaatgcctaatat

SEQ ID NO: 26059 - DNA, 2245 bp, Heterodera glycines
ttttctttgcgaaaattcaaattttgccttaaaagtgaaaaaagtcataaaaagggtcaaaaaattcaaattttatcaaaaaatcgccaaaatatgtgacaaaagctgccgaaaccccaaaatttttgagcttttcatgcgatagcatatgcgcaaaaaaaatatgtaaaaacatataaatccgttcactgtttataaataaaccatgtttaaactaaaacgaaatacacttttatattttgataagggagataattatttaatataattgaattagttgtaattacaaaatctttttcctcagaattaatttaaaaatactatatttcttgtatgtaccgcatggttaaaaattacaacattgaatgaaaatacactttttatctagttcctacgtttttctgttatatagaccatgagatcaacgaaagactcgcactacacccattttgccaatcaagggcttaaaaagattcaaaaataaaataagatttaaacgctttcttaaaaatgtaaaaaatcattcaaagacaaatattattttttattcaaaatattaaaatcaactcaataataaaaaagatacaacataagataaaataactataatacttgtactaataaattattgtggtgaaatctttaaataaaaaagattactctatctaaaaagtcaatgcattttaaattaaagataaattagctaatttaaaacaagatgctatagagaaaaaaagaatgaaataattaaattattaatcggtaatccattatttaaaacaaaacaaaggaccatgactttctacgtacttctgattttggaaaacaaagtgatcaacacgttgggttgcaatttgctcaggtttagtgccccatgtaaactctcaaaaaaagttatttattcaattaaaatagataaaatgaataatattttaattttagatttaataaaaatcagcaaaataataatcaaaataattaatgatgttgttgtattcagaaaattatgaaatcaatgagtcacagaaacatacaattaaattaattgattaaaggaatatatatatttgtacagatactaatataaaaataataattgaaaccaaatcggacttgatattaacctaatcaatccgaagttaattttgagtgccgctattgcacgtcccggggtccgcagactaaaggaaataaaagcaaccgatttgaagactcaaattcacaaatatttctagtcaaataagaccacacaaattccttggataaaaaaggtctaggaaattcctttattccatcaaaaggcaactgcaaccgagtgaatgactgaacaacaaaaaacatagaaaaaatagaacattaatagtccgtcggtcataagaaaacggagatacaatttagagataattacagagagagagagatagagagtgaaagaagtagagagaagaaatataaatgtgcaaagaatttactggaaaatgatcgagaacaaaatgtatttaataatttatatttgagtgactgtttattaataatttaaaaaatatataaaaagctttgctaaaaatattgacaattaattacaagatgaatacaaattatatcaaaaaaatattataataaatctaaagaataattatcaagggtgaacaagcaataaattttgtcggtcaatataattgataatttttaaaacgcaaaaaaaacaacacaataaaacctgatatggattttttggtaaactattagtgaatatataataacaagtgagatgtcaaattgacaaataaatgttaatttactaataaaaataagtaatttaattttttaattatgtctacaaaaaagaaattaatattataaagagagtagtcaaaaataaactaacgataataaaatgcaaaaaataaataataatttgtataattggtaaaatttataaaatatattatgaatttttgaatgtataaattagattaaaaatacccttatgggtagatcacaaagtaccaaaaattcgtggagcaaccaaatgcatcccaatcaatatcagcaattctcggcttgactaatataaagtcgctattttttatgctctttaggccattcccaaataaaagaaaaatatgtgtaagtgtaaataagaaaattaaataatctcataaaattataaatcaatgcaaaaaatcaactttgtgtttgatcaaagtttcaccgaaaaataaacaattatgcaggaataagg

SEQ ID NO: 26060 - DNA, 2276 bp, Heterodera glycines
agacagagacagttaaattcaaggaaaatatacaaaatcattagtcaaataaaattcattttatatgtttttaactaattttaaattttatctgaaataaatgtatataaagttttgtaatgtatttgatctatttcaataatataataattttattaaagaaactattcacaaaaaatacttaaaatatattacagcataaagaaagcataattattaaacaataaaaaaagtgaaggtaatacattaaacagaaatcattattttaaaaataaggttagttaatacaatataaagtgaacatttagattaataaaccaattaataaacaaaataacatgaataattataatctaacctatttgaaatgtattattattttctataatttagcttgaaaaattgcatagcttattcgtagactatccttcttataaaccttttttgggcgtttatgtgccgtaccgcctcttttagtaatttaagaccttttcaaaaaaaactaaatttgatttttttttttttttgctaaaatttatttggaagttcatatattaatataacatcaggaaattattattgataattattcttgcaaatttcgaatatagctaataatatctgaaaattaaaaaaaaataagcattgcaattctatacgaaaatgataattgaataattaatattaattattctcattgcaaacgtttttaaactttaatctaaaatagcaattttcatattttcgtaataaatatgtaattaatgtttgctttaataactgaaaagataaagtagccaaaaccaacataagtttctttgcaccatgaagcataaaaaaattaataaagataattaccgttgttgattcaagccaaaactaaaggttttacttaattatatttggcagtttattaatttcataaaatatggaaataacaatatggcacaatggtgtagtagcagaaaaaaaaattagaaaaacaatttaaaaatcaattcaaagcattaaaattagaggaaaaatactaataacaaaagaaaaataatattaaacaattaaaagatcgtgctaaaaaacatctaagagtaaaataatcattgtttttaatctattaaaaactttctaaaatatggtattataaactcattattaaaataaaagcgaaagaaatttattaaataattatcaaacaatgtaaaaagcattaataaagagtgaaatatttaatttaaagaaaaattatgcaacaaaagttgaggactttttttctttttatttatttatttttatcttttatcatttgtttttaattaaattaaatactactacatatttaacattaaaattctaatgcactatacaaattttaattctaattgtagattttttaattactatattgttttgttttattaaattttttgaaagaaaaacagaaatttttttgaaaacaaaagattatgtatgaaagtagaaaaagagaaaggaagtgagaaagagagagattgagggaggagagagagaaagagagtgtgtgtgtgagaaagagagagtgtgtgagagagagagagagaacgagagagggaggggagagagagaaagagagtgtgtgtgtgagaaagagagagtgtgtgtgagagagagagagagagcgagagagggaggggagagagagaaagagagtgtgtgtgtgagaaagagagagtgtgtgagagagagagagagagagagagagagaacgagagagggaggggagagagagaaagagagtgtgtgtgagagagagagagagagagtgtatgagagagagagagaggagagagagagagaaagagagagggagggagagaattaataaaaaaaaaagataaattgatacagaaagaaaagaaaaacaaatagatgtgtgttacgaacacagagaaagaaggaactatagaatttaaaggacatgagagagagaggagaggagagaggaaaagagagagagaaaagaggcagaaagagaaaagtttttcaattcttaaggtttattttctgaacaattttcaggtcatttattaggggtgtattttccgattttattgcattttttgtggttcttgaaaaaacgccaaaaaggcagcaaaaaggaaaaatgccaaaaaaggcatttaaggcacgaaaatcccgtaaaaggcaaaaaaaggtataataaaagtcaatgtaggagcctcaaaccaagttgaaaatgcattatttatgcttaatataaagaaaatagtgcgcagaaa

SEQ ID NO: 26061 - DNA, 2253 bp, Heterodera glycines
ttttaagtgatcggaaacgaatctttttttttggaatttttcacataaatcattttttattggaaaagcattcattcatttctttttctgtgtgcggcaatgacattgaccaaattcgctgatatttttttgttttaatatccatttttctttccacatcactcctcccaatctcttcagcacttttgcagcaatttgcgggaaaaattggcggaaggaattgaaagaataaattgggggggggggaaaggtgaccttgggggatagggaggaataaatggtgatgatgaatatgacgagaatggcgaacttttggtggtgtggaaaaggcggaatttgaatgcaaattgagacgacgacggcacagaggtcaccgatgagaattttagcaaattggcataggggacggaccaaatttcagaaatctttcaaagtctatgattccatccctggttggcatgagggaagtgagggagggttgatccccaaattttgcatttttgccaaaagcctctgaattgccacattgattacctgaataagcggagtaagcggtcactgccggcttcggcggcaacaaaataaacagacaaaggaaaagcattgagaggaaaaaggatgaagcagttgctgccgaagttcgatgttgatgaaaaccagcagtaatagatggaaaaagccatgagaaaatggcacaaatttgcacagtgattaagccgccttcatccacgctcgacttccattgttggcatttgccgagccttcgtaacggaaggggccaattaggctcatggtgccgccaccgttgttcaatttgccgccgctgtcctgccactgttttctgctgctcctgcttccttccactggtgattagcatcgtttgcgcttcttccgctggctggtgccccactttcgctgccaccgctttttgggccattcgccgccgcgacctttgcgcgtcgttgttgtgcccgctcaaagtgttgctaatttgttgcccgtttttttcggttgcgccgctggcagtagcgtccgttgtcccaacagaagcacaacaaaaactcatcgccatactcaaaatgagctgccacaccaaacaaaacgcagcagtgggcgagagattgagcaaaagcaattttaaataaaaaactttttcatttgtttaaaaaaaaatttaatagatttaattttgagaaaaaataaagctggttttaaaacaataataatttgttttcatttaaaaagggggaaatttaagtaaaatgaaagagcgcgggttctgttcggctgggagcgccaaaaatttggaaataataagtacagagattccaaatatttgtacttgttgcattccatcggcacaatgcatttgatgacatacacatggatttttggaaagcgggatggggggggggggcgataggcaaaaatggactgaccgcggcgcgtgaaaacagttaaaatacaatataaataataatagtaacagttgagccgatgcgcctgatgatgtcgtcacagaacataccaccgagcagcagcagagatagccggggggggggggggagaaattggaatgacacgaaattgggcgggaccgggaaaaaatcctctttcctaggcagcatagcagcgattgtgatggtggtggcggagagtgttctgctccgtcgccccgctgttgccgctgctgctgactgtgattgtggtggtcttcgtcggtcggctgcgtattgtataattttggacgaccggacgggcggatgatgacggaaggccggatttgatagatttgtcacttccatcactgttgttgttgttgttgtggttgctgcttatcgcttatctcggcgcgacgcccttaactgtgcgctctcatcagcggtcgccggtgtggcgcccggcgacggcggcggcggaggagggcctccccactgcgggcgggcgtttttggcgctggggtcggcggtgcgcaagcgatggcggccgtggcggatgggcgggccggcgcaaaacaacagcgtccatccatcaccacaaccacaacaacaaaatatgtaataataatgagagaaaggcgaatgaatgatttgggaccgggggaaggagggattttgtgggaggaatgactcaaaaacacggggacgaaaagatggagaggaatatgcggaaaaggagggaagaagaagcggcggctgaaagcagaagcgaacgttggttgcagccatgttttgtggtggtggagatgggtgg

SEQ ID NO: 26062 - DNA, 1115 bp, Heterodera glycines
ttatgcgtaacgactttcctgctcgatgggcaaatttcaccgatgaaattttgccacttctccgcgtgtcagagcctgaaacacttatgggcactttgctaatacttcacagactttgcaaaatttacgagttggtctttgattatatataagagcacttctccttataatatatagaattcagatctaattgtaagtcatttggtctagtccaagtatacttacattttcattgtttccagaacattgaaaacccggtggtctgatcggcccattttgggcattgtcccacgggcacttgccctttcccagtcggaaaggtctccacttttaaatcggcttattgataaaatcccgatgaaaataattttttgcaataaatattggacctttgcttaaaattttaagattaatattaagtgtccacaatcaggttaagaatccttttaaatatattatatgcagggttgccagatgaaaattttaaaaagcctcattttgggtcaaaaagcctcattttgacaaaatttattcaaaacacgtataaaatgttcaaatgttatatttttgattgtccatgatcgatttgagcattttttttgttagaaataagcattttgtgagattttgagcatgaaaaatcgaagttgatttttttgcggcgctttttccaaaaaacttgggaatgaaaggggccggccggtgccgataggcgccgccgggaaaatttttgtaaatgtgatttgttaacagatttgttcacaaaatggccaaattttgcaattttgagtaaaattgaaaaaaaaagaaaaaggatttttagggtccggcggtgccgataggcgccgccggagggggaaaaattgagaattttgaccatatttttagcagattttcattgaaaaaattcataattttgtggattttcgaaaaaaattgtaattttctggctaaatttgggtgagatttccgtttgatactctattaaaaaccaaaattcaaattaaataattgctaagcattatgccaatttatcaaaatttaaaagattctgaggatttttcccaaaaagcttaaaaatcctcaaatttctcaaaaagccacaaaaatcctca

SEQ ID NO: 26063 - DNA, 1611 bp, Heterodera glycines
  misc_feature (1506)..(1506): n is a, c, g, or t
  misc_feature (1552)..(1552): n is a, c, g, or t
tccttgggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataaatggcttagtccagagcagttgggcacatggtttttggagagatgccaatcccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagtttaataagttatatagtatttttttaataataaaaaacaatgataattagacatattattattaatttgaaattttatttaaattttagtataatatgctacatataaaaaaaattagttggattataaatgttctttattttattattttgaaaaactaacattttaggaatttattttataatttgtgagtttttttgaaaattaacatatgtttttgtatcaggttgagttcaatgattatactgattattattttttattttgtgaaagttatcagcagataatctgcaagattttaatgaatacatatttaatcatagcattttttcttgttcgttagttccttatttgcatgagaattgagaaatatacaagaaataataaatagtccatatttatttacaattcatatnacctattggcggacttatgaaacgtaccagcacgaataaatacttntatttttgaattcgtaactttataagttcagttcaatagttatttaaattttcatttta

SEQ ID NO: 26064 - DNA, 986 bp, Heterodera glycines
atgcaaataattttgcttgtgctgtccgcatttattctttttcactcggtcggcgcaaaagaattgccatcggcgctgattcagttgccttcccgcggtccttcttcattgaaaatgcgagaagcgccgatgaatcagatctttctgcacggcttcggcggagatgtgcaccagggatgggccaaattgaaaaataaaaagcgaaatgcgaaaagcgaaatttgcgaaactgaaaaatgcgaaatgaaaaaaaaagcgaaatgcgaaaagccaaaaaatgcgaaatgaaaaaaaagcgaaatgcgaaaagccaaaatatgcgaaaatgcgaaaagcgaaatgcgaaaagcgaaattttttctacaaatttttaatagttaaaatcataaagcaaaaatcattttttaaaattttattccaaatttaaaaatcaataaaacgctttattgaggcgcgctttttccaaaaaaactttttgggaagagggggcaggcggcgccgggaaaatttttgaaaatttgattaaaatttgttgacagattttcaccaaaaaatcatcaaattttgtgatttttgtatcatttttctaatgagaaataagagttttggcgcgccgctgagaacagtttttcagcaaattaccaaatttcgcgattttgggccattttctaagaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgatgtgcacccgggaagcgaagaagaggcggtgaatcat

SEQ ID NO: 26065 - DNA, 1156 bp, Heterodera glycines
ttttttttaatttggtgtcatcaaaaaagacaactttactcaatttacgaggtgttttttaaagaatttttaaaattattttagtgcgtcaaacatttcaatcggagtttccgtttgtctttagacgaatctcaaatcaaaatcaaggacgacatatcattacaaaatggccacatatagtgaatttgccaacttaaaataaatagaatttattgctttattatatcaaaaattagataaaatttagaatggttcgacaaaaaaaaaaggataaaaataaatctgccaaataccgtatccattcacttgctgaatactgtatttgtttaattaaaaggtctgatactctgaaataaacattatcactacaaaaaaattgtgtgaaaattcaattattttctgagaaaactaaggtaatgctgtgcaattaataaaagcataaaaatgcatttttattcgtatggcattcaaatttttttgaattggcatgacaacaatttgatttataaattaaaaagttaccaatattttatataaaatttgtggactatatttaaaacaaatttattttaggttcatttatggggagaataatgaaagtttaaaattgattttcataaaaaatcaatccccaaattattcccaaactatcaatgaaatcaattttcaaattattcaaacgattttaaaaataatgcagggcttccagatctgaggttttatcctcattttgtggtttttgatagatcaatgaggatttttttgaaatgaggattgaggatttttgaggcttttggagaaaatcgtctgaatctgttaaattttacgattaatttaaatagtttggcataatgtttggcaatcatttaatttgggtttttaatagagcattaaaacaaaaatctcacccaaattttccaaaaaaaatgctaaatttttcatgagaaccagaaattttaatttgtccgaaaacaaaattatgaattttgtaacgcttttcaaaatgttgtccctttttcaattctctttttttgtgaatcattcactttccatccaaacaaatgcgtctgttctgatcagagacgggcgaagctcggcttcgcactcgaagccaaagacgaagcccaattttttttgaagcacgaagctccaagtt

SEQ ID NO: 26066 - DNA, 1654 bp, Heterodera glycines
  misc_feature (1604)..(1604): n is a, c, g, or t
  misc_feature (1611)..(1612): n is a, c, g, or t
  misc_feature (1620)..(1620): n is a, c, g, or t
atttattcatctccctttttgatagaaaaagcatcacatttacgaaactagcatgtaaataaaatttggtgcgtttcacagcattttctgaaaaaaatatttatgaattaattatgcaaaaataaataaaaatttctaaaaatttgatcgtccataaataatttgtaattgatcaggggctcaccaaattttgcaggaatacgtatcggaacactacaaatgcttactaattttcctagattttttaaacccggtgaaaattttttgcagacaccaccacttttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaattttaaaaattttattcatctccctttttgatagaaaaagcatcagagtgcctaaactaacatgtaaataaaatttggtgcgtttcagaaccctttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaactccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgataagtttctgaaaaaaaaagttaagcctaaactttttggcctgtttaaaaaggaattaaaaatttttaaaaattttattcatctccctttttgatagaaaaagcatcagagtgcctaaactaacatgtaaataaaatctggtgcgtttcagaaccctttctgaaaaaatatttaagaattaattttgcaaaaaataaataaaaacgaaagactcagattttcgaaaatttttttgagccagctagctcggcgctcatttcagtgtaagtagtcctttaccggggagatccctgcaaagtttggtacgcttctgctcattagcaaaaatatgagtgatcgaatttcactaaaaaagtaagcctacattttttggcatatttnaaagcanntaaaattnttaaattaataatttcctgcacgaggtactatcg

SEQ ID NO: 26067 - DNA, 1440 bp, Heterodera glycines
atataatagaaataatcttaaataaattgctttatacttcatgcatgatttccattaaaaaataaaataatacagaccattctttatcaacatcagaccattaaacactgttttttttctatttcatcaaaagcaataaaatagtgaaaatatactcctgaggaatgatccgaaaaaaatttcagaaaatacacccataagaattgaaaaattttctcaaaaataatcgtcaaattctaattttgctaaacatggttaaaattctcaatttctccctcggaggcgcctataggcaccgccagaccccctattccacaaaagatttttggaaaaagtgcagcaaaaaagtggtgtaaaaagagaaaaaaaaatgaaaaagaaaaaaggacattcattgcccggataggagtaccccaaatcatggaaccgtccctgatagacaatcattttaagcgtgttttaaaattttgtaaaaatgatgctttttgacccaaaattagacttttttgcctaccaattaaggattttgaaaattttcatctgggagccatgttttgatttatattagcataataatctggctaaaaaataaataatataaaagttttaaaattaatatgtgaaaataaaccaatcaattttcgagaatcggaaatacaattaaatcaataacaggtggcataatttaaagttggtgacaaattacaggaaaatttataaaacattaaaaacaaatgaaaaaattaaaatgtaaattaaaatgaataatttattagcaaaattgctttatcttttttatccatgacaattaagtaaaatataatttattctcgtcgtagaactcaagtgatgaacaaacggacttgatttcgaaagttagttttgtgcttctgaaaaaatattaaggaatgcacaaaaaaaaatattttaaaaaatgaaaaaatgcaaatatacaacttaacgaaaaggtaatactataaataatccaggctgatcgtattgctttaatttaattatcatatttattgtaatcattaaaaacgaattaaaatacttataaaaataacatcttgtgacccaaaacacctagaaaacgagacttcaagtagtaatgggttacaggggcaggggtccagggctttaccacaaacctaatccaattagccatcctcctcaggaatctcgcgcagttttttttagttttttaaattatttaaattcgggagaattttaataaaaattaaattcgccgcggggtgggggactcgaacccttggaaacgggagctctaaccactcggccacggaggcggttgaaatgatgggagcaaatgttggatatgtgccgataattttcctcccgatcctcccccagggcggcggcgatgatcggacccctccccctctccggacccctccccctctcccggacccctccccc

SEQ ID NO: 26068 - DNA, 1723 bp, Heterodera glycines
  misc_feature (426)..(426): n is a, c, g, or t
tttcatttttaacccctcaaaagtttaatcatttttgatatatttattatttatggtattttttggcctttttttttttcatattgttttaaatgacgcgctcaattgatcagctgatcaccaaagcactttttttcatgtttttttgagtcattttggcgccacccaaagttttttaactttaactttttttcattgtcaaccagatcaaaaatattggtattattcgatctcttaaaaggctctattagccttacaattagaaaaatcacaaaagtgttttctagcttataaaaaagaggtttcgaaaaaatttcaataattttgtcttttttgcaattttagtgttataacttttttgggaattgtcgaatctccaagcaatagcatacaaacagcttctaaacacttcccctcccccccccnccccccgattcattatgtaccagggctggccgtgattgaatttccaatcacggaaatccgtgagccgtgatcacggggctttaaaaaaaatccgtgacccgtgaaccgtgatcacggcaccccaaaatccccgtgatttccgtgatccgtgagccgtgatccgtgattataaaaaaaaattttctaatgattttttatttaaatttatttaaaaaacggaatttaatcgcgggaaaaattcccaaaaaatgttttaaagaaaccaaaacatataaaccgctttttttgcggcgaccttttccaaaaaatgactaagtttacgatttttggcaattttttgaggaaaattagagctttttgtagaaatctccaaggaaaattttttatttttaactaatttattaagaaaatttttcaaatttttaaatttttcaaatttttcttaaatttaaccaaaaatctatttatgtagagaaaaaaatttcctctaatttgtaagctaacttttgatgctgaaaaaaatcttttggaccaacatgctcagtccttcatgacgatctgaacaccccaaaagatactgaaagtcgggaaaattttagaaaaaattcttagagggttgggaaaattttctgaaaattttgattaggcctttcgttttaaatttaagcgacggagagaaaaaatagggtttttagcagtttatatgccaaaaatggtaatttttctgccattttggggtcaaaatttcaaaaatacggtaaaatgggggtccgtctgccggtggtgccgacaggcgccgccgggaaaaattttgaaattttgagtgaatttgttgacagattttgtccaaaatatgtccaatcattggttaatttattggtctatggacgttttaaaaaataaagaaaaataattttcaatgttatgaaatttcttgttaattaaatttcaattaaaattatcaaaacaaaatatataaattgtcctatcccaatggggaattgaacccaagggacagacaacgaaagacagaaggcttaaccaccagactacatatatatgttacttgctaacttgtaagcaggaaagaatttatttatttttctcaaaaaattcttcacaccactttcctattttcgtctcaataaaaattccctatataaaatgccaatcacggatcaaaatcacggaaaatttgaaaaaatccgtgacccgtgatccgagatcacggcaccccaaaaactccgtgatttccgtgatccgtgagccgtgatccgtgatcacggccagccctggt

SEQ ID NO: 26069 - DNA, 1077 bp, Heterodera glycines
tttaagtttcagaatttttggaattttttaaaaattcgaaaatatttggcaattttttggccctcgggattttggcctaatatttgaaaattcataacaaatcgaagggttgatcaattttacagcaataaagccttaaaaatagagaaaaatcaggagaattttatggactttatttggaatttctatctaaaaaaggaaaaaagttattccagaatttctggaaaaattcgaattttcagaaaaaaattcataactcggttctgaaaagatattctggacaaataaaatactacaaaaatccgcagttttttgctctattatataaattttatttggcatttttatcacttttttaagaatttttataaaataaaagtgattttgagattcgggaccaaaggggtgagcataggatttttgagcggaaatttttttttcacaaaaatcttccaaaaatatgtctttaggggttatttgggccgctgatcacgaatacgtgatcagattttacttttgacatcgttaagacctcagaatccctgtgtgattggggattctgaggcatcattttttgggggggggggcaaagttcgaatccggacggtgtaacaatatttttctgtgcatttttgggttattttgactgtttttaattaatttgaagatttcttttaaattatttaaatttatttttttttaaattaaagaatttcattatttttttttgaatttgtaaaaaaaataatttaatttcaaattaaataattattcaattaataatttccaacgttgtttttaattaataactaccatttttttcgtattttcattgttttattcatttaaaatattttttattttattaataataaattacatttttttatttgaattaaatttttataaaaacttttcattatttatttaattttaaaccatgttgtacctcttctaatcacttttgtacctcttctgatcactgttggactcatcttaagacctcagaatccctgtgtgattggggattctgatttggatggtttgataaatttataatacatcctaataatacaa

SEQ ID NO: 26070 - DNA, 973 bp, Heterodera glycines
tggaatttcaaaattctcgaaaactggcatcttagtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatctttgtgagaattgaaaacggtacgggagaattacaaaataagtccccatttgcgcttaaaagggcgagaaatgtcaattggagcaatattttcggcatgtagtgctggaatttcaaaattctcgaaaactggcatctttgtgagaattgaaaacggtacgggagaattacaaaataagtccccatttgcgcttaaaagggcgagaaatgtcaattggagcaatattttcggcatgtagtgctggaatttcagaattctcgaaaactggcatcttagtgagaactgaaaacggtacgggagaattacaaaataagtccccatttgcgcttaaaagggcgagaaatgtcaattggagcaatattttcggcatgtagtgctggaatttcagaatctcgaaa

SEQ ID NO: 26071 - DNA, 1154 bp, Heterodera glycines
ttggtcaaacgccagaatgcaagtaattcactgatgactcctcccaagtggtgcgcatctcgtcaaaaatggatatccgatcgcaagaagtagagttgagcggtaccggtaccggtactggccggtaaaatgtatgcagctataaatttacaacgaatacaaaatatattctacagataatataaaatgataagtatatagtaattttttattcgacaaaaatcaagcattcatgcttttttatattttgcaggtaaatgtatgcagctataaatttacaacgaatacaaaatatattctacagagaatataaaatgataagtatatattaattttttattcgacaaaaatcaagcattcatgtttttttatattttgcaggtaaatgtatgcagctataaatttacaacgaatacaaaatatattctacagagaatataaaatgttaagtatatattaattttttattcgacaaaaatcaagcattcatgcttttttatattttgcaggtaaatgtatgcagctataaatttacaacgaatacaaaatatattctacagagaatataaatgttaagtatatattaattttttattcgacaaaaatcaagcattcatgcttttttatattttgcaggtaaatttatgcagctataaatttacaacgaatacaaaatatattctacagagaatataaaatgttaagtatatattaattttttattcgacaaaaatcaagcattcatgcttttttatattttgcaggtaaatgtatgcagctataaatttacaacgaatacaaaatatattctacaaagaatataattttttattcgacaaaaatcaagcattcatgcttttttatattttgcaggtaaatgtatgcagctataaatttacaacgaatacaaaatatattctacagagaatataaatgttaagtatatattaattttttattcgacaaaaatcaagcattcatgcttttttatattttgcaggtaaatttatgcagctataaatttacaacgaatacaaaatatattctacagagaaaatataaatgtaagtatatattaattttttatttcgacaaaaatcagcatccatgcttttttatattttgcagggtaatgtatgcagctataaatttac

SEQ ID NO: 26072 - DNA, 1114 bp, Heterodera glycines
  misc_feature (27)..(27): n is a, c, g, or t
ctgtttttgctaactttgcgtggcgcncagcgctgaagtttggcgccgctgaacgaaatgcgtgccatccgaaggggagcataatgaaaaaaattttggcgccattcgactactttgcgctgagatatgctaacttttgttgcccactttgcaccatagagagccaacattggggccagcgctgctagagagtcagaatttttttccccgcgcgtcccgcaccctgaaaggctgggaaaacaaattgccgtctggcgccgggcgctttgcgctgagttgtgctaacctgtttttgctaacttttcgcgaatggcgcctagcgcctggcgctgcagagtagctgtcttgcggttgcttggcgaaagttgcgccgcgccatggggagcattttaaaaaaaagttcgacccgattcgacaagtctgaagggtcgaaccccctttagcccctggggggtgcaaaatgcaaagtcgctattttcgcgggaagcggtgtttttttagtgtaaaggatgggcgcagacgtaaaaagcacatttttcgcaaatttggtcaaaacggacaaagtgtcgacactcaaaacggacaaagtgtctacacacttgctgggacaaagtgtcgacaccgtgttttttgtgcgtgtagggcagtggcaagtgcatgactgtctgttttagaccatttggtcaccacagggacaaagtgtctaccccgtgacagtgggtcgacgcgatgtctgtctgtctgtcatccactggcctttgtataatatttcttttattggcttccactggccatttagacaattttcttttaattggcatccattggccattttataatgtttcttttattggcatccactggccttttcttttcttggcttccactggccattagacaattttcttttattggcttccactggccatttgacaattttcttttattggcttccgctggccattttataatgtttcttttattgtcatccactggccattttcttttcttggcatccgctgaacattagacaattttcttttcttggcaaactgctcacgggtgccacgcatgccaatgccaactgctcacggacgccacgcatgcccattcg

SEQ ID NO: 26073 - DNA, 1045 bp, Heterodera glycines
ccaatatttcaaaaactacgtaatgacaacaatgacttcacaggtgaacaaggggtgcgccggcgcactcccccccccccccccgtaagggggggcggctgtaaaggagggggggggaggtcgtaacgaagggggaaaaatttaaaatttgagcaatttcttagcggcgaaatccatacaaaatttaaaaaattttcccggcggcgcctatctcggcaccgccggaccgccccagccccttcccaaaaagtttttggaaaaacgcgccgcaaaaaaaaagaaaatatgagaaatttatgtgatcctttttttcatgactggtcatttctattttagggcaacaacagcaaaatgcaccggcgacaatggaaattgacgagcagcaccagtcgaacagtgcgggccatgttgttgcgtcgggggaatgcgtacagcaaagtgagcagcagcaggaaatgcccgatttgtcagcaatgaccgaagaggaacagttggaggtaggtaattaattcagtgataattagggtcgcgacttttagtgacgaaaaagtgccaaaaaagtggcaaaaagtccgaaatagtgacgaataatgacataattttcagccaaaaattgagcaaaaataatttttattcactgattgcagttgcaaatgaagtgtacatttcctttctaatattttcttaacaaatatttaactttttaaatcaaaatttttgtcaagaaaaaaaagatttggtcgatgaatttttgagaaaactttccaaaaaaaattttatgtcgattcgtaggggtgtattttttggttttattgcatttctgttaaggaattttccaaaaaatgtcgaaaaagtgaaaaaatagtgacaaaatgccaaaagagtgaattttcactattttaagtgacgaactgcaaaaacagtgattttctagtgacgaaaaatgacgtccaattgaaagaattttaatgcagaaaatgcgtttttccaagctccttttcttccaaaacaattgaagcaaaaaaaaaaaagaaagtttttttcc

SEQ ID NO: 26074 - DNA, 1807 bp, Heterodera glycines
  misc_feature (1725)..(1725): n is a, c, g, or t
aaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaggtgggcgtttcttaaaaccgccactttgggcgtttcttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaataggtgtcagcaggaaatatgaggctggcagttttattacaatttaaatggtataagtagctaaatttctttaacatacatttattataaaaaatattattgccttaattcctttaataaattaatccaatgttattagcatttatattcttttcattcataaatattattaattgtattagctttgatgaatttgtttcaaacaatggcgcaaaaggcttggttgaccaataccttaaaaaagaaataaaatccaaaggagaattgttggaaaaactagccgaaattaagttgacctaagcttcaggacgctggaaagatatatttcaaaaataaaaaatcgaaaatcaacagaaggaaacaaagacaacatggaaaacgctgaagtgtcacaatgtttttcaaaattcgacaataaattcctatttataattggtcatgataatcaatatcgaaaattcaaaaaaacaaatgaaagaacggatacgatttatctctattgcatgaactgtgagaactataataagcagaattctgctgggttggtttcagttatttcgtgattcttctatataattagattatagagttattggaagtgctattattagagagggccaattagatagaactcatcaaatcatgcaccatcttcagtgcaaaggtgtgccactagagcaacttactgctgaacaaattgataggaatcaaagaagagaattaattcaatgttcagcagattctaaatctatttggcgagaagtgatttgaatatttcataaaaactaatccaattggtacgataaatttaggggtctgacagggctagagagcatgatacagctgaggatatcgaaattgatgatcccactggaatttcatttaattatccaaattggcaaagcgtaagacgtgcctacaaccgacgaaaaatgaacaaataggggattgttctgatccatttaatgtgccagaaaaattttagctaactaaacgcggagcaattaaattaattcttcaaaaaagctgacttctgaagatatgtaagagttagttttatctgataatttttgattaaaaaaaatctaaaaaaaattcatattttaaagatggctacggtttcgagataaagatatgggtgttatgctctttatgacacatacacagaaaagagctgtcgctaattgtaaagtcttggtttctgatggcacctttgaattagcacctctgaattttcagcaaatttggacaatcccatggattggtcagattatatttatatttctacttaggtattcttaagatagaaacaactagtgggcgccgaatgggcaccattattaatgggcttntgatgaaaagacggtagcaaaaacatatttaaaattttaattttaatattttttagtacccaagcatcatacgaaaaagttt

SEQ ID NO: 26075 - DNA, 1537 bp, Heterodera glycines
ttttaattatttaaataacatttttaatttaaattttctctatgctaatgagtctcattaagccattttattaattttaatcgcttctcaaagcaaaaacattttcgcaaaatttctatgttattaaaaatgtttttttttactttttaatgaacaaaaggagaaaaatgaaaaaaacgaattgtcgttaattacccgtgacaaattttggacgaacgcttttcgaagaaatattccctctgtcaaattgcttggacagcccaacaatttgaaaggcgaagaagcggtttcgggcggctaattgcgctgtttgccgatagtcttttcggtgggcgcaattttccggcccaaaggattttttggtcggtttcccgtcccgtctcttgtcattctcatcatccgatattaaattagggagtgcgccagtggagaaaatcccaaccaaacgaagccgaggcgcgcattccttagacagaaaatgatcacaacgttgctcttcagcaatttttgctcaattcctacccccactcacatgttccgtctcccctctgtggcacccgcctcctttgccctcccattccctctcctctcccctctcctctcccaaccctctcctgtcccctcacctcccctcacctctcctctcccctctcctctcccaaccctctcgtgtcccctctcctcccctcacctctcctctcccctctcctctcccaaccctctcctgtcccctcacctcccctctcctctccactatcctctcctcactcaaataactgatgtcacctgtaataaacttacctttctactcataaaaatcatttcttcgtaaagagtcagtgtcttccttagcgaatgcctgtcaccatggcggatacataggaacacaaagccaatatttcacaagaaataaaaaaataagaaaatgttgctttattatatctaattatttatctgaaatttataaaaattttaaaaccaaatatacaatttacacaaaacctcattactcaattacaaaaagttaagtacatacttagtgaacacaaaaaccttgtttttaaattcatttaaatcttttaataagtatcttcaatatataattgtatagtcaaaaaaatttcatattaaaattaagtgatttagctttaccacaaaaataatttaaaagctttttaacataacgaaatgcaactgaagatgcttacgcgggcgagattaatcatgaaaatatattataatctttttttaaaatcaaaaatttcaaatataaaaaataaataatccaccatgaatggtaaatgcaaaattctgataaaagaaaattgcagacaggaaaaaatgcatataaatgaacagtcaaataaatattctaaattagttattttattataaataaaatataattataatactagagtttgatttcctttctgctttactcaacatgtttataatttaaacaattaaaaaacataaactcaattattcacttaattaaactaatgtaagccgtgactcgggtctcggctaccga

SEQ ID NO: 26076 - DNA, 1176 bp, Heterodera glycines
  misc_feature (60)..(60): n is a, c, g, or t
ataaatttatcaaaaaaagagatagccattttttgggatagagtataaatttaaaaattncctcaaaaataaaaggtctatggcgcaccgcccttccctatcatgctcgagagcatttgtatgtgtataaaatttatcaaaaaaagagatagcatttttctgggatagagtataaattaaaaaattcccctgtaaaataaaaaggcgattgtgcacagcccctccgtctcatccgcaagcccttttgtgaggtataaaatttctcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttct

SEQ ID NO: 26077 - DNA, 1522 bp, Heterodera glycines
ggagaagagccggacgagtccaagctgtacatccaacagccggcaggtgtgaccatttggtgttggttcaaatggtggtccatcgacggacgatggtggtgggagaccatcgaagagcacgatttggtggatgacgactgcgaggatgaggaggaggacaccgtggccagaaacgggggcaactccatgctgcacgagggtaccggtggtggtaattgcaaagcgtgatggcactttcacaatgaatgcgttggatcgatgtgctttcgctgttaatgtccccgggggataaatggcgcccacggcgatgacacgcacaacgtcggctgttcgtagagcgaaatgcgccgccgacagcagctgtcttcgctcggccttatcgtaatccgcgccgcgcagtcagagggccttccccccccccccccccccgctttgattgcccgagggccaaatgcttaaagaccttttggtggctcaggcaccatacgctcgcgcacaacgcaaccgccgttttggccattagcgacaacaaacggaagggttggcatgggaaccaaagtcttaacggaaatggcagaccgcagcaagcaaatttaattggtgaaaaagtttaattggaaggtcgatttagggtgaggaaattgttgaagcaaatggcaaattgagtgtcaaataaaaagcatttgttttttcattaattaaacctaattggtgcaattgcccttttaaccctttcccttgaattgcccccccttctcccactctttcccacctgctgctgttgttgttgttgctgctgttgttgttgttgttgatagtaaacgttctgttgtcccccatattccgcgctgttccgctggtgtccccctgcattgttgtgctgctcgaattcgccatttgtcactgccgccgctgcgtaagcgttctgctgctgtctgaacaacgacggattattctgctgcagctgatggtgaggctcaaagttcgacgggtgcggcgccggtggcaattccaaccagcaccaatcgggcgaaaggtccgccgctgtggaagcggacgaaaacgggcacggcggactgtcgccgccatcgcggggccccgtcccccccactgtccccgacaaattgtcattgtcgccaattagtggaggcaaaaagttgtaattgtgaaggtggtgggggtggtatgggccattgctgctgctgtgccgaatgtctaactcctcaatcactacaacggcaccacccggtgccgaactcggcggacccaaagcgggggccggcacaaaaatgggaggattgctaacggacattccatcctcctcaaaattgcttgagcacacaaacatcattttgttggcacttggcacagaatatttttgggattttcagagaaatgcgaaaattttgggcttaatgatgcgaattctgcccataggtgaggtgcgaaatggctcaatttgtgctcatttaggcgcagtgggcggtgccgggcgaaggggggggggagacggggggggggg

SEQ ID NO: 26078 - DNA, 2043 bp, Heterodera glycines
  misc_feature (29)..(30): n is a, c, g, or t
  misc_feature (85)..(85): n is a, c, g, or t
  misc_feature (123)..(123): n is a, c, g, or t
ttgtcaaaataaacccaaatagagtcttnnttcgttggtcatttggtctaaattacaaagaggaaaaattgtctataaaatgacngatgaatgtataaatattttctgattgcatattccatntaaatgcgcgagcaaattggaattttggtcgttttcaaaattttataccttcaaatcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaatgcgaaatgcgaaaagcgaaattttttctacaactttttaatagttaaaatcataaagcaaaaatcatttcttaaaattttattccaaatttaaaaatcaataaaacgcttttttgaggcgcgctttttccaaaaaaactttttgggaagagggggcaggcgccgccgggaaaattttagaaaatttgattaaaatttgttgacagattttcactaaaaatgatcaaattttgtggtttttatcatttttctaatgagaaataagagttttggggcgccgctgagaacagtttttcatcaaattaccaaattttgcgattttgggccattttctaagaaaaaataggagttttgggggcgcggcggtgccgataggcgccgccggggaaaaaaatggaaattttgatcatttataaacaggttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatgcgaataatgcgaaaggcgaaatgcgaaaagcgaaacctcggcccatccctgcttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcacggatcgcggatcgcgcaaaaaaaacgccgcgaatcgcggatcgcggtcgcgtcccagccctgatggatggtgagccattaattttttgaatggcaattttggccatttgttcaattccaactagagttgcacgggaccgggagttttgacaaaaaccgggaccgggaattttcgggctaaaaaaccgggactttttggctgggtaaaccgggaaaaaaccgggactagtcccggtccaggtcaaaaccgggactaggtactcagttgtacgttttttcagtaccagtcccggtcccgtgcaactctaattccaagtttttaaacgggtccgggtaatcgggtccaaccggatcctgaaaaaacccatgaaaaaaaagtttatacattaaaaatattataaaatatattcaagaaaaatattattttttacaaattactctatatttatcataatctacgaaattttcaaggattttggcatgggacggggtgggtaccccgccctcgggccatgaccctttttactatcaaatcactctttaggtgagtttttatggattaagggctttataaagagttccaaggttttttcatcttttatttcgcgacgcgaccttttaaatttgcccccattttcaacaaaaaagtaagagagagtttgtttgtgctggcgattgagccaaattaagttttgtactgaataatgaaactcctttttattttttagaatacatttttttaaaatgacaacaaatgggaagataataacgaatgatggcacattagtgccaaaacggcaccaaaaaacgaatggcctcattccggggatttttttttttgttcttttcattcgctttatttcaaattttgtaaattttttgttatgaaccaatcattttttgctattattgtaaatagtgccattttaatagtaaaaaaaactttcgatggcatttactctaaaatcattcgcgaattgcacaattctgg

SEQ ID NO: 26079 - DNA, 1548 bp, Heterodera glycines
tgttacgcccaaaagtccgaaaaggaataaaagaatatttattcaaattggaaaagggacaaagggcgaacagagtcaaagatattgattgggaaacaaaaggaacaaaataaatgaatgaatggagaagtacaactgagggaggaaaaagaggctatttatgcaaagacagaggggtcaaagaagggatggggcataacaaataaatgggaacggaatgccaatataataaataaatcaaataaccaggcccatcccgaacacctccccctttaaaagagtgggttcttatcatctgggcgaataacgatcaggcggacgacggtttcgcttgggtcgttcgttctgaacattcggttgaacggcgccttcttcaatgacttcgtttggctgttgtggcgcatcggggcgcggagatggtggcgcattctcaatcacttctccagctggctgtgccacaacatcaccaagattttgattggctggtgccaatggaagcccgaaagcgtcattcaagacgtccagagggtcttcctcattcacgtctgaatgtcgaaccagaagttggttcgcgtgaaatcgtccaactgatccgtcctgaaaagtgacgtcgtacatcacaccttttttcagggtgatatgcccgggtcgccaattttgcgacattcgatgccgagcgtagaccttatcgtctaaatcgaacgatctcggcctcgcgccatggcgccgattgaactttcgttccattgcttcgtcgcggatgacgattggacggttttttggtttcaataggtccaatgtcgatcggagtttcctttgaaggaacaactccgctgggcttttgcattcaggcaaagactcagtcggcgtgacacggtacgtggccagaaatgtgtccaacatttcggtgattccctccttcttcaatttgcgacacgtccgtttaaatgtgtcaacgaaccgttcggcttgtccgttggacatcggacaataaggtgccgaaaacaaatggtttatgccgttgagtcgggtgaattccttgaattccttcgacgaaaactgggtgccgttatcggtgaccaaggtttcgggcagtccatgccgagcgcaaagatagcgcaatttaccaatcgtggcggctgaaccggtggaattcatctcgaagatttcgggccacttggaaaatgcgtctacaatgacgaggaacatctttccaaagaatggtcccgcatagtccatgtgaacacgcttccatgggccatcggattttggccatgaatgaagggtcgtcttgactggtgcttttgcctccgaagcacatatttgacaggaacgaacaacttcttcaatttgttcatcgatttgttgccagtaaacgtactggcgagccaaatttttcatgcgtttgatgcccgggtgtccgtgatgtaatcgttgaagcactcccttttgaagtgattttggaatcacgacccgatcggcatacatcaaacaatcgttctcgattggccacgcttctctcccgtcgtgaaaagggacaatgtcctc

SEQ ID NO: 26080 - DNA, 1796 bp, Heterodera glycines
tcgccttcaaattgccaattgatgtgaaactgtcctacccattttgtgtcaatgaaaattgcgatttcatttatccttgcggcaattgaagtgccaatgttcacggattataaaaacactaagagcattcaattgataaaaagtgggtattttttacagaaattttaattaggtaaaatgcgattttttgccaaaaaagtttgcaaaaatggaatttcatatggctttttcataaatgcgcaaaaaaaaaaacgaaatttcgcaattgtttcatacatattttttatgtttgttttcaaaaaaaaaacaaaaaaaaattgcttttctggcgttttgtattatttttaaataattgttctcgcgtcaggatcagtcagctgggtaacaaactcagcctaggacaattcagccgaggacaaactcagttgatgcgacaattcggctgatgaacaactcagctttacaagaatttacaaaacgcaactcgtacaatggcttaggctggccaagcaaggcatacgcttaagcctaagctttaggcgaggcataggcttaggcttgcttgggcctaggcttaggctttattttgtaattttttattgtatggctgagttgtccatcagccgaattgtctcatcagctgaatagcccagaagacgttcttgcattttattaaaaaaatttcttttttttaagaagaaaaaacaattctcaaagaaatgaagaagaagctaacagaaattttttatgctttgttcaaaaagttcaacatcgatgcgtacaatatgaaaattttggccaatacatttgaacaaaatgtgccaaaaacattgtccaacattggcacaatgttacgggagcaggacaaaattgatgatgaaaagcaatatgtgcgcatttattggcgaaaatgcatcattactgctcgtaaccaattggaatcgttgaaggacggcattttgtcccaaattttcaattatttggatgagtataaaacggtggaaaacattgagcaaattggtgaaacattgaagataattcgcgaaactttgctggctgacgactgagtgaagaaattttggaatttatgaaaaaatgtggattttttttaataaaattaatttgaaattttgggatttaatcgaatctaaacacgaattagaattggattattgtgatcaaaaagcattttccattcgaatttggcatatcatttgaaagcgctacttttttgaagcaaattttattcattaataagtaaatgtgccagtaagcattaagcaattttcaaaaatatgtagccgcacaaaatcgaaaaacacacaaaatttttggattattcttatagtaatccaataaaatcctttttgattatgaaatgatttcaaatgataacaaattagtaattatttttccaatgccccactttttaacaaatttttcatttaaaatatatatattatcatttcaattttttgtctaattaccttattttttacatgtgtttatgtcataaaatgattaatatattggatttattatgttcttccaaatgttattactccattttttgatcaattttggcatttttgtccaaatttgcgccaattcaacgcttcttttgtgccgttatgcgcaaaatgccggcacgtgtgatgttggagcggatgcttttcgggtccacatcatccggcaatttatagttgcgctgaacctcacgcgatgttgtgcccagcatgccctcgcgctggtcatgtttgcagtggatgaacaaattttggcccatccgattcacc

SEQ ID NO: 26081 - DNA, 1171 bp, Heterodera glycines
atttcggtcggtcggtttcggtataaaaaccgaaaaaaaccgaaaaactcaaaaaattttcggtcggtcggtttcggttaaaaacccgaaaccgaaaaataccgaaaaaacccgaaaaaaaaccgaccggtccgatctctaaatgaaacggtgcccaattggggagacggcgacggttcaacagcagcagagctatacaaatgtgtaccatataaaaaatgtacgcattgatttgaatgatgattatgacaaagattgcatgccattgttcgattctcattgtattcaaattttgcatttaaaacaggccattgactccgccagcagtgtaagaagcggatcaaagcaacgcagagggagggccgattgagtccggggccaagtaatcaatgaaaaaagtgaatgaagattgaaatgtttcaagaagtatctttgaattttgctaattgatttgatgcgattttagttttgaacagctttcattaaccttaagggactttcctcagaattttgaaagccatctaagcagaaagctgaggtcaagcttaagctttggcttagcttgcgcatgtaagcctaggcttaggtgagcgtttggagaatgaataatggggggcatttccatcattgtttagtctatcgccaagcacattctcccaccatcattattataattattatttatttttttaacattgcaatattttattgaattatgtccgacaatggaacaatgcccaagaaacgaaaaattttcatttataccaacatatgaattaatgaaatactgccaacattaatttcatgtgtgattaaaatataatgatcagaaagtcatttattgaaacaaataacaatacaaaatatgtgaattgaaatggtttaacataaattaaataaatcaaggggtgggatgatatttaatttcaacaatttccccattaaaatttttaaaaattcttaattatttctgccctgctgattgatcaatgcatgtatttttgcctcaaagcttgcgaggtccctttccctcaagcagcggtaatactcctgtcgccacccctcatcaagcgtgaccggcccgcgtcgcatcccgcggcgcaaaatcaaattcagaaacaatcgggccgtgcggccattgccgtcaaaaaacgggtggattcgcacctta

SEQ ID NO: 26082 - DNA, 1437 bp, Heterodera glycines
tttggatcatcgaattcacttgggcttcgaaggtcgttcctttcgttggaatgtctgaagctaaattaaaattttaaagcatgtaaaaattgtgatgcgaacacatggaaaattaaaattcacccggaagttttcttccagcggagacaattttatcgtcgaattcgacgaattgtcgaatagggagcacgacagaaagtaaaatgggacaattgtgctcgatggccaattcgcgcaaagaattcagcaattttttaggatccggaaaacagtggtggataaataaagttagaatcgaaaactttacatggtgtcggtcgagcagattcagtgccgttatcaacgaatatggtccactccgttgccatttgtacatcggcagaacggtgaagccgcgcctggccaaccgccactccatcacctgtacaaaaggggggggggcttaagcaacccgatccctctgggaatgaaaactttggatgcttcaacaacacaaatggaagcgaaaaatgaggcgaatttcgccgtcactgcgccgtcaccggccccaatgtcgagcaattgacgaccgatgggggaccaatcgtcgggaatggcgaggaacactttcagatgggagtgggagaagatgaacatgcgacccctgacaatgagtgcattcgatgaccatccgaatttaataagacctgtgcaacaatccgttgatgctcgtctttgcgaggaaaacagaaagcagtgaagtgaagagagagtaatacacctgcaaagggaatggatggaagaacgctaattgaaagtcccattaatactaattagttccagttaatagaattatttgtccgtttccatctcacaatcagcacgtactctattttttagaatttttacctgaaggcaaaagctgttgctaataacgagggaagcactcagaaattcgttggtttcttcgtccatttggaggctgaggaagcgattccgcgcctctcctcccaattgacagtggtcgacagagtaccaatggccaactgaaatgtaatagaaattggacctaaaatgctgaaaaactttgctccgttgaaaataatttacggtccaattcatccttttccaccaaaatacgcactaagcgtttctggcgccacattcactgtcgaagaaaagcaatcttatgaaattaaattgaattaaaattcaaaagcaattataaaacagaattccatctgtaatatttaaacaaatttattttcacatatagacaatctgaattgcattttggcattttataggctttgttgttaatcattttgaaatgaaatgagaggaatatcgaccaatttaacaacggggaccaccgattcactgcagcattccaacggaagttggacgagtcgctgttttccgtttgccacccctttcaacatttgctgccgttcattt

SEQ ID NO: 26083 - DNA, 1124 bp, Heterodera glycines
  misc_feature (116)..(116): n is a, c, g, or t
tatttccgacttttgtggcacagacgaaacatgcggtgacaagctttgcaatttcgttcattaagcctttgatctcggagatcaccgcgtccacctgaatcacattcattttattntgggagatagaaggtgccgagttttcttctctactttactaaaagtggcacttttgccgactgtcggacttttgaccaacacttgaagctgctgacagtgaaaagggattttgtccagaatttgcaacagttcgttcttttctgcacttccggggaccttaaccagcgaggggggaagaaagtgtaattggtagggagggaaatgcataagcattgtcccacttcaaaagcgaattccatcacagttttgtgcattttgttggcctgttccgcgaaaaactccgcttgggtgaataagtcgtgggtcgtcttcagagggccgtctcccttcgtgaacaaatacatgttgtaactcattgcggacattgcctatcaaaaaatgaaagaaaagtcaaacgcttcaaaaacggtatagccttttctaaaattggaggactctccgccgaccttcgctctcttcacaatgtcattctccgcgtattcgtcccatttctccgcctccgcttccacttcggccgtcaacagtttcatctccagcccaaccttggcaattttctgctggtcttccacgtccaaagtgatgggctttgtcggttttgacgtggtcccatggcgctgcaatttctttcatcggttgaattatgcaaaaaccaaaacgtaaaaatttatacgaataagaaaaaacaaattacacaacaaaacacaccgtaacaacagaaagaaggggtaaatacatacagtaggcaaataaaatgaggcagattttgaaaacgaacaccttttacacagcaaaagaatttattgttggctactatcccatttgccactcattttgtccacaaagcactctccgtccatctccccatttctccgcttgttctcactgcctcttccccgtcttctcctcgtccttgcctcccctgttggagtcggatcagactttcggcctcctgctgcagactttccagaatttggctgattctctgctcaaattttctgtccccatgc

SEQ ID NO: 26084 - DNA, 2150 bp, Heterodera glycines
  misc_feature (2124)..(2124): n is a, c, g, or t
  misc_feature (2132)..(2133): n is a, c, g, or t
acaaagtccccaacaaaatgtagccgaatacttctaaaagcaaacaccgatcagctgttagcactggtcgaatttttttaaacattgtctgatcccgcttccaattgactactcgacagaaaaaacgtttaatgcctcatgtggattttgtgcgatgcatgaggagcgaaaagcgagcggggcgcgaaacggaccattgttcagaaaggagcggggattggtacattcgctgccctattgacacctgtactcattgaattagcaaaatcagttgtatccaaaactatataaacaattccctaacaattattgttgaatcattttaaatgactaataaatttattcttgttccacaagaaatttaccgtggtctcacatccgcacctagtacgggggatattaatttggataccgtacggcatgatttggaccgtttcagaggtgaacatgccaacccttctactaaaaatgtccgctataatcaacagcttaggcgctacttacagatgagacgggaggttgcagatcggccatccaaagttgagcttaccaagggaataagtgtgctgttaaaaagaggtagcgaagacggagacggccaagttgtggatacaccaccccgtcctcctggtccccctctcctccgccacctcgacctcgtggtccccctcctccgccaccgccgcctggtcgtccaacaagccctccaggtcccggtccctcgccgccgggaagtcctccgcctcgtccacaacgtcctcctataccaagtagagctgtgcgcctcggaaaaaccgtcgtctggagcaatggcggaaaaggcgatacgatatacaacaaagacggcagccggctgtgcgcgactttcttgcggaagcagctgctgctcctttacccgaaagcgacgaataagctgattacatgctgtagaatggattcgcgctgccagcgccttcacaatactatggtgacgtgcctgtgctacaagacaatgcggatgaaattgaggaaatggacactgttcaacaacgattggctagcaggaggaaactaaaaaagcacgatgatgatgatgattggcaagacaaaaaatacaaaaatttactataaacctccccctgctcgccggcccccgtctcgtccagcaaaaattgaaccaatgcctccaccacgtcctaagaagagagagccacagccaaaggtcgaccctcggccatccacatcaaagaaggccgatataaaacctaaaagggagccaaagtttgagccggatccgcgaccatccacatcacggcaagccgggtacaaccccgctccacctgctcccaaaaaagagccaaagcatgagtggaaacagacaaagcgactccattctcctcctcgcaccgcaccccatcggattccgaaaagagagccagaaattgaagaaacaccacaagagcaacctccgtgcggacctattggaagaacgggttaggcaggacccaattttgtattcattgaccgctccaccaaagagaccatcacagagtacaaccaccaggacgggatcgaaaatcaaaaaagagtttcgcccgaaaaaatggaattaataaatgccactcttgacaaactgtacaacgagccatcctcccccgcgtgtttttccggcgttactgcagtgtggaaagaggagagaaaaaagataaaacaatcaagtaaaaaagaagtgcggaactatttggaaagtcatcgtagctacacgttaatgcgcccccgacgcgtgcacttccggagagcaaaaactgatgcagcaggattcatgacagatgtgcaagtggatttggccgattttcgagcgctttctcgtcaaaatcgaggccatcggtatctgctcgttgcggttgacgtcttgtcaaaacgcttgtttgttgttccgttgaaaaataagagggccgaggagatgctggaggcattcaaggaacttgttaagcaaatgccaatggttccacatcgcattctctccgacaaagggactgaattcaaaaagcaattactcaaaaaatttttcgatgagcaggaaattcagaaacatgagccagtccactcatccgtgaaggcatcagtagctgaaagagccattcngaatgtannagcacgactgtacagat

SEQ ID NO: 26085 - DNA, 1202 bp, Heterodera glycines
tcttttacatttatggtcttttttaaaatcgcgcactcaaattcgaacactttgaataaaagttacgaaattcttaaattttcaacttttcgccttgattcgctaaaatgaatgtagaattatacaaaattcaaaaacctctcgcctttaatacccatttagattacctaattagttaattatcttcaaaatggacatgagtgaattgtgtgcaaaagttaatgcaatttataagaaggaaacggaccacaaagtgcaatcggaagggttcgtttttgggcagaaacactccaatgaatcaagaagaacaaaatgttaccaattcagacttcagaaactgcttgagggggtgctcacctccgtgccgtcggataatttgaagcaaattaccgaggccgtgagcaatttggtcgagactggtcgcattttccctttctttgtgtgcactttccctgccgtcccttttcagtggtgaacaatgagagtacctccatggtcgtgtcccgtcaattcatcgccgacatcgcttcctatttgagtcagccttcgctgaacaccgcactgatcaaaggcattggcgaggccgtgctcactcagcttcatgtcggtttattccgccattttgtcttgatcaaattgctaaaatgcactaattgtccgcctcaggcacgtgcacttgcctacgaggagcagagcacccaaatccgcatgattctggccaatgcgcttgagcgtgaccgccaatttgagcaatccgcgcggactcttatgggcataccaattgaaactggtcaaaggtgggaattcttagaaatataaatacgaaatttcagattttcattttgatttttaataaaacgaattttttatttgaatgtgtaggggctatcgccacgaattcaaaatggaactgtacttgcgaatcactgagctgtttttggaggccgacaatgtcgaggaagcggaccgacacgtgaaaagggcctcacttttgcagcaggacgtgaaggaggaggccctggtcatcaaatacaaggtgtttttcttggaagaactcattttccttgtttgttatccattttttctaagtattttcatgactttcgtctttcaaatccaccgaacatttccttttcaaaattatttaaacttcttaccacttttccccctttgttttggggggtgacctcaggcatcaagct

SEQ ID NO: 26086 - DNA, 1208 bp, Heterodera glycines
gaaaatcttttttggggcctaccaaatgaatgccaggcactgtcattgtttccaaagagattttttatacccagattgccaaaaaaagagaatagccatttttttggcccttcccatacctcacatatactcaaacggcccgaaaatcatttttggagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccccctgtctttgtttccaaaaaaatttctattaccacattggcccaaaaaaaaaatacccttttttttggac

SEQ ID NO: 26087 - DNA, 1361 bp, Heterodera glycines
tagggttgcgtccccgacgtcggggttggaactgtcggggttcggggtcggggttgccaaatcgttcggggttcggggtcggggtttttcaatttttgccttatgccaaatagtcaaaaattttttaatattttttcggaaataatatttattaatttccataataatatttgtattgtttttatattttttttatttcttttttatcagaaattttgtatagaattaatttttttttcttaaaattttaaaattctttattacttttttgttttccaaaacacattttttcacgtcgctcttttctaaagacttaaggagaaagggtacggcgtccggcggtgccgataggcgccgccgggaaaattttgaaaatttggttagatctgttaacagattttgtccaaaatatctaaattttgcgattttgagccaatttttttaataaggtttatgactttttgggccctgtgatgccgataggcagcgctaaattttggaattaagctctattttctaagatttttcaccaaaaaaatttatgaatttcggtaaatttttctttttcttcgatatgtattttgtcaaaatatgccaagattggtcgatttctattatttaatttaaaaaaaacaatttgtcacaaagaaaataattaaagaagaaaacgtcaaacggtatcgaactcacgacagaaagtaatgtcaatgtgatgcactaacctctacaccacattccaaatgtccaaaatcgagcaaattttctttatttaataaaaatttggcaaatggttaaaaaaattcaaattttgtctaacttttttgcattttctcccacgaaaatgccattcttaggggtgtatatttaaccccgaccccgatcggggttaagggtcggggttcggggttgtcggggtatgaagcgtcggggttcggggtcggggttttccccgaaaatggccaaaaatgtcggggttcggggtcgggggcggggtcggggacgcaaccctagtttttaggatgcttaacatgaaagaaaaaagttggaatattttttaaaattaaaattttaattaaaataatggtaaagaaaatgtgaggaatattctatccaagtggggaattgaacccaggcgaaaaattatgaaagaaagtaaccactacaccacatgtgcatgtgtgtaattccatgactaaatgaaataaaatttaattttttctcaaaaatttctccttcttcaccaatttcctactcttttctcgaccagacccccattcttaccagtgcaaatttttaccggcggtaccggtactagacaaaccggtaacggtaatttcatttttgaaaaaaccggtaccggt

SEQ ID NO: 26088 - DNA, 1519 bp, Heterodera glycines
aaaacattaatttccattatattgacactcactaacgccttatttagcaacataacagatacagccgaattacaaattaatgtttaaaatcaaagcaataatgttagagacacaattggccattgtgagtaaatataattaagggggggggggtcggagacgaaagattatgaagtcaactttattcttagttcataaaattttcccatatattttaatttgatttcttaaagattttcgttaaaatgatctaattttgcgatgttgatccatttttttaatgaaaatgaaggtttttggcaccctctgaggaaattttttaaccttagatttccaaaattttatctagtaaattttttatgaatttttgttcataaattcacgaaataaaaggaatgggcgaaaatttaacattaatctttaatttgaaaaaatcttagaaattgtttaattattttgccttacgaagacgcctctctctctattgccccttcgtctccgatcttttcccaaataagaagaatataaacataataattcggatgtgtatttttgttaatttcttatatgtattgtaaggtttattgaatcgaaaaaagcataatcgtcaaagaaaaattgtactttatagtcgaattttaaaaatgtattaatttaggccacagaatcttatattaatcagtgattaattgggaatttttgtggaacaagtataattagagaaagtgataaaatatggagatatcataggattgcacaacttaattgagccttccaaagagcattaattgaaaactcatattcacacttattaaggataaaaaataaagaaatataaagataatttcgctctcaatttataatagaagaaaatgaacggagacaaaacatgaaaatgacaaaaatatcaaactataaaaaattaagaagagttatttgaaataatatttgttagattttgcttgtaaattagagtaaaacagtacttgcaactttgaaaatcgatcttgacctttatttttatgatattaacaataaaaagaatcagatgaaaaatagaattatgaattgtcaaatttaatgacagagataatgcggcagaaataaagattcaattctggacgaactcgaaatgtaaacaaattattctatcagaatggctttttttaaataagcaaagggcaattaactaacaaattaattaaatgattgggtatttccttaagaaaaaaaaacaaaaattataagagcagaccagaatactaataaagataaagacaatttcatactttctaaaaaggtgggatttaaatattattaaagaataaacaggagggaaaggaaatgacaatgtgtagatggataaaagttgttgtggtcgtgttcaaaaataaaacaaaaaatgagcactattaaaataaacaccaaaaaacaaacaacaaaaagcgtgctaatacaaaatgcttgtaaacttttaagccttgccttaattttataaatcattcataaaataaattta

SEQ ID NO: 26089 - DNA, 982 bp, Heterodera glycines
tttttgtaacaaattctctgtcccatcattcattctttcgtcactgaatttgctttcaaatgaatccgatcattttgctctgatcagatcagcatccgatcaaattccatcggctcaatttgactgttcccattgcggtccatgtggccaaaccattcgccgttcttggccaaatggctagcggatctgccgttctttgttttcaccaaatacgcaatggcttccttcatcgaaatggtgccgcttttatccgcatcgatctaattaaataaatagctaatgtaaaagctaaaaattaatatgcttacgcctggttgattcatttataaattaccgtatcaaatttttgtcgcaattgtttcacctcctccaatggatgcacaaatgttgagttaccaccagccctaacaaattgggttaaatgaagaataataaatgtataatggaataaaacaatctttgtcttatctaatgcctatctcctcaaattatattaaataaattttttctatactatggtaaaaaaaatgctttagctttagatgaagctttattcgtggttttctatccatattttccatattcaaaatttatgtccatatttccatattgtgcatgttttggcattaaaatgtcaatcccaaatgtggagccctcatatctatggtcctcaactgttggaaaactcaaatttcaagcgctaggacctcaaaatgtcaaatcttcaaatgccgcaccacatctctctatccatactgtacctgctgcttgcgagacgggcatttggcttattgttctccggacatccgccctcgccgtccttgcggcaattttggcacccttgcggacagtctttggcatattgtttctcgcaacagtagtaacagctgcacgacacatctagtatacaatattccttggagcgatcttcgtgagtgagatcaaacgcgcagaccagacagttattgtggaaaatgttgca

SEQ ID NO: 26090 - DNA, 922 bp, Heterodera glycines
cgagctgagactcgagacctgaactctacgagcgtcattagtgaacagtcagacgacggacttggaatgttcggctgctttgcgcccatttctaatttgcagctcggctatttcggaattttttgcttttgtccgtttcccaaaatatccgcccccttcctaggattttaagttggagggtgcctaagatagaaagaaatctagacttctatcaaacagacttaaatttcgccagtgaaactgcctcaaatttgaaaatataataattattttggcgaaatgcctttaatccaaagtttgcggtttgagatgttgcacaagcgtcagattgaaaaagaaaagcttcacaacaaatataccaaaatttaattttactttcacatataaatttgctatcgaaatttataaagttaacaaaaaatttatacagtttagaattttttccatttctttttcaccttgcaagtggaaaacataccgttattagattttcagggtcgctggtctcgaatcaggcatccatttcaaacaatttgcgaccctggacccgatctcgagtaaaacccagaaattcacttttcactataattcagagcaacgactggtgaactcgattataggcatttggcgacgcttgttatattacacaaattttgaaaagtccggttccggcgggtgcccggcaaaattttgaaccgggacgcccggtaaatgggcgtttcttgaacgggcggcccggctccggtcaattgtctgatcccggttccggttccgctacttcggtctctacttactatataagcatttatgaaaattaggttttcaaccaaatatttattcaaatatatagtttcaaaatctaaatcacgttagcaattatttaattgaaccgttaaaaaataccgaatccctaaaactcgaa

SEQ ID NO: 26091 - DNA, 1615 bp, Heterodera glycines
caacgtggtttgctgacattccctacggggtttatgtcgtacaaatatggttcgctgacaggcccttcgggcttttgtcgcgcaaatgtggttcgctaacagggccttcgggcttttgtcgcaccaatgttgttcggtgacaggctcttcggggcatgtcgcactcattctgcactcttgtatgggatgtgtgagtcgatccatggctgatggattcggcgcgacgactacacattgtggcaaagaaagatgtctgataaaattcatatgtacatttgaataaattttatttatgtgtgcattattggttaattttacctcatatttttgccaccttttcatacatttatcattttgttgtttaagatgccttcaaaacaacataatttacgtatgaagatgaaggaggaccgacggcggacggagaaatctgtcagcccaggtcgctcacccgtcccagacgggagtgcagatgagaatggggtggtatcacacccgggcaacgtaacgcccaatattggtgctttgcaattaagcaccccggcttcttcaattggaagtagaagaagggctagaccctcaaacgccggaacggagtcaattacggcttcgcaaaaaagtgcgtcatcagttgacacacaaagcatatctcaaaatgccgaatccttgccgtgcaaaaagaaagcgaaggttgatcaagcagaccaaccaaaaaattatgaagcaattacttcaacgcctatttccacgcaaagaagctgtggaggacggccgaccaagatgaggcgcggcccaggcaggagcaaagctaatgattccatgaacgagagctcgtcaatgaatcagagttctgaagctattacaaatctgatcgttttgccaaatgtgactgaaaagataaacttcagcacagtgcaaattaagttcgccacatcgcgaaatatggcatgcaaaattcggagatgggccgatgttgggctttacgagcgtgatggcgaaacagcacaaggcccacgctctggcccaagattcattgagacctgttggaatgatctgacacagtttctaaatgatgcctttgttgtcgagtatttggcatacttggcaagtatatcacaacgaaaagtggtcgttgttgatccagttgtgtggcaaatgggcatagaccgggtcatgcaatataaaaaaatgacatttgggtatgaccctaatgttccggcagaagtcatacttttgccagtacatttccctggacactggactctaattatccatgatgtgcaatttggcactcattttgccgattctttgcctaccccatatggcaggttggatccgcaactgacggataaaattagaaagattatttctgacattttgccgtcaacagttttaaccgggatttttaatgccgtaaatctgacggttcaacacgatggaaatagctgcgggtactttgtgtgcctgtatgctgaatcctggctcatgaacaatcgcacgtttgttctgccagatctgtcgatcaattatgaaaagcggcgcatattgtggcacattaacgagctttatggcacagataatgtgccataccatccgagggaaggggtaccaactc

SEQ ID NO: 26092 - DNA, 1555 bp, Heterodera glycines
ctttttagctaaaccattaaattattgaaccttaattttaattatttcgaaaaaacaaaatttaaacaaatattttctgacctgcataaaacacgtccatggcattgtctccgtctaattcactcaaatcgtccgtgtagatgaagctcaacatcactttgaatgcattggcactaatgtcagggatctctaccggacctttaggggggggggggggggggtggtacttgtattttcgggaatacggtatgttgaaatagcataattgtacggaattaatcactcatcaaccacatgaaaaaagcgaaacaaaacggtcaaataaacattaatttctaatgtgaaattattttgtctattttctatgagaacgaaatcttattcgttagtggtgtaaacatagaagggatctcaaaaatagaaattcggattcgggacaagtttaggattctaatttaaaagttttaaattttaacaattaaatcttataagcatggttttgtcatttcaagcagattggccttaaccgcgtcttaccattttccgttctttcgctttttgagtcaaaatcaatcattgccttaaatacgtcggaagatccaataatgatgactttgtgagcacggaaaagcttaaaaattcagaaataaattcatagatttaaaatatcccttttgaaaactcgcctcctttccctctccttcccccacattaaaattctctttattttggatccctaatgaataagtgaaaaaattctttttgttcttcaaatgtctccatggaccacaaggaattccatttttgtacagaatttatttcagccaaaatccaagaaaaatattaaagaaattaattaaaattaaaattctctttattttggatccctaatgaataagtgaaaaaattctttttgttcttcaaatgtctccatggaccacaaggaattccatttttgtacagaatttatttcagccaaaatccaagaaaaatattaaagaaattaattaaaattaaaattctctttattttggatccctaatgaattagtgaaaaaattctttttgttcttcaaatgtctccatggaccacaaggaattccatttttgtacagaatttatttcagccaaaatccaagaaaaatattaaagaaattaattaaaattaaaattctctttattttggatccctaatgaattagtgaaaaaattctttttgttcttcaaatgtctccatggaccacaaggaattccatttttgtacagaatttatttcagccaaaatccaaggaaaatcttaaagaaattaattaaaattaaaattctctttattttggatccctaatgaattagtaaaaaaattctttttgttcttcaaatgtctccatggaccacaaggaattccatttttgtacagaatttatttcagccaaaatccaagaaaaatattagtgtttgtggagggcgttggggaattattggaaaatgtgctcgtttgatggggattctcatttgttgttttgcttatcgggcggcccgggattggtgggttttaa

SEQ ID NO: 26093 - DNA, 1528 bp, Heterodera glycines
ttgtggttgtgcattgtgacttaatgtaaaagaaaaatgtatacagtatacggcattaaatacttttgtttgcgtaatttctacagaaaattatatgaacgaaatctatgatatgtagtcacatgaaataaattttacaagatttagttctggcgtaatcaaaacatcttttatttcaccagtagtatttttgatggcctcggtgttggcaaacgaagagcctaggaaatctttaccctcagtatattccatttttcctgaaaaaaatatatggttaacaataagtaattcagaataaattcagcatgaaaaattcatttgagcaataaaggcgtaaaaaacagaagacgccatgccaggtgatttcgacaatacagataatttttaaaaatggagtacatatgatttgtttgtccccttttcgggttagtcaatgcgttaattgacttctgtcaattgttttacaaattttttttcctttccgggagtttgttaattttttcaattctttttttatttatttttcccggtgggttttcttattttggctcgtccttttgagttgagtttcctccttcccctcccattaaagccaaaagtttggctacgccattacctctattacttagggtgtaacataagtttctgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaacggcatttttcaagaccatcaaataacaaaatgttttaagtggttttggaaattccgaatttaattaaactaagtaaattgaccacgctgagtccgaatatggctcggggtttagatttagagcccggtttcgggttccccgggagttgcggaaatgggtttagaacagggctcgtatccgtccttggatgccaaggacgtcctttgaaatgagcatttaaaaaatggaagaaataatcaaatgaaatttgacaaatttttgaatttctaacataccgcatttgctctttttatccccccggggggattatttttcaacctcctcagaaacggggggattattagatacggggggaaaaagggagaaggggggattatttttcgacagatttattttgtgtaaaatttttgaacatgtcgccaaaaaatgtcatcgcgtcaaaaaaaataaaattttttgaaattttatggtgtaaactagagatcggtattttgaaaaaagcctggacctggatttcctggacaaaaatccagg

SEQ ID NO: 26094 - DNA, 1887 bp, Heterodera glycines
  misc_feature (43)..(43): n is a, c, g, or t
cattattagtgcaaaatctggtactaaattgcacaaaaattcncaaatttttttccggcggcgtctatcggcactgccgggatctctctttctatttttttaaatatgcttcaaaaaaacccctagaaataattgaaaaaatgaaaaaatattgggaaataaaatgtgaatatccaaaaatgagtgagtgacaaagaagttgctaaaatgttgaaaattgaaagaaacaatttgtggacgaaatgcagcagaactgaaatcattagcatattaatctagatttgttttttgttttttttttgtcatcataacaatgggagggattacgaaaatttttaaaattaaaagttgtcaaaaaaactctaattaattaatttttgtttcagcttagaaacaaaatggataacaaaaagaacaaataaatttgttaactcaaatatcaaacaaaaaagcatcgctttcgtcctcacacaaatcgatcttttaaatttccataatattcggctgttaaaagtccgggttaatttcaaaattttttgtcccgttaagcaatgaaaatcaaaactaattttattagccgtttctttggtttaccgtacttactaattagtaccccccggggcttctatttttcaacccccctcgagggggctattctaatttagggggggggggggggttactaattcagtaaatacggtatattgattatgaacatttcaccgcaacatgtagaaaccgtaattttgaaaaatactgactcggaccaggttctgaatatccgagttcgctggcaccggcctggcttagaacaaagcccggcgggcatatttcaacttcgagaaacaaattccgacaaagtcaattaaaaatggaatgagtttttcaaacttgttctgattttcacatttgtcctgagaaaaggaataaaatgacgattttttttgttattataattaatgtaaaatatttctgttttggatgaaaaatttgttaataaatgtcctgattttttatgtttgtactgacttttttataatcgatccaagcaataaattctcatttcttcatttaataaataattcataaagataaaatttcctttttttgaattgtaaattattagaatttattttatttttattgaaaatatgtttattattttcgaatgagctccagtagaaagtaataaaatttatttaatcattaatttaccaattggcaattattttgtcattaagataaaattattattattatttctttgaaattaaacaggatttccttattttattaagtaaaataatgatttattcagttttttaatcagaaaaaaaatcatttaaatgcctcaaaaaatgaattgcatttaattgaagaaaaataaaataaaatcatttccagacgacaaaaatgaaattatttccgctactattattaattattttatttttaattgacaaaattggatcagaaaggaaaaaattgcaacaaaagtcatttggcgaaatatttggagaaaaatggcaagaaaaagaagaagaaaaacgaaatgaactcaaaaaaagagaaataattgcaaaattttataaaataaaagagaaaattaagcaaaaaggaagaaaattctcaaaaaaagaatggaataaaattaatttgaaaatagcaaaaaaattgggcacaaatcaaacatatattcaaaaatggattaaacaatttggtcttcaaaaaaataaatgctataaatcaaaaagtgatgaagaaaaaattgtaattgtgcaaaaatttattaaaatggcaaatgaatataagcaaaagagaaaatattcagcaaaagaatgggaccaaaattaacgcgaaatttgtaaggaaattggagttagtcaa

SEQ ID NO: 26095 - DNA, 1206 bp, Heterodera glycines
aaaattaaagcaaattaaaagaataaatttccccaaaaaatcgaaaattaaagaaaaattaaaaaattaaatttcccaatggtaaagaatttcatcacacctttaatactagggatgccattttatgaattaaaatacttaaaaaaaaatgatttaagacaaaaaactcaaaataaaagtaatcataaatgttgggtgaaaaaagtaagtcaaggtgccaatttgtattaacaatttcaggcaaaatccaattatttctttgctaaaatgtggttttaaatcatctaaaatttacttttcgtttttaaaattgaagagacccaaaataaaatggcataactattacatatgcattaccatcaccattcaaatttcactccccaccacgccacccactattcctcgtccattggctcctctggcccgtgaacccgcgccttttttgcactcggcagcttttccgttgtcgcacgtcgacgaggcgccagaaaacggcgtccgcacaccgcgcatttgtttggcggtgcgcggacaccgaatgggttcgcgaaggtcgagcatgatggcagcggaagtggcgccggtgccagcggcggaagagcgagtggcgcaagtactgggctcatttgcggcggccgcgggcaaaacggcgccatgccgatttgtggcggcgacggtaaaaacggcaattgtggtggcggcggcgggaaaaccggcaattgtggtggcggcggcgggcaagacggtgccaaagggcgcggcggcgcgaccccttgaggcccctgaagttgaaagacacataagatttcattattttttgttgtttcgcaaaattttaccgcgtttcgtggcaccggcaccgtccacactatcatattgttgtttcccatttcgttcacggcaaagttccccgagaggatggagtcgcggatgagcttcatgtcttgctggagtttgtggagtgcgatgattttttttaaattttcagtcagctgctctcggtttgcggacatgtttattgctaaaaaaatgccaaaatggaaaaagtctggggaaaagtcaaaaaaagtttaaataacaaaaaaaattcgacagtacactttcaaaaaaaacaaacaaacatacttaggggaggcgctctttgaaagatggccgggtttggcgtgctaactaaacgccgtccgccttttcaatcgtgtaatctgg

SEQ ID NO: 26096 - DNA, 2124 bp, Heterodera glycines
  misc_feature (1696)..(1696): n is a, c, g, or t
  misc_feature (1851)..(1851): n is a, c, g, or t
  misc_feature (1862)..(1862): n is a, c, g, or t
  misc_feature (1889)..(1889): n is a, c, g, or t
  misc_feature (1958)..(1958): n is a, c, g, or t
tttttgttagcagcttcaagtgtctcggcgcaaatggcccggcgcaaatgtccgcggcgcaagagtcttttttgctgagcggcgcaagtgtcgcggcgcaaatggcgcggcgcaaatgtccgcggtgcaaaagtcggctaaccctattagcaacacatcaaaaaggtttagatattaatatttttaaaattaaaaattttttattgcaaaaatttgaattttaattgcatctaataatttcattatttcaaaatattttttccttattatttttcgttataaataatatttttgtgagaataataaaaaattaataatttttatccatacgtcttttgcctttttatattcactttataccatgtatagttccttggcgcggtcgccagacttaagctttcccattttttaagcgctttctcgatccgcgctgaaagccgaatttatctttggtgtctccgtcgttcttttttggtgcttttttgctgaattttggcgccatataaaaatatcgaattgattatggaaaaacaatttaatttatgggcaatttttagatgtatttaagttttttggcctttaaattccaaaagggaatattgagttttaatttcttttcaaattattcttcatctttattttaagcatatttttatttttattttgtaaattattcattgtttcttttgtgaagctgtcttattttttaaaaacattttcttaattaatattctcaatttggtgggccattcaatcttttttataattattatttattttttatattgtttatgttaaaattttaaaatatattcaattataaaatgtacccatctctcattattattaaaaattgctgtaaacataatttgtttaactgtaaatttcttataaatctaaattttaaaaattatgttttttttgtcacatttatttttgtttttttacctaatgattcattaagaaattattattatttttagaatttgttaattaaaaataatataaatttatagaaacattaaaataatatattaaaatcagttaaatttccaatctttttatttttcttgatttatctgcaatataagcattgctaattttgaataaaaatttaattattccattctataaccggaaaaatttaaaaaattatttgataatctgtagtttaagtaatatattttaattttatcatttttgtatttttttttggtttttcggttttatttattttataattgcattgaaatatgcttaaagttgatatatgttgtattcttttttttccactaacgacggctttcattgtcaatatttagttcataatgataattaatttatttaattaattgttttttattcacgtgttttctaattgcttccttttattattgaattcacacgttacatatatttttttcttaagctgtttacgcacccttgctttcgaacgtagtaaaactgtgaaaaatacattgatgaataatattcattaattttcttctataaataatagatatattttctatcaatttcatatttgaatttttctataatatttaaatgaaaaaaaatttaaacaaatcaaataatttttattaaatcaatttaagtgcttaatttgctttattgaagtagaaaaatttaagtaaaaatgaatttgttattaaaacaatttttacaggctctcagntgttttttattcttttttgcttttttatttttatataaataaagataaattactgcttaaaataaatccttttaaaattaagtttgtattgctttttattggtcaaattggcataaatatttgtgctttcctctttcctaattttatttttgacnataattagatnattttttattcttttttattattgaantgataaaattttccaaaattaattttttaattatgctgtaaataaatctcttatatttaaacaaataanatattttttattaatcaaattaaagtgcttattttgctttattgcaggagaaaaatttaaggaaattttatctccaacaaataaatattgtccttattaaaaggaaaaaattggattacttaaaactttttaggggtaaaaaaaaataattaaagggggttttttt

SEQ ID NO: 26097 - DNA, 1238 bp, Heterodera glycines
gggggggctcccccgaaaaaaaaaaaaatcgtttttttcaagtgtccgtttgggggtcttcaaacattttggggggcaaaaattccaccccagaattaaagtccgggtttaggggaagttttccggaaggattcggtttccccataaatctgggggcatcggttcgggggggctgccccgaaaacaaaaaaaatcgattttttcaagtgtccgtttggggttctcaaacaattatggggagcaaaaatccaccgcagaattaaagtacaggctatagggaagcttttccggaaggattcggtctccccataaatctgggcgcatcggttcggggggactgccccgaaaacaaaaaaaaatcgattttttcaagtgtccgtttggggtactcaacaattatggggagcaaaaatccaacgcagaattaaagtacaggctatagggaagctattccggaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcaaaattaaagtacaggctatagggaagctattccggaaggattcggtctccccataaatctgggcgcatcggttcggggggactgccccgaaaacccaaaaaaaaattttttggataaacaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgccta

SEQ ID NO: 26098 - DNA, 1437 bp, Heterodera glycines
  misc_feature (23)..(23): n is a, c, g, or t
ccagaatttttcagaacgattcntggtgtttactagaacttcctgaggcattctgacgtttaccagaatttttcagaactcttctggtgtttaccagaattttcagaaccattctgacgtttaccagaatttttataactattctggtgtttaacagaattttcagaacaattctgatgtttacaagaatttacagaacattctgacgtttaccagaattttcagaacaatgacgcttaccagaattttcagaagaattctgacgtttaccagaatttacagaaccattctgacgcttgccagaatttttcagaactattctggtgtttaccagaattttcagaaccattctgacgtttaccagaattttcataactattctggtgtttaacagaattatcagaattttaaaagcacatttgttttaataattaactcagttaaattttttccaagttgagacgcgtacaagattgatatgttgtgcaatggatttctggtaaaaaatcacagaatgttaaatcatttgtaaattagttttattttttgttggtaaagtaaatagttttatataatccttattttaatttgtcttattttttatctcaacacactttaatcgttttaattaggaatttttttttacataaatttatttatttattataaaaatcaaaataaaagctttttttcactatttattctatttggtcgctttgtttttgcctagatttcatattagagtgctcatatatttttgaacaacacacataaatcaattcttgatttaattttaatcgctatttattaattctttaattaataataaacttttttctttataaaatataaaaatgaatgtttttaatgtttatttgttatctttgataaatattattagaaataatgtgtattaatttttctctcgatatattaaatttttattgttcaaatgatttgttttaatataacaaaatttattatataataagaaatattaaaaataatattaagactttatgttgattatattttatcattttaattaaaaggaaaccattttatgtccgatttaaccttttttaaattgcttaagatcttcaatccgagccattcgacttgcggggttggggggtcttccagctttgactgttgtgaaaattataaaaaaattacaaaaaaccgtttaaattgctgctttaccaacagacgttttttaatatattatttctattgtaaagataagagttacaatttccggtagctttcgctctagttaaattaagattctctcttttcatttttaatattttatttatattttattggttttatttttatcattttaataatacttgtggtacattgggttagagtagttaaatcgacgaatagctgataaataattttttaaacaatttggtgtttatattattt

SEQ ID NO: 26099 - DNA, 2172 bp, Heterodera glycines
agatcacctctgatctctggcattgaagatgcggtcctgactcgacacttgaaaaccaccaaacctttatgacctaagtaccatttcataattttctttttctttttgcttatgcttgccccaccaataagcctaataatttgtatattttggctaataaaaatcagagaggggaatggaaaatttttaactattttaatttgttaataaatccttccaatttagtcgggctctgagccttacgctttcgtggaatttgtcgaccattacacggccgcccaagcgcttcagtcgatgaatcggcgcctacttttggacaaagtcgtcattcatttccatttcatttgtcatttttctgatttcaggagatgaaagtcaattgggccattcagccgggcactcagcagaaaatcgacaccagcagttcgttgctacctttttaactataaaaaagaaaagccgccttttagaacatttccacatttttgtcggagatctttcgcccgaaatcgacaataaaactctcaaagatgcttttgttccgtttggagatgtttcgttagtcattttttaaacatcattttcttgtttgccggtctgaccacaattcggttttagggactcaaaagtcattcgcgacccgaccactttgatgtccaagggctatggctttgtctcttttccaaagcgcgaggaagcggagcgtgcaattgagcaaatgaatggccaatggctggggcgaaggacaatccgaactaattgggtaaacggaatacgaaagatagcggactctttcacggccacccaaacgctaatatttgaaggccactcgtaagcctggcgcaatgggcggtggagttgaatattcgagcaaaccgacggtggacgaaattatggcgcagacgagtccagaaaacacgtccgtttatgttggtggtgttcctcccggtgcgacaggtcgttttaccattttttcaatggaaatttatcatctttgtcgttcagaggaagacatacggtcgactttcagacgattcggaaacatcgtggacattcgctactttaagccgcaaggatacgccttcgtatgttccaaatttttttgtgaaatattttcctattctgtgaaggtgaaatacgagaccaaattggccgccgggaaagccatccacgaaatgaacagcaacgaattcatgggccaaacgcttcgtctcaattggggcaaagtcgatgtgagtgggtggtccagggacggtcccaggattttggcttgggggtcttattttaacataatgactgaaattaaatctttctcacaaagcagtgccggattaattctccccgatataatcaagttttttgttatttagcaaaaatgtcaaatatctgggaatattctccaccgctgggttgattgtgacagatctgagaaaacgtttattgcctgagaatgtggacaaacttttatttttgcatcacaatcttaaaatttatgattttgattatgaataaaatttttgggaaaaaattatttaaaaaaaatcggaatcgtaatcggaatcgcaattaatcggattttgggccataatcgtaatcggttttaaaaccgtatcggatttttggccataatcggaatcggcgatttaatcggaatcggattttgtctggctcggcacatccctgatacatagtattaaaaataaataaaatgatgatgcaaaaaagatttagtgagcatctatctgatcagtgatcacacttcggataactaattgggaataaattcttactaaaaactttacatcaatcaaaattttatctactaatataatggaacatacaatacacaacacatagaatacagcagtttatggttttgaaatagataatctgatacatatatacatatacatacatctactaatataatggaatagacaacggaatacaacagtttacgtagaattagattatatcgatcatatgtcttatccatcacattgttgtttcatcgcattggttatgttttgttggcatcagcatcgttcccgatttcgtgtctgcttaagctcagtcgatggcacattccgtgaccaaataatcatcatcatcatcgtagtcgtcggttgaaacagaagcacacacggggcacttctttttcagcaccgaatt

SEQ ID NO: 26100 - DNA, 261 bp, Heterodera glycines
gaaaaagagcaaaatgttgaggggggggggaagaaaaagagcaaaatgttgagggggggggaagcaaaagagaaaaatgttgaggaggggggaagaaaaagagcaaaattttgaaaaatagtgcaacagaaacaattacatatttaaaaaaaattaatgttgaggggagggggaagaataagagcactcaacattttgctctttttcttcccccctcctcaacatttttctcttttgcttccctcccccccctcaacattt

SEQ ID NO: 26101 - DNA, 2651 bp, Heterodera glycines
ttttagccgccttttttttgaaaaaatctcaattttcggctcagaattcgattaattagtttaaacattttttttgtttttgtgcggggtggtgggtgattaggcacaaaaaatgaattaaaaagcaaatttttttggcattgaaatttttcaaaaaaaatatacacagagtacggtaaaggttatgatatgttcggtacagtcccaaaaacagcaccataaacatttagtaattggtggctgaacggccgtatcggtaaatgtcgacaggaaaatcttttttttttaaatttgggcattgtcaatatggggacaattttgacaaatgacaccgcaaattgccgtccgtattccttcgtgccgcttaaaatattaattagtattttttaatataattaaatttaattaaaaaaagagtttgactctgtgtttttagctttgcccttccaaattggccatttaaatggaaattaatgccaccggcactttcctaaattacaaaaaaaaaaaaattaatttcgaaaatgatcgatttttttaaggcttttcatcaatccgatcgatatgcacctttggcacaggggatatttgtggttgcgggggtggaaaaaaaatgccgggccccttttaccgcatattaaaagggcttttcaagactttggtggcgatgtgtgtcttttggtgggttgcgtgatgatgccaatgtcattattattatcctatatgatgtgaaagtgccataattcgatggcaaatgaatgacgctgaggacggtgagcaacaaatccgcccccggggaaagatcggaaagtgccaatggcgggggatgagaggcggcattttcggtcggatttaataatgccagataaagcgaggccagactagctgaggaacttgcatgaagcataaacaaaaattcgtaaacaccattcatgattatttttttacgatttttgagagaaaaaaatggaaatttttaacggggcatcctatggaggcctgtcggtcggctgttgctgtgattttaaaaattttgcattgttggtaaatgccaaaattattaaaaaaataaaataatttcctggtataaattccaatgatgagatatatggaaaatgccaatcacatttttttttacattgccataaaagcttataacacaaaagcgaggtcaatgctattgaaatttagtaaattcaaatttttcagaaatattaaaaatttttaaatagaaaaaagctaatccatcggtttttaaatttttacattttaaaatgcctaaaaaattattttaatgaccttttttgcatgaaaattttgtaacaaaacatttcttcgaaactttctcaaaactaattatttttattattattcggggagcagcaacagacagaatggtgctctctggttgtttgttacattttggaaacaaagttcaccccaactaataatacaaattttaattgggacacaacggcacaaaaaaaaattgagccctcggaggcattcggccgaaataaattaaaaaatggaatttaaggagcaaaaaaagcgggctaacaaaaatgagaaattagaattttttttcatacttttcattcccttttaaaagaaaattaacaaaatctttattatatttttagataattttttttttgattaagaattaatttgcttttattaaatatattttaaaagaaattatttttcaaaattttaaaatataatttttttaagtttaataatattatttttttttggattttaaagtaagaaaagtttaaaaataatcattttcttgatctcaaactgacttttaagaactatgacaaggactgtgcttgccattttcaaggatgaatatgtgcaaatttttaaattgaaaataaatagcaaaaaaaaaatttaaaaaaaatttgtcaaaaagggtgtattaatgagaaaataagagtccaaattaagtggatggaattcgttggagaagatgttaaaaatggaataaacaagaagcaattaatgcacaattctttgaaattttttttttgtgaggaattccattttcttagaatcacatggatttccaaaatttgaaataccaatttagggatttcaaaaatcaaaattcatagtaaaacagagatgggagatctctcaaattttttaaaaatttgtaggctttatttgaggtagcagcgccgaaacttaagaattttaaatgtacttttaattttttggcggcgccaccgcggaaccccgaaatttcctcttttttccaaatttaatcaaaaaaatctgattataactattttttggctaaaaccaattaataaagcagcaaatttccatggtttttcgcttataagcaccgctgttcaatttatgataaagaaattggactcaaaaattgggtctccacatgaataaagtcaaattctgtatactcttagattgcaaaattacaattaaatctataaatgtcctttttgtttaataaaaatttctgtctcaaatcactttttaaccacttctatcgtgtagagcttagtcgatttactattgtaaattttcggctttttttttggctccgacgccaaaaatgatcagaaaaagtaatgaaacgttcgaaaaatcgataaaaatgacaaaatttt

SEQ ID NO: 26102 - DNA, 2839 bp, Heterodera glycines
  misc_feature (2789)..(2789): n is a, c, g, or t
gtcggcgagtcaaccatcggcgagttggcgtcggcgagtcgaccatcggcgagtcggcgtcggcgagtcaaccatcggcgagtcggcgtcggcgagtcaaccatcgggcgaggtggcgtcggcgagtcgaccatcggcgagtcggcgtcggcgagtcaaccatcgggcgagttggcgtcggcgagtcgaccatcggcgagtcggcgtcggcgagtcaaccatcggcgaagttggcgtcggcgagtcgaccatcggcgagtcggcgtcggcgagtcaaccatcggcgagcgagtcgaccatcggcgagtcggcgtcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagttggcgtcggcgagtcgaccatcggcgagtcggcgtcggcgagtcaaccatcggcgagtcggcgtcggcgagtcgaccatcgccgagtcggcgtcggcgagtcgaccatcggcgagtcggcgtggcgcgttgaactgttcccctagtgcatgtatgtttgcaaaatggttaggacgctaagactcattttttgtctttatgctatttttaaaaatatttcattttatcataaaaacaaatttgaatatttatttattacaaaattttgaaataattaatattttttattgcaattaaaattaatatattcatctgattttatttaatgctcatcactaaaatttagttatttttttagatttgtagactaattttgagagttaattgttttacgtaatgatttgcatttgaatgattttgcatttttttaatcagaattttttataggaaattttttctaaatttactttatcaggatattttatttgcttctttctttgttcggctgaataaatgaatgttaggaatattgtatttgaaagttattaaatttatgcttttgtttttaattagatttctgtttttattaattaatagattttttaaaaattctctttgattaaattacggttttagttataaattaaatgttttttgaatcttttttattatttttttaagtttgagatatttaaattcttgaattttctcgacttcacgatgaaaaaattcaatttattgacgtccaactgcgatcgaaataagctatattataatatttttaatattatttttttaaaattaaatttgtagtgctataaaaacaattatttacataaaaatttttactcaaataattttcacgtaattttttctagagttcttggaaaggtgatatcagaatataattttaaaatttcttacaaaattgaaaaaaatttatgtaccagaaattctgagtcaagatttacttggacaaaaaaaaattttgttttcctaccccttagcggatttaagaaacaacctagcaccaaaatcttttcaggattggatttttgaccgattagtttctttgaaaattaaaaatgcaataaaatttttagaattttaccaaactttttatagaaactaaaaacaaaaaacaaaactggaatttttgaatatttagcaaataaattatttattaattcaaatatttaaaaacataaaaattattttaaattaatttactataaaaaattattgggtgcagcacatgaaatgaacccgataacgggaatattgcatggaaaaaattgtacaaaataagtaattaaaaattcataaagaacaaatgaaaaaaagaaatttgaactttatttaataaaattaaaatatatttaaatagatgaaggacaagtcgaatgtgaataggaaatcaattaaattaaccgataattaatgaaaaatttaataatatattggggtgttcggaaagttctttcatagcgaccaaaaatttatttaaaaaaatcgtaacaaattaactaattaaccaattttaatcaaaatatgctccgttattctcgaccatcttctcccatttttgagattttaaaaataatctatcgattaaattcaagatagttagactcaaataaactgatcggtctacttaaaaaagtggccaaattcaaccactgatttcttggccaagaaaaggctaaaggtgcaaaacaaattatggttttgtagagcaatgttgggactatctgacaagctggaaaagagccaccaagaccgatgggttatttttttaaagttgtcctgtctgaaaaaaatgattaatatttatccactaggttaattaaataattaattaaaataatttttaataaaacaataaaataattccaaatttaaaaatgaatgatgagaagatagaagagattgaaaaatataaaatgaaaaagtaataatttcctaaacaaatcttcaaaacacacggttaagtggttgtttaaaatatatatttatttcaaaaaactgcgtataaagtaatcaatatccgaattaaacaattaaaaataactttttataaatggaaatttattaatcaaatccaatttcaaaataaaaccaggccaaattgttattaatcaaaagctctttgagctatgtctaaaaattagttaaataaaaaaatgtaatttgaaatttgtcaatttctaatttgtaataatgaaataaaaaaataattgtaaaattaatatatgtcttcgcttattgagatgcattaattaaatcgaaattttgaaatttaagtttttatgaagaaatggtatatttaaataactaatatgaaaataattngcagaatttgatgggtattattgatttttattagaaatgccataaatttt

SEQ ID NO: 26103 - DNA, 1717 bp, Heterodera glycines
catggcgcataaaataatttaaggccgtacagatcttaatcctttattaaacctttgtgacatttctttttataatttaaaacaaaataattgtgcaaaaatccattcataggcggaatgcaccgctaaaattatatttttattaattaatcgaacaaaccgccagatgctaatgcactctaacagtgacgtaaaaaaggaattaaaaccaagattaatcataaatggtagtcaaaaatcacaaaataagtgccatattaaacacaataaaaataaatcacgcctctcaatagtgaaaatatgcattagtgcttattatttcttttgcaaaagccaaaagaatgttttgtattaggatttttaaaaaccagaaaaagccctgaggggatgcggagaagcctgccaattaacgccggcttaatttggaaatttcttttttttaaatcatcgataaaatataggataaaaattgctgacccccccctccccacctccttccttgtgaaatgtatggtaagtatgatgacatgaatccatgatcagatcatcccttcttggtgatcgcgatatttttttaatcccgtttttcatcgaaaggagtccattgtcaaattacttgcagattttcacaatttttctcacattaatccaaatcctggtaatagtaccgatggtagttcccccttttgaaaaaaaaaatttgtgatttcaaaataattaaaacaagtttttaggggttttctgggctgctgatcacgaatcttgcgtccatttcgaccaatccctaaacccggacccaaatttgaacaaaaagtcgaaaattaaacttttcgacttttgaatttttggttcaaaaacggcttaaacacatagaaacaaactaaaagtcatcaatcctgcaattatagatcaattaaactatttttatacataaaaacgcaaagttcgaaaagtttaattttcgactttttgttcgaatttgggtccggatttagggagaccaaattcaacattcttggtatcattcgaaagcccttcagatgcactattagcctgcaaaattccaaaaaatttcgttcagtataaaaaagttcgaaaaaaatttcgttcagtataaaaaagttcgagccaaaaaaagttggaaaatttggtttgttgaactcttctgaccataacttttttgaaccttaacggaatttttccaaattttgtaggctaatagagaacacttagggctatcgaatgataccaagattattggatttggttgacaaagaaaaagttatagttcaaaaactcgccccacgcgaaaacgaccccgacccaaaaaaaaatgatggaatgaagtgaaaaatgcgtaactttaaattttaaagtagaggaagttagcggacagatcaaacaaaaagacatttttatgaacacttcataataaactaatcaaaatatttatctaattcaaatcaaatggatcaatcacatcccactaattcattcatttctgtggatcacttgggcggaagtatttccgtcgttgtgctgatcacttgggccgggagtagttccgtcgttgtgctgatcacttgggccgggagtagttccgtcgttgtgctgatcacttgggccgggagtagttccgtcgttgtgctgatcacttgggccgggagtagttccgtcgttgtgctgatcacttgggccgggagtagttccgtcgttg

SEQ ID NO: 26104 - DNA, 2725 bp, Heterodera glycines
ctttttcattctaacaataagaattttcttatttttcctttctcgttgttataataatgattgaaaattttattatttttatttttggatttttaaaacgagaatgatttattttcaaaatttgaacaaaaaaatcataaaaattattcccacctaggacaaaaactcttaacaaatttttctatcaaaaattccaaaattatagagtaaaaggtgtaccataaaaatttttacaaaattctaatttaaaatccttcaaaatttaaactttagaacttttttctccgaatttttggttaattaataacttggaaaaccttaattaataaaaagaataagagattaaatattggtcagtagaatggcaaaaaagaccatcacaaaaagggtagaaacggaatcgatggcaccggagcaaatgttctcggcacaatcgaacggcacgaacgggttcaatagtgaaggatcagttggaccagttggcggatctaatttataagtccaaaaaaaatttagaaataaaaaatgcacttaaaatgggttaatctgtggtgaaaattggtcttaaatttttagagctttttgctcaaatttgattgctccagggaggtcaaaacggtcatcaattttttgtattaaattttggaaacaccttaacaaaaattaatgaaaattttttctagaccagcaggcccgtaaatttcccaccttctaaatgaaagatttaacaaacaaaatcgcctccttcggattgcccccccccccgcctaatactccgatttttttcaagttacgggactgttcttttttatttgcatgaacagcttataagttttctctattctcctgcaaaattttaaaaaattttgcaggctaataaaggatgtttgtggctatcgaaatgagtgaagaatgtttaatttgtgttacaccttaagcaaagtgctgattattttcatagcggatttttggaattacctagcacccaaaaaaaaaaaaaattcacaccagtttgttttacacgttgcgccggcgggatggttcggtcgttcttcaaaatgtaacgtcttgagcatttgtattgaccaccctggcattgactcgccacaacaagtccaatcagttcatcatcaggagtacaaacttgactatagccatgcttagcgcatagattgaacaccatttgcagttcaccatctacaattaataacaatcttaaataaactttaaatccaaaatgattcttaataaatttaaaaaataataattattattattaattactttttgataaataaactttaaatccaaaatgattcttaataaatttaaaaaataataataattattattaattactttttgataaataaactttaaacccaaaatgattcttaataaaaaataaaaattattattattaattactttttgataaataaactttaaatccaaaatgattcttaataaatcaaaaaataataataattattattaattactttttgataaataaactttaattccaaatgattcttacctgataaatttaaaagaaaaattaataattactttttgagatgacaatcaaactttaaattcagaatgattattaccggataaataaaatttttttttattaaattacttttttctataaattttttggcttattttttttgtgggctggtcgctccaaacttatattcagccttttatctatttaaattgtttaaaatactatgaaattgaacaagacaaatttggacttactgaataaatcagagctactcaaaatattctaattaataaacgtaaaaatatcaattatttaattaattaattacccttatagcacacgtgttcaacacattctttcacgtcctgtctactatctgattgatatattacacaaaggtgttttcgcatttcgccattgaaaatgagcgattttttgtcgctgccggaaatgttcactgtcaaaatattcgcttggccaccaacatggatgccttcatagcaccaaaccggtaatatcggctcttggtctataaatccgtggtattaaaattttggtcattaaaatttgtgcccctacatgagaaaacattggcgacgaatgccaaaaatagcacaggttggagcacagtcggcaacagtttcatgatgattgaaaaacagttttttaaatggaatttaaaattttatttttatcttaatttaatttaagtttttctttggttttgactttttattttatcattattatttcaaaaaaaaatcagtttagtaatgaaaaaataatgatttaatgttaaacactaataataattgtgtacaaatggaatgaatgttcttcttttccaaaaacattttcaccaaattattctgcataaattaaccaatatcagtttaaagtgttgatgactaatacataaataaaatgtaaatttaaaaataatttaaaaccttaagagaaaaataatttgaatttaaaaaatatttattaaaattggaccactaccaaatttatgttataacaataaattcatgttaaaatgaaaaaaaaaaaattagtttcgtaaaatatattcagtgcgtcgttttgactaaaaaattttaaaaaattaataaaaatttatgtaattattgtacaataataaataatttacctataatataatttattattgatttaacaatcgctaatttagcgcattaagtg

SEQ ID NO: 26105 - DNA, 2288 bp, Heterodera glycines
gataatttcggcaaccagaagtttttgtaaattcccttcctgttctttctgtacaggcgattttttaagctttctgactaattttttaatccgttcaagaaggctttttgtcgattcgtcatcattcaactttcgaacaccgtcccaaatggcctgaatacataatttaaggttacataatgcataaactatatttaaccaaattgcatttgtgcgcaaagcaatcgattgattttaagccaaggtcggtacaaactttgaccatcacctctgcagcatcccgtaaaacgacaaaaatttttgacttttctaatgaaaattcaacaaaaactttcattaataaatcctttaagacagtagcgttatgccgtcctaaaatttaataatttaataaaatatgatgacatttgttaacctttaattggcttagcagccaagacaacgaattttggttggccctcgtaaatgaagtgacaggtaactgaaagaagagagtgcgctgcatctttagaactccaacaatcgatagtcaaagagatgaaatttgtttttttaatgtcctttttaatgcgagcctaaaaatttatatatttcgggaatttaaaacggccaaacacctttaatgtttcaacaattttcggcattaaatttgttgtaaaaaatttgcggccaggcatatggtatttcggttgtaattcgtgaataagtcgtctgaatccttcattttcaaccatggaaagtggctgcaggtccactgcgatcatttccattattttggtgtttatgattaaagttttttcgccatctttttcccatgggcctaaaatcattatcaataaaaacaaaaacctaaatggaataactttttgcttgtaatgagtgcagtataatcgatttaatgtgctttggaggctgaactgattcgccatcaaaatcatcttcggcaattgttaatgggaccgaacagcttggagctgatgaacaaaaagccctaaattttaaaataaaaaatggctagaaatgttgcccagccttttaatgctcaattggtcaaatgcagcagaatcctttttcttttttgcaaactctttatgcaaatcagggtgtttgtgctccaaatgagaaattaacggtgttgtcggagctcttggtggataatcctttttaaaatcgcaaatattgcaaaaagcaacgcgaccagataatttgaaatatttccaaatcaatgacattttaaaggctaaagattattacaaagtattcagtaaaagttgaagaaaaagcaaataaaaataaaataaaaatgttataacaaatatgagcatgccaaaataataataaactgaagaattcgttataaaaatttaattttcaaatatatccaattcttaggcaaagagtgggacttcgatgagtaatttattttgctttccatttgtgtgtatattttttgatcagttgatttttaaattttgatgcattttacttttctaaaagcgccaataatttttatcttcttttaacaaaaagaatatttaaaattggtttatcatttgctaaaaaatgattaagaaaaagtgccattttatgcgttccattttgtcattcgttatattattgattaagcaccacaaaagaaggggataattagccccgggctatgccccgtaattgcccactgcagtggagttaattattctggttaattaacttttaactttacataacataatatacagattgaacaattccgtttttacatacacatattcctttagattattatatttttttgaaatataattttttggccataaaatgtcggaaagtccaaaaaaagtgggaaaacaaatggaaaaagcaatgtaaattttgatagaatcaattttcaattaattcattaattccgcgttcgtttagcttcatcactggcgacgattggctttcggtgttccatttggtccccccttttcagctgggccttggcattgcgttgctcagccaccgatttgaccgattggtggacgaacacttcaaaacgcggcgttgggcgttggacgaaattggaattcgtcgcacatttgaaaaggatggccaatatgagatgcaaattaccaattccaaattggatccgtcgccaattgagacaaaagtgttcgacttttacctaaagtgacggaaatggttgacattttatcagagagtttcggcacttacagatggaaacaatcgggcgccaattccgcaaaagcccggtgccgcacaaagtcttcgcattcaaaagcatt

SEQ ID NO: 26106 - DNA, 1589 bp, Heterodera glycines
tagggatgggatcttaaagggcgaaaattccaaaataaggtcgtaaataagggcaaaaaaatcggagaataagggcgaaaatacggtcgaaaaagttccgaatttagggtataatttttaaaattgctgttttttacagaaataatttcagactaaagcaaacaattttattactgattgcagttacaaaaagctatattttagaaaaaaattttcatttcttagggtcgattattgaaaaatttagtgtcgattcataggggtatatttttctgaaaattttttggttgattagtaggggtatattttttcgaaatttttttgggtcgattcttaggggtgtatttttcgttttttattgcatttttgttaataaattttggacaaaacgccaaaataagggcaaaaacttattttaaggacgaacatccaaaataaggatttttaagggcgaacatcaaaaataaggatttctaaggtcgaataagggcgtgaaaacgcaaaattttcagacaaaaaatgtgtttttcgtgtatttctcgttgagttaaagccgcagaaaaaaattaaaaacttagaaatcccatccctatttatcacttaatttgtgcgtttgtttagctgtgtcatcagtgttgccgtctgctgctgcagccgtgttcatcattccgccgtcaccgcgactgagcgttgcgcgtgcggtggtgccatcgctgcaagggacgcgcgccgaagcggcactgccccaagccgcaaatggcggcgagcatttgtcgccggcggaaggcagcagtgccaaaagtgccgtagcaactgtggacaaaaggctggggttttggccacaacaatcgtcgtcatcgtcatccaatggcagtgccaactgtggccaaggacaacaaaaacagtcagtgccattggcaacgacggcaaaagcggtgccgaatggtgcggaagcgctggtgccgttcaacggcaatcaccttgtaagcggaaacaaagaaattgagctgtagctatactcgagaccggaaaacccgagactcttctagagtcgagactctcgagtatcacacacttttgttagcaatgggtgcctgcgcgcgtggcggccaaaggcgtgccgacatcgtcagctaaccgaaggacaactgaggaagaggaggacaatttgggtaccaacagcgacactggcacacggcgatggccttgtcttggtaagaaatggcagcagttcaataatatctctctctctttctctctctctctctctctctctctctcttttacacttacttacagagttcccaagtttttttttcaaagtaaggacaaacgaggctaaaactaagattttgaccccaaaaataagaattttctaaaactaatagtagcgcgaagaaaatgcaataaaaacacgaaaaatctacttataaaatattttattaccgtaaaaactagagatcggaccggtcggtttttttcggtttttatccgaaaccgacccgacgaaataatcaaaaaacgaaacgaccgaccgatttttatgaaaaaccgaaaaaaaccgaatcaaatttgagcgatataacctg

SEQ ID NO: 26107 - DNA, 2422 bp, Heterodera glycines
gtgattggaatgcaggtggattgagtgattccaagtgattggaatgctggaggattgagtcccggcgactggaatgctggtgggttgagtcccggtgattgaaatgccggaggattgagtcccagtgattgaaatgctggagggttgagtgccggtgattgaaatgccggagaattgagtcccagtgactggaatgctggaggattgagtcccggtgattgaaatgctggagaattgagtcccagtgattgaaatgctggtgggttgagtcccggtgattgaaatgccggagaattgagtcccagtgactggaatgctggaggattgagtcccggtgattgaaatgccggagaattgagtcccagtgattgaaatgctggagaattgagtcccagtgactggaatgctggaggattgagtcccggtgattgaaatgctggagaattgagtcccagtgattgaaatgctggtgggttgagtcccagtgattgaaatgctagagggttgagtcccagtgttcggaatgccgaggattgagtcccagtgattgaaatgccggaggattgagtcccagtgattgaaatgctggagggttgagtgccggtgattgaaatgccggagaattgagtcccagtgactggaatgctggaggattgagtcccagtgattgaaatgctggagggttgagtcccggcgactggaatgctggtgggttgagtcccggtgattgaaatgctggagggttgagtcccggcgactggaatgctggagaattgagtaccagtgttcggaacgccgtagatttgactcccagtgattgaaatgagggttgactcccagtgattgaaatgcatgagaattgagtcccagtgactggaatgctggaggattgagtcccagtgattgaaatgccggagaattgagtcccagtgactggaatgctggagggttaactcccagtgattgaaatgcatgagaattgagtcccagtgactggaatgctggaggattgagtcccagtgatcgaaatgctggagaattgagtcccagtgattgaaatgctggagggatgagtcccgttgattgaaatgcacgacaattgagtcccagtgattgaaatgctgtagaattgagtcccagtgttcggaatgctcgtagatttgactcccagtgattgaaatgccggaggattgagtcccagtgattgaaatgctggagggttgagtcccggtgattgaaatgcaggagaatgagtcccagtgactggaatgctggtgggttggtcccagtgactggaatgccggagaattggtgagatagagttccgatgattgaaatgccgagggttgtttaagaaatgacaagaaacaaaaaggccagtagaatgttaaaatgttttgcctatgtagaattggtgagattgagtccaggtgtttcgagtgctgatggattgagtaacggtgattgaaggtcgtagaactgagtcccagcgattggtatgcagaagaatcggcgagatttattgttggtgattggaatgcaggtggattgagtgattccaagtgattggaatgctggagggttgagtcccggcgactggaatgctggtgggttgagtcccggtgattgaaatgatggagggttgagtcccggcgactggaatgctggtgggttgagtcccggtgattgaaatgccggagaattgagtcccagtgactggaatgctggaggattgagtcccggtgattgaaatgctggagaattgagtcccagtgattgaaatgctggtgggttgagtcccggtgattgaaatgccggagaattgagtcccagtgactggaatgctggaggattgagtcccggtgattgaaatgccggagaattgagtcccagtgattgaaatgctggagaattgagtcccagtgactggaatgctggaggattgagtcccggtgattgaaatgctggagaattgagtcccagtgattggaatgcaggtggattgagtgattccaagtgattggaatgctggagggttgagtcccggcgactggaatgctggtgggttgagtcccggtgattgaaatgccggaggattgagtcccagtgattgaaatgctggagggttgagtgccggtgattgaaatgccggagaattgagtcccagtgactggaatgctggaggattgagtcccggtgattgaaatgctggagaattgagtcccagtgattgaaatgctggtgggttgagtcccggtgattgaaatgccggagaattgagtcccagtgactggaatgctggaggattgagtcccggtgattgaaatgccggagaattgagtcccagtgattgaaatgctggagaattgagtcccagtgactggaatgctggaggattgagtcccggtgattgaaatgctgg

SEQ ID NO: 26108 - DNA, 907 bp, Heterodera glycines
ctgcatttctccgatttgcctatcgacacatcgccttcttaattctcatctgaaaggagcatgccgctacctttaccctcaattatttcaaattcaataataatggtcaaacctaaaaaccgacttcccggaccttacgccacctgctctgaatatgatactggatgtctttagggatacaatcgatgggcaagagattgacagagactagtcaaacttcatacatctaactatacagccttgtgaacaagatacagatcgacttgctataacagtgccttgtgaattttagtaaaaaccataagaaagggaggaccctttggttataagacttataatcgaattttattttttctcttgaagtcaaaaattttaattttttattttacacaaattcttaataaaacaaaatacgataagataaaaaacagatccataataaataccttaagaagggatcagccgaattttaaataattaaatcctcctaattttaaatgggttttctctattttctaattaattttctactcataaactttttaatttttaggcaccgatgaataaaatgagcaaaaatacctcaacaatgttattattttctctattagcaaaccgaatatttcttgttacaagcggtgattagtgaaaattaataaaaataataattcatttaatctatttcaagcctaaaatgggaaaatattcattttctaaattaaatattaatctttcttttcagtcaatgatttgacagaagcaattggttccatgaaggagaaattgttcaccatttatcaaaaatatgacactgactttacgccaaatattccttcaattcttgaaacggaacgtcaagaattttttaacaagttaaacgaaattacaaacaagcagttccaactgt

SEQ ID NO: 26109 - DNA, 2381 bp, Heterodera glycines
  misc_feature (58)..(58): n is a, c, g, or t
  misc_feature (116)..(116): n is a, c, g, or t
tttaaaatgtaaaagaattaaatatttgtaaaaaatattattctcaaaatataaattngctaggttttaaatattaattcatttttcatccatcaaatctttgaaccaaatgcctntaatttactcaataattaataagaataaaaagtcaaaaataaattgaaaaataaatgtgacaataaataatagtaaaatattcaagtaaataaaaataatttttgatgaatataattaagagaaagcatttaataaaaaaatataaaaaagaaaataaaatattaggagaaaataaattgtaaataatttaaaaaattaaatttctacattttaaaaacttaattcagtaatcgcaaattaattcttttatatattagtccaatagtattttaaggcaaatgagctcaaccaatcagagcgaaggaccgccccttccgatcactcctaattaattgtttaatttaaaacagaaaacataagggtcgcaaattaaaatgattatatgtgttaatgaaaattattaaaacctaaaatattttttataaatcaataaaaacaatttacaaatgggaagccggagccacagcggacgagccactcctcctgaagcggacgaagctggatgaaaatagtgtttaagaaatttataatgtaaaaatcaaaaaaagagattaaaggaattactaatttataaattagaaatcaaaataaacgatctttcaataattttaaaagaaatattttactaccgacagaaactaaaaaaagcaaaactgagatcattcgataaaaaaaatcaaagaataaattataaaaaatggtaaaaaaataataaataaagaacattaatacttgaaatgtttatgtttagttaaaattaaatctaaaagattttggacaacaacaggacaattaattttaaatcaaattatgtttgaaaaacttctgaagacaaatatttaatacaataataaattttaaaaaatttcttaattataaataatgcaaatattgaaagccatatagcaaaatggtaatcaataaaaaacgtaaaattataaagaaaagacgaaaaaaaataatataaataaaataaaatttttgcatttctcattcgctaatgcataattaaatactaattaaagcaaacaattcaaaatgtaatgagttgagagattgacaatgcttgtctggctaattaaataaatagaataatattttattacggaaattatattattatatggatttcggtgcaaaaaagaatgaaaaacaatgtgtaatcattaacaattatatgtaaattctttaaggggacatcatgtcactactgaaaaagtaaaaaatagtgaaattaaacaaaataatttattttaattttatataaactccacgaattttttatttttttctaattattaaagttgcaattatttggatataaaacactaaataggcaccttttatatttatttttataaaagcggtcatcagcgatggatgcccttagacaaattaacttattttatataaacaattattacgaacaataaaaaattacatcaaaatgctgcttaattgtaataaaaaataatttcaaaaataaataaatattcttaaaattaaaaatgacatatccacttgacatttctgagaagcaatttcgttcatgctgccaagagataaacacaaagagaaattaataaatttaaacttaaaaaaatatttaatagtcgaaataaaagtttttaaattaatgcccttattttaccagaaaatttgcattgttttaaaattttaaaatttataatataaagcaaaaaacgagctatttatcatttcatacaatctaataaaaaaatgatacatctttttcaggtaaaagaatttattatttagtaaaattttaaaatttgcaaaattagtttaaacatatttgttttttacttttttaaagataaaccttagaaaaacaccaaaatagttgcaaattagttgttatatgaataataatttttgtttttgggtttgattaaaattattatttttgcgttaagtcaataaacgaaaagactttaggcatattacttatattaattttaacaataatgactttttttgtgactttttcggaattttatcatttttgattttttcaattattttcatgataaattctttgagttttaattgtattaggtatttagtttcgatgttactatgacacttttgtaaaaaaaacaattagtaaaaaaataaccaaattcaactttttaatataaatttcatagtatttcaacgccgctgatttttttattaacacattataaaacaagttgtcattaaaaataatctttgttaatagtaataactaattaaacaat

SEQ ID NO: 26110 - DNA, 1409 bp, Heterodera glycines
gccaaacaataaactgactttgaaaaaccatccgtcgccccctaatgaatgctccatattttcgatcattcttttcgttttttgcttttgctatttcacgagtcaaaaggcaacaaaaggcaagcgaaatcgaagttggcaaatgccatttgaatttgcagagaaaaagcattaatggccaatgggaaatatgggcataaaaaactttgaacttttaagggatttgcgaatggcaccgaaaatgacggagagtttaaaaagagaaggatggcaccgactaaggagcacattcttaattcatttgctctttccataatcccatcatgcttattaatttgcttttaaaagtcggctgactcaccactcttcattcatttatttattcattttgctttactttagcgatggcaaaaatcggaaggatttcaagaaaatgggaaattaatgaaacattaagtggaagaaagaattaagtaaggaattaacgggaaaaggcgacgcgacgacaacgcaacggaagagaaaaggtgagagggagggggataaagctgatcattatgaaggacagacaattattgggataaatcgcaaaatatgaccataatttccaaattgagctgaaaaaaaaactaaaatggctgagtactgtattaaaaatcattttagaagaaataataaaattatcttaataaacaaattttttttagaattttagatttttagggggccaaaaggccaattttatggaaaaaattgacataatttgacacatatggaaatacaaattgctttcctataagtttcaaaccaagctaaaaacatgtttttcgtgccttttagagctctaatccagaaaaaaaaaattatggatttggatttccattataattgcctggcgtactgatcatatgaacaaaaacacagtaagaaaacggaaattggggggggggcggcacgagacactcctcggcattattattctcattagtacgttcaaaagggggggggggagttgaaaaacaaacaaaaaagtgagagagagggcagtggaaaatgaaaattgggagaaccaaatgataaaacccattctgcttgcctgttttgtatcagtcagtacttaagcatttttcctggttttctcaaaaaggaaaaatttcagaattctctcgaagaaatgcgaacaatgccaagtcgaaagggcggaaggatttgctggcattgggacggatttcacatattagtattaggaagatttactaaattaagtcaaaatgcggtcattttgcccgccgatattttcatcaaattaaactgaggccgggagcgaaaaagatgttatacagattttaccgaaaaagattaatttataaatttttggctaggatttagtaaatcaatcaatcaataaa

SEQ ID NO: 26111 - DNA, 2428 bp, Heterodera glycines
cgtaattacgacgatttttcaatttcggaaatccgtaatccgtattccgggggtccaaaaccccgtaatttcccgtatccgcaatccttaatttcaaaaatcaatttttgtcagattttagaaaattttttttaaaatagtgattaataaaaatcaaaaaactgattttcttgatgcagtttcttcattttttatttcaatattacatatattttttttgtgtctgaaaaaaccattctttttgaatttatgggttgatttttgaaaatttttgaaagtctgatcattataattggatttatgtatgtatataattatttcaacattttaatattcagaaaaaaatttcgggggggggggggaatccgaagaatttttttggtcaaaatttgtttagattattttaaaaaattcagcgccggagagcaaaaacaggaattgtaactatttttagccaaaaaagactaatttttgccattttggagtcaaaatttaaaaaaataaggtaaaatcgagtaaattatggtccggcaatgccgataggtgccgccgggcaaattttttttgaaaattttaatgattttattaagaaaaatcgacaaaaaattttaaaaagtaagaaactttggtttttataaaaaaataatcttgcaggaaatcgtctcgaaaaataatcccaaaaagccaattacggatcaaaattacagaaaaatccacaaaaatccgtaagccgtaattacgggggtccaaaaaggccgtaattcccgtaatccgtaattgcgcccagccctgattgctatcattcaagagcccttcagattttattagcctgcaaaatttcataaaatttgtttaatatataaaaagttatggaaaaaatgctcgaaaatctgagtttttgaattcatctggccataacttttttgtatcttaaagaaattttctgacattttacaggctaatagaggacacttagggctatcgaatgataccggcaatgttgaatttggttgagaatggaaaaagttacagccaaaaacttgggcccgtgcgaaaacggcccgtacgaaaacgacccgaaaaaagggacaaagaatttaaaagactgaaatttgaaaaatgtacatttggcataatgtataatttattttaaattcaaatctttttgtatgtacacttaagaaaaatgaatgccaacttttacatcccaattagctaggtaattagctattcggacacaaaattttttgttgtttgatcattttcatgttacaggtgtttaaaataagagctgaatattcaaatatttttagaagatcaaaatggaccgagaaaacctggaagattcaaagaatgagaacaaacaactaaaggagaaaatccagaaacaagaagaggaaatggaaagaatgcgaaaggcactgaatgaagggcagagttcgtctgcgggtgcgggtacttcatcggccaaggttttgagcgattgtacgggaaggggggggggtgtttacaggggcgtcacggaaattgtatggcagttgcaattggggagggaggactatcaaaatgttgggacttggtttattttattttttgggtaatcaattgtcaattaatcggaaacaatttacaggcgtcagcgtctttctctgatcagaaaattcccgtccgtggccgtctttcgctttgtaaaagtgttaagtacgatgtaacactcggcgaaatcgaacgccgtgttacgggactcgagaagattactccgaacgagtacctccgttttctgcgcacacagaaggcaaaagggaaaggacgaaaattgcaggaagagatcgggaaggaggtttgtaaaacattcctaaacctgaaaagccaagagggacccttaggttttttgaaattttccgaacaaacttacttcggatgctaaaaacactgctgatttatttttactttattaaattttttgtccacagcgttggggaccagccattgctgctgcgatgcaattcaatctggaacgtgaaaagaatgaacaaacctgcttcactcctcttacagaaggggaggcatgcaaagcaagtttaagccatgggtgggggtggagaaactgttggatgattagccccaaaaagtttttcaaaaccaaattttgattttctaagaatgttcgtttttacgagcagagatattcctttgattttaatctgactcacaacactttattttaaatgcatttttaaaaatttagctcgcggatgacttcaggtcaatcatcaaaaaacattacccgtccgatgccattgcgcgtcaaattggtaagaaattggcctaaatttcaatcctgaaaaaacaaaatgtcatttgcctcagtcgctggtcaaggcgatgggtacacacagcaggagctgttcaaatttcggtaagaaat

SEQ ID NO: 26112 - DNA, 1471 bp, Heterodera glycines
  misc_feature (352)..(352): n is a, c, g, or t
gtccaaaaatttctaaggaaaaataatattatggcggaaaaattttaggttttccatgcggggctggtaccccccccccagacctagccacacccaaattttccaagaaatgtcgctaaatttttcaaaaaatccacaaatttttaatgaaaatctgctaaaaatggctcaaaatcacaaaatttggtcattttttggacaaaatctgttaacaaaccgcatttaaaaccgcaaaaattttcccccctgtcccccaacaattttttttggaaaaaccgcgccacataaaaaacgggtgtgaaaagcaaaaaaaaaaaaaaggtgtcgcccggggggaggtgccccccccccnccaagccaaaatcctgggaccgtccctgctattttctccacccaaaaatggtgatccgattcaagacatcagaaaaatttgaatgtttaacagaggaaaaatgggaaattccacctttaaagcaatacacaaaaaaagagcaaaccatcgatggtaagtcagcctcctcttcatgctcctcttggtcatcatcctcaaaatcagcggcatcggtcgccggaactgcgccaaaaattgataaattatttattgtttcagcgaacatttcggagccaacattgtgtgctgctcgggggttcgagccccgctagatgtggcataatttgttagggtgcaccccaaaatctcgccgccggaatctcgccggccgaaatctcgccgcagaaatttcaaaaaaaaaatttcaaacttagaaatttttcaaggaaaaaattcttagaaaaatttttttataagaaaatttaaataaaaaaattgttgaaaaatttttcagcaattttttttgaaattttatgaaaatttactgtttttttttaattttcaaaaaaacttagcaaatagtttttttttggaattttcttataaaaaaattttctaaaattttttccttgaaaaatttctaagtttgaattttttttttttgaaatttctgcggcgagatttcagccggcgagattttgtctcggcgagatttcggccggcgagattccggcggcgagatttcggcggcgagatttcgtcccgtccccagaataagcttaccgtaaacacaaagtgattggaaacattcgtcgaatgtcgagcaaaattcctcccatgcctaaaaaccaaatgtttttattatataatatttgcaaattcttagactattggatgatcgatgtgtgatctgaattaagagtaatagaacagtgaaaacaaaacccacgcaattacctccaaatggcggactcttccgtcccgtgggtcggctgtttcgtcatgtacaagtcgccattctgactgatcgccacactttgaactttcccgtcaataatatgttcatgttcatttgttccatccaacgaaaaaattctgaacacggataaatcggacttttcttccgcgcaaacgtatata

SEQ ID NO: 26113 - DNA, 2324 bp, Heterodera glycines
  misc_feature (2286)..(2286): n is a, c, g, or t
acaactgaatgacggtgaggtcagaggacgcatggtatttatgggggacagaagggaagagagatagaggagagaataaggggagagaaataaaggaatgaaaataatatgggcggacaatagagtaccggtctcaacatcttcccccttaaaaaaaaatcttttcctcggttcttccaatgatccgtccgtcttacacgtccgttcgattcgtccgtctgatccgtccgttcatgatggagtgtagcgatcaggcggtcgccgatttcgctgtgatcgtcgttgagcgggcacttcgggcgctcgatcagcttcctccacgacgggttcttcggccacggctggtgcgatgacagcagcgggtgccactacaggcaattgcgcttgtccaccatgctgaaccagcggtggtgccaatggcaaatcaaacgcatcattgaacacgttcaatgcgtttgtgccgttttcgtcagtgcttctcacaagcaactgattggcatggaaccttccgaattttccgtcaaataattcgacgtcgtaaatgacacctttacatttggtgacttttccggggcgccaaggctgagaaagacgatgccgagcgagaaccttatcgcccacggcaaaagatctcggtttggctccatggcgcctattaaattgcttctccatggcctcgtctcgaattatcggtgcctttggctttggcctcaacaagttcaaagtcgtgcgcggtttcctttgcaggaacatttcggccggacatttgcactccggcaaagctcacaaggcgtgatccggtatgttgccaaaaatgtggtcaacatttccgatgctcttctcccttgatcttccgacatgtcctcttgaacgtatcgacaaaacgctcggcttgtccgttcgacatgggattgtacggagcggagaacagatggttgatgccattttcggtcacaaattccttaaattcttttgaagcgaattgtgtgccgttgtccgtgactaaaatttcgggaaggccataactggcacagagtgatcgcaatttgtcgattgtagccgcggaattcgatgaacgcatttcgaagacctcgggccacttcgagtacgcgtcaacaattatgagaaacatttttcccataaacggtccggcgtagtccaaatgtacgcgtttccacggtccatcagctttcggccacgagtgaagctcagtcttcaccggcatctttgcttccattgtgcattcgttgcacattttgacaaaattctcaatttgttcgtccatcccaggccagtaaacgtactgcctggcgagacctttcattcgcttcattccgggatggcctcgatgcagaagttgtaagacatctttttgaagcgatgccggaatcacaactctgtccgcataaagcagacattcatcctcgatggtcaaagcgtatcgtcgtcgatggaacggaacaatgtctgcggccattttgttctttgttggccaatgtgagcagacaaatttcttcacatttttgatcgcctgatcacttttcgcggcattagccaaatcactgtgatcgagaggaagagttttcgtaacaaaattcaacactcccgtttcattgctctcacgaatgtttgcaatgatcactccgttgtccggcactggtgtcttagcgataagacgcgacaaaacatccgcttgaccaaaatcagcagtattttggtattcaatttcgaagtcatagccgagcaatgtgattgcccatctctgcaatcgattcgctgtgcaagccttaattccctttttgttcccaaaaatggacaacaacggcttgtggtccgtctgcagaacgaagtgtctcccgaagagatacttgtggaatttttgaacggcaaagacaatcgctaagccttctttctcgatttgagaataattcttttctgctgctgacagggacgatgatgcatgtgcgatggcttttagacttccatccgaaaagcgatgagagatcacggctccaattccatgctcagaagcatcagccgatacaatgatctcttgtgccgggtcatagtgtgtcagcaactgatcagatttcaaaatcttgatcacattctcaaaagcattttgacaatctgcccattgccacactttgtcctgcttcaacattcgtccatggctgtcggatgaacctcatgttcttcacgaattgttggtaatggttgatcattcccaaaaatgatcgaaactcggacacgtttgtcggaacagggatttcagaaatcgcctgnatttttgtttggtccggccgtctcccgtcctgatcaat

SEQ ID NO: 26114 - DNA, 1309 bp, Heterodera glycines
ggcgcgccccttgtgcacgtatgaaccatacttacttgattactggttctacataatgtagtataattatgaaaaatgataaattcaattagaaaaatatttaatatattgaagttcactaattaattaataggtgcttattaggctaattagggaaaataatgaaatagtaattattattccaaaaattgactaaatttaactgcttcaactacaacatgtcactgcatattaacaattttcttctgctggtgagcatgaatttgtatatttgaaatattttaaattgattcaattttgaaaaataaaagaaaatttgtgcattttttgagtttggtcctctcaatttatcgtccgccaacttcttctctgagtgctcaaaaaatttgtacgaaatttattttaaaaattggatagataattttctacggcattttttttttcatttttgcatatttaaatccaatgttggcagttgcaaatttacattttttacaatttcttaattataataataataatattaataataacacaattatttcttggtatcattcgaaagctcctcacatgctctattagccaaaaaatttttttttaattttagcctgtaaaaaaagtaatgaagaaaaaactcaaaaatttggacttttttgcaattttcatgatataactttttttgttaattgtctaattgcgaaacaatagcttagcaatagcttctaaacatgttaagctttcaaatgataccaagaacgttagatttagattgacaaagaaaaaaatagcccaaaaactgcgccaaacgaggtggaccccaaaaatggattcctcccgcagtgtttttcttttcactagagtgaagcgggaccgggaattttgggaaaaccgggaccgggacctaatctggttgaaaaaccgggaatttttggctgggaaaaccgggaatttcccggtcccggtcaaaatttgtcaaaaccgggacctcggtacactcagttgtccgtgttttggtcccggtcccgcttcactctacttttcacaagtaaatatttaatatttccattggaaattaaatttctttttaaatttcattttcatattctcacaaaatcatttacatctttctaaacatttgttttcgtaagaatacaaaaaaaaaatcttttgcccatccaattcatccttctgctgctgctgattcaccttcatttttgcatcttttttcttaccgattcacatttttgtgccttttcatcccttttttatgaataatgtttcctttttgcctattttgcgcctttttgcc

SEQ ID NO: 26115 - DNA, 2175 bp, Heterodera glycines
ttggattacacgaaaaaaccacaaatcccatgtttactaattttgttgtgtttttgacaatttcaatatttttgttaattttatatttgcaatatttccaattttttgatgggcccaaaaaaagcgccgccggcaagacgaaaggccgagccaagtgaaggcgaagaggaagtgaagagaaagaaggcgaagagaattgtcattgaggatgaaccggaagaaggagcgaatgggacaggaagtcaattgcaacaaaatgggcatgaagaagcaatggcaccggtagtgaagggaggggacgaagaagacgaagtcgtttctgaagtaagcgaaaatgatgaattactgttttcttaatctaaaaaatcggtgaaaaaattttgttcttctcgaaatttttttgaagtttccgcggcgcgaatcgatataaatggaaacggaattttttaaatttcgatcggaatttttttccctttctctgtgcaggtcggcatctatctgttgccgttggctccgtccgatgctggtggcattgcaaagatggcaaactctgctggtgctgcttcgtcggtgtccatcaatcgacttcaattcccccagcagcatccgaatgtgctccgacgtcgcttcaatggcgcgctgtccggacgcggaaatgcacaggacggagaggaggaggaggaagaccaggaggaacagcgaaccgaccgaactggacggaaattatttgcacagtacaaggcccaggtcaaacatttgcggcttgggttcggctcggactgcgatgaggaggcgatggcatcggccgtcatgcccactttcgccggtggagggggaattgccgaactgctgacaaagtcagtcccaaagaaatgggttggggggaagcgaccgattgaccacaatgagtgcaatgtgggtgcactacgtttcccccgcccctccttcgagaattatcttttttatttccaaactgaaatatttcaaagaaaaaattcttagaaaattaaaattttcttaaaaaatttcgcggaggtgggggaacgacttgctgcggggtaatgtaccaataaaacgtcatttcaggaatcacactccgtcttcgtccgcccttttctcgccgcccccttcggcgtcggcctcttcctctgcaatcaaaggggggagcgatttgacctccgacgaaatgttcaccggggaaggcttttcccagcaaggcttgcttaattacgctgtcggattcttcaaaaaaggtgatgatgcatgtcatcatttattcttttctttctcaaatgacaatgctttgtcatttttagagagcagctcgtttcctttcccaacgaaaaaaatgaaaacaatcttttaaactttcattttcacaatatattttttctaaaatttcttccaaaaacattttattctttgcaattttcgaaaaaaaaatattaagtgaaagtttaaaaaattcgttttttttttaaaaattttcatgaggggataaatgtatttcactcgtccttttttccttgcaattttttaatttggattatcctttggcttcatgtctttgtttcaggtcgtctttttttgttaccggtggacaaaaccttcgaaatgcgaaagcccttgcgggggaccattgagcgcgagtcgacggcgcgtaccaccgcattaaagcgtgagaaaattaagggagaggtccatgttctgtttaatagccatgcaaatgctctttccgccttcagcgtcttcgtccgtctcctccacttcgacacgttccgttgccgctgattctgctccttccggcactgcgtccgcttcgtcgtcttccgtcgctgttgccgcgccgttgcgcattcgctttgcacgtgccgaaaatgacttgcaacgacgccgccgagagcagtcgtccttctacaagcagaagctggtggagcaggaccagtggattccgctcaaagtggagcatagagtcagtctcttgaaccaaaattgacaaatttgcacaaaaaacagtgaattttgtcactggaaacactgtctttttcaggatttgttggaaatgtacgaaaaggacatcaacaaggtgctgctgtcttcagaatgtccgcccaagtagcaaaaaggcacaatgaatgcttatagacattatattgaaagtcaaaacaatttctc

SEQ ID NO: 26116 - DNA, 1307 bp, Heterodera glycines
acaaaaatcaaatgggaattggggcaaaaagcaaaaaacaaaacaattttaccgtcgggtcggagggaagcaagcattttgtcgcgatgcacttgaaactttcccctgccctgctgattggaaaagtctttggtgtctctgcagacgctgatccggcaatcgctcgcgtccaatgcataaatttggaattcggtcattactgggtcttcgccccgctgcagtccgacttggcgcaggaaaaatgaaacatctttgggagaaggaacactttaaggaaagaaatattttttacgacgcactattaacgtcttcttcgcgttttccgtttgggtaaacgtgcagctcccaaacaactgaggaaccaagaagtgcaggagaactgtttgccttcaaaaggtaaaatgacaaggaaagcacacattgatcaacaaccaagcaaacttactgatcagattctggccatttttcatcaatttcatcagcttttcaaaatggtcaatgcgccactcaagccttgacgaaattgccgccacctaaaagcaaaaactttcatttatgagttgctcagattgcaaaatcagatgacttgccttagtggtttgtttggaaaccatttccaagcgtctcgttgctcgattgatatttggcgatggttccatcatgcgcatgaaacgaattgggtaacgaagattagcattgttttgcattgcacgtggcttctgtaaggaatttaaaaaacgatttatttaaggaaattaaaaacatatgatcatttgtagaattgaaattggtctaaatcatattgcggaatttgtggctcaaaaaatagtgaatttaatattttggcaaatttatgtgtccaatgtgcttttttaattcgaaaattagcatttctacataagacgggggcagtcacaagcagaggaagcagcactacacggtttccaatccaacacacaagaaaaaacagaaatcaaaattagtgaaatatctggcgttttgtcttttcttctgttcgtggctgctgctgaatgagaaaatggcctccattctgttcgttgttcaacactttttgatgaaaattaatgtgaaacgattgaattcctttgtaacttataagcttataacatattcctacttaattttaacgtttgatgatattcgttctttacaaatagtctaaatcccaaatagaaattgattcaaaaatatatttaatttttcagatatttattaattatcatcatttttggttttacaaatgggtcaaaaccaccgcagggaggtgggcgaagccaggcgatgac

SEQ ID NO: 26117 - DNA, 2707 bp, Heterodera glycines
  misc_feature (57)..(57): n is a, c, g, or t
  misc_feature (120)..(120): n is a, c, g, or t
tttttgtctcaaaatagaaaatggacattccagttttttacccatagaccaaaaatntaagaaataaaacttgtcagaaaatttttggcaggaagagcaaaaaaaaaataccgaaatttnttttctgcttattacgcgcgctaacagtgtaaatttaccacagtaatttctccatttgaaactttttaaattttggcttatccataattttcaaaaaagtaaatcatttttcagaattctaacaatttcagctatgggcggatcagtttatcagaattttcagcatttttcagatggcgcttaaagccgagttggaaacccagaaaaggttggcggagcacaatgagatgcaggcgatggaagagaagacggacaatgaaaaacagaagaaaaatgaaaaggaaaaatacggtaaagaaaattaacaaaaataaaaaagaaggcttttttaaattctataatttaggttttaagtttaggcaaattttaaaatttcgttacaatgtttaagattctgtttttggactcactcaacaattgcaaaatgaacagacaaaacttttcggacggatggacgaattggagaagcaatttggaaaattgctgcagaaaaaggaggaggaaaattgtaaatacggtaggggtactgtaaatttcgaaaaaaacagaaattaatcggatgagaatttggaaaaattaattaattacatttgtacttgacaataataatggcaatttccatgttaagcattggctgaacaaaagcatttggaaggaaatggtgaattgaacaaaactgacaatgagaagcagcaattggtattttcataagattggcatttaaattttttcctaaaatttgaaaatgcgactcaattttatttgaaaattatgaaaataatttattaggacttttatttacatattttgaggttctcaacaaattttatatatttacaatatttcgtataaattactgttaaaaaatatatttatttacatactttttcataattgaaaatgttaaggaattttgcgaaaagtttgccaaattggagttggaattgagcgaaaagcaaaatgaaacacgtgggttcttatttaaaaagaaacattaaaattgctcaaaatattttcatgacaatttcataatttaatttaagattttaagagaattttattgttaagtttcgctcggcagaatcgctcaattgataaatgaggagaagaaacaattggacaaaatcactgctgaatttaacaatcgtcatgaagaacaaacggtgaatgaattggcattggcaaaaacttaaataaaaataatttattttataaaatcaaaaatgatttatttaaattaataaagtaatttgataagaatttttaaataaggtgcaaaatgagttccgccaaaattgttgggatgccctcgcttgtcacaatcggctgtttattaatggcaaaagtttgacgatcaattacagaggatttttaatgtttggtaattaattctaatgaaaatatttttaaaatttgttttttcaaggctattgttccatcttcgctaaacattccattttgttgaacaaagattgctccaacattttttactttgaaatttcagtcgcaaaaatgaaaaggtgaggtgatcagaagaaaacaatgcgtttcagaaagtttggcttatcaaaacaaaaatatggcatgaaagatttaattttttaaactttagcttcaaaaaattaaatttaaatgatggatttttataaaataattcaatgactcttaaaaggcaaaaaaaatttttagattttctaccctctccactcctccttgaatacaatttaaaagcataaaacttgttttgttttttgacttcgaaaacagatgttcaaacttttttaaaagttttgccttttaaaaatttagttttattctaaataattgaaaattttttgccttttcgaaaaaatgttcaaaattttggaaaacttaagtcacactttttaaattaatcatgtaacaaatgatgaaagtagttgagagatggggcttgcacctttattaaatttaattttcgcattttatagcgatgtgatcatcggattcgccccaaaacagccgaaaatgccattaaatggtacgcttttgaaccgttgcggcacttacgcatattcgagcactgccaattgtgtgcttaatgggtcttggaaaaatgctgatgtcaaattttttcctggcgatgttgtcggatgcggcgttaatttggccacccaacaaattttcttcaccaaaaatggccatcgattgggttaggaaaataaattaatggaatttttaaaatttattttagattttgcctttttaaacaaccatttgttggatgcttcttctgctgatcaattgttcccatttgttattttgtggaattctggggatcaaattgaggcaaactttgggccaaagttcaaattcgatatgaccactctttgaagaaacacatattaaatgtatttaatggatttcttgacgttttgaccaattttgttggttgcttattccatttgtcgaattataaagcttttcaataaacaattttaatttaaaatttctcataacagtccccccagccagaaaatattttgggcgtgaaatacgaagaccctttttcgctaacggattcaaaaaattcttcttgaattctttt

SEQ ID NO: 26118 - DNA, 1138 bp, Heterodera glycines
ctatagctttttaagttgtcaaccaaattttataaaattggtatcaatggaaagagagagactgataagccctattagcttataaaatctcaaaaaaaaacttatggcaaaaaagctaaaaattgccttttattggtcttggcgccgaattcttagaacactgtatctcaacatttggtcgaaaaatattacagtaattcccctgccgcctcccccgattccgtacccaaaatagcgtttgttcgtgtcccagccgacaggcgtgttgaagccgttctcgtaaatgggtggcagcagccgaaggaatggcatttggctgacaccccatgttggatgctcaaaattgttgcactgaccggtgtacgaactgaataagtaaattaataatcaatggtgagtgatagtgggtggcgttacggtaatttattttattttattttatttaaaattttaccgatatttggagtggaagcacatgtcttggcaagcatctttgaactgcaatttgtaataacaaacgaacaaaaggaattgaatgtcacgaaattatgcaaaaaataaatttttggtgccgcttaaggagttggttgatgcaaccagaaaaaaagttcggatgagagaatccgaaggcctttttttgcttttcggatcaaaattttttttctcctaatattattttaaaaatttcagcgccggagagcaaaagaacaggaatttgtggcaattttacgccaaaaaatgtcaatttttgcaattttcgacctaaaatttcaaaaactaaggtaaaaaaggggtccggctgtaccgataggcgccgccgggaaatttttttgaagatttcaaaaaaattggctaacaaataagcgaagactacgaaaaattgaacatattacagaacattttgaaaagcatcgttattctaaaattagatttttggtaaaaggagaatttagcatgcaacccatgaaaaaatcttcaaggcttaaatttttttctaaataattcagaattcaaccaaaaattgccaaatttttgcgattttaaggcaaacgacgaattgttttgcttttaaaaatgttttttttttgtttgcgcgcgctttttctaaaaaactttttgggaacatgggggggggggg

SEQ ID NO: 26119 - DNA, 2007 bp, Heterodera glycines
tgaaaataataaatcagagaatattattaacccgatccttctaaatattgctgcagtatttatttagagattaagtagctgaaattgtgagattctctatttacatttcattagcactttgaaattctcaaaatttcagctcattatcatggaaatataaattgtataggcgtcgcagaaggatcgagtcgataagcgccaataattttacatttattattttggtttggccagcttgtataattcttacaatttcagctcattaccccctcaaaataaactgtataagtgttgcggaagtatggagttgataaacgctaataatttccgatttacaatttacttgagcaaatttatacagatacattttgaggaaaatgagctgaaaatgtgaaaatttcacaaagatggtcgtgaaaataataagtcggagattattggcgctatcaactcaatatttccgcaacgctgttagagtttatatttagatgataattagctgaaatttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatgagtagtatagagcgtcaaaacctcgcgggtttctcgcgggtgtttcccgcacgaacccgtgcctatgggaggggtgcagctctttgatgttgccgcccggacattttcccgcacgaacccatgcctataggaggggtgcgtgccaaccgaaacctatgtgagggtctgtttctttgaagtctgccgcctggcggtttttaattttccccgaaacctcgcgggtttcccggcctatgggaggggtgcagctctttgatgttgccgcccagacattttcccgcacaaaccaaagcctatgggaggggcgtgtgccaaatcccaaacctatgtgtcctttgaagttgccgcctaacatccatttccccaaatcctcgcgggtatttttttttccgcgccgcgcagcgccgcggaaggtcatcaatcaaccacctgtcaccaatgtgacaggtggaggaaatttgaatttttcttttgcaaatttaaaatttttttttccaatcggagattattagcgtttatcaactccatacttccgcaacacttatacagtttattttgagggggtaatgagctgaaattgtaagaattatacaagctggccaaaccaaaataataaatggaaaattattggcgcttattgactccatccttctgcgacgcctatacaatttatatttctagtatatggagctgaaattttgagaatttcaaagtgataatgaaatgtaaatagagaatctcacaatttcagctacttaatctctaaataaatactgcagcaatattgtagaaggatcgggttaatgatattctctgatttattattttcacgaccatccttgtgaaattctcaaaatttcagctaattatcatctaaatataaactctaacagcgttgcggaaatattgagttgatagcgccaataatctccgacttattattttcacgaccatctttgtgaaattttcacattttcagctcattttcctccaaatgtatctgtataaatttgcttaagtaaattgtaaatcggagattattagcgtttatcaactccatacttccgcaacacttatacagtttattttgagggggtaatgagctgaaattgtaagaattatacaagctggccaaaccaaaataataaatggaaaattattggcgcttattgactccatcttctgcgacgcctatacaatttatatttctagtatatggagctgaaattttgagaatttcaaagtgataatgaaatgtaaatagagaatctcacaatttcagctacttaatctctaaataaatactgcagcaatattgtagaagg

SEQ ID NO: 26120 - DNA, 562 bp, Heterodera glycines
ctctctctcactctctctctctctctctccactctctctttccctctctctctctctccactctctctctccctccctctctctctctctccactctctctctccctctccccctctctctctctccctctctctctctctcttttttctttttccctaaaaagaaatctgatcagagaatgccatccaattcattcgtttctctcctcaaatacattaatttcatttcatttattttatcccaattccctacgaattctgttctttcttccgcgtcactcacagccataaatagtcaaaattagttgaaatgaacgagcagcgggctgagaaaggacaggaggacgggggtgggataaagtgggataaatgcggaagataccggttccgatcagccgaccaccgatcgaatcccaccgtttttaccaacccaaaaaaacggtgaaattttgggtattaaaaaaagcgaaaaattcacagaaatttgtgttaattcatttggaaaagaagattagcagaaatcaaaagttaatttgttgagttacgaattgatggagggcaa

SEQ ID NO: 26121 - DNA, 1242 bp, Heterodera glycines
  misc_feature (1190)..(1190): n is a, c, g, or t
agggctgctaattttatgtaagaaaattcgcggattatataaataaaatatgtataaaaaatgctaaaatatgtatgaaatatgtactaaaacctccaaatatgtactaaaatatgtaaataaaaatttttttaatggttatttttttggaaaaaattcttcgtaaaaagtgaactaatcacaaaatgccataaaaaggaccaaaataggtttagaatcactttttagtattttaaaaattaattttgatatctgatttttggaaaaaaccgattttttagtggtacattttcaaaaaaatttaaaaatttttcttaaaaaatttgttataaattctcaaaaattcccaaaatatgtaaaaaaaaaataaataaatatgtacgaaaaattgcgaaatatatactaaaaaatccaaaatatgtataaaaatatatacatatgtaatatgtagaaaaatccccaaatatgtaaaaatatgtaattaaaagtcccaacttttgttcgcaaacagaaaaaagaaagtgtttttcttactatttagagcatggagaagccaggaaaaaaagtatttacataaaattagcagccctactaatgagacacagccgatattagaaaatattcttaattgtctggcgggcattgagaagttggtctccaacagcaacaacaatggcacattaactgcccagcagcaggtggcggaacagatcaaagccacaaagccatcgctgaccatcacggcaacatgagcgcaaattaaacgtcaacaactttagcaaaagtaatcataattatatatataattcaatataagtgtactttttacaaatgttactcaaaaattgttttataatttcaaaaaagttgattattctgtataaattattaattttctttgactgaaatgaacttaatttgtaaaaaaatttatattgtttcttggtaattttaaaagaaattatatgtattgaattctctacaaagcaatgaatagaaaagttgaaattatcaggacatattatgaaataattaattattatcgtaaacaactctgctaatattctttttttagacaaataaaaatctgctttattggtagaacaattttattatgatgttcaaatggccttaaaatcgcatcaaaaaaaactgactttggtgactgtatctgatgaatgacatcattncacattgtgtagtgcctaatggaagcccattgtgcagtggaattacttgatt

SEQ ID NO: 26122 - DNA, 1583 bp, Heterodera glycines
  misc_feature (1506)..(1506): n is a, c, g, or t
agcttctttctgattttttcacgttaattggacctccctcttttgattgtcccttttcgcttccttttgccgatttgccctcgttaagtttcgccaaaatatttgaaaattcatcatcgtggcaggcccaattggactcgcgagttcctccgctaaatccaaaacctattcggcggcatttaaaaacataaattatgaattacccacccattcacctctctgcgtgtggttcgcatttggcttcacattttctctaatgccgtctgccttttttcccaatccgagcccatctctccagcccatctgttccatcattcttttcccaaatgcatttgtgtcgtttagccagcttaaattttgggggtccaaacatatccgctgtttccgcctcggctcagataacattgacggcgagttatgcattgacaaacaataatggaaaatgttacagataaaaaacggaggcaattttaaaaagaaaaaatatatataattcatgtttatttgcatgtttctttacatcgataatgagataaaaaaataaatataaatttgatacatttttaccgaattgtaaaataaactaatttgaagtaaatttcgcaaaatagagatctatcattgttttctgggttcaatttcaatagaccaaatttccgacataaacggaattttcatcggcgcattttggaagagagtgccggccgaaacaaataatttagtcgcgccatccgacaacacatagaggccatagagataagggaggatgaagtaagcgaaaggcatcagaaccaaatactgggcattgtgagtgtgtcctcaatttcaattgatgaaagtaaaaaacgaacgggctttttgatacctgacaaaatcaaatcaacaggatggtcatttgattgcgaaaactcaaaaattttcctggcggcacttggattatgtgctaatacgatagtcgtcgcatttttagggcaatagtttatgaccgagacatccatcacgtgatttggaatgctaaaaatagatgaaacgtctttacattaatggatcaggaatgttagtcattcggcgctcacccactttcctcgctagtgatgtcgttaaggcctatcagacaatagccattaaatttgacaacacttaacaaaaggggaagcgtagaataattccgacaatgctcaaacgaactcattcttcagaacgcggatcccataagattcaaacagtgcaaaccattcctccgcattgccgtagtaatactcgtggttgccggttacgtaaaatgtgcccagctgcgctttcaaatggcgcaatgattcaaccctttcttcgatcaatttgcgcggcgcatcgacaatatcgccgatgagaaagacaacatccgcatcgagagagttcacacgtttaacgaccgatgaaatttgcttgccataaacactagcaccagcatgcaaatcagtcaacaccaccatctaaaaacatttgttctccttattttatgattanaataatgactgtcgttttgtgatttgtttttttattgataacatgccattcatttattatccaccttgagactcagt

SEQ ID NO: 26123 - DNA, 1212 bp, Heterodera glycines
aaaaaattgatttttttgttttcggggcagtccccccgacccgatgcgcccagatttatggggagaccgaatccttcgggaatagcttccctatagcctgttctttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttattttgttttcggggcagtccccccgaaccgatgcgcccagatttatggggagaccgaatccttcgggaatagcttccctatagcctgtactttaattctgcgttggatttttgctccccataattgtttgagtaccccaaacggccgagtgagtaccttcggtgcaggaaaattattaaggaagagagttcattatttatttgttttttgcataattaattcataaatatttttttcagaaagtgttctgaaacgcaccaaattttatttacatgttagtttaggcactctgatgctttttctatcaaaaggtagatgaataaaatttttaaaaatttttaattcctttttagacaggccaaaaagtttaggcttaactttttagtgaaaattcaatcactcatttttcgagtagtgatcagaagcgcaccagattttgcaggggcctaaaaggtcaaggaaaggcgtctctgccgtgatttagcagtagtacctatgaatttaaattttctatgaatttttaaagttttttgaaatttttt

SEQ ID NO: 26124 - DNA, 1538 bp, Heterodera glycines
tggtgggcaacaaatgtgacttggcacagcgcgccatggaccagcgctccatccaggagttggcccgctcatttggcattccgttcattgaaacgagcgcaaaaacgcgacggcacgttgacgaggcattccatgtgaggaatttttgtaaatttatcaaataattttttttaattcgtaaaatttagacaaaccaaatgaaaacattaagattacatttgtattttttgagtttttgaaaaattaattttttcaaaaaaatatgcctaatttcctatttttctgaatttcatccccttttcaggcattggtgcgcgaaattcgtaaacacaaggtgcgtaatgattgtttgttttctgctaaatattagctttttccaattaatgaaaggaaataattatgcatttactcactcagtggccattggtacagaggtattttgttagtctaacaatgttggttcacaggttcgaatcctctgcgtgcatttccattttataatttttattttagctttttatgcaaaatttattgtcaaaaaattgtttattatgaaacaaaatcttttttataaattaaaaacatttaaaaatcaataaaatattactgttcaaaaataaaattttaatttttatctaatattttattatgtatctatatgtcaaaataaataaaaaataaacattttatttaattaacaattttttgataattgactgcagcattaaaagcaaaaataaaaattataaaatggatttacatgctgaggttttgaacccgcggcccgaagggttgagaccaacacactacctctgcaccactgcaaatgggctcgggttcggcccccctcagctgcgcagaatttatttaagatttttttgttttaataacaaaaaacaagattctgttcaaaattaaatttctggaaaatagtgccaagcaaattttctttcctttttttgcaaattttcgaaatttacttccccgcaccttacacattttaattccaaccgtgctcattttttccaattttcattgtccaggacaaacaccgggagaagccgaaacggagaaagcgctgtgccgtcctctgacgaaagaaggggaaaatttaaaccaaaaaaagtcgtccaagtccaaaattcctttttctcctgaagcccttctcctctcctcctaccgtacaccaccacctataatatcacattcattgtgggacattttttccgtttttcctgtcttctctttttctttctttttgaaaatccaaattcatcgacgcctcatcatcccggatcaaaaaatgagacagcattttgcataaatattattatttaaaaaaaaacaaataaatattgaaaaagttaattaaggattgcgattccggtggaaaaaagttaaatattttgttttccacaattgtttgaacttggcgatgtaccatcggcactattaccgagatgcaaatcaagacgctattcaaatgtcagatgcggattctccgacagaagcaacccctaatacgagatgctttccag

SEQ ID NO: 26125 - DNA, 967 bp, Heterodera glycines
  misc_feature (8)..(9): n is a, c, g, or t
  misc_feature (29)..(29): n is a, c, g, or t
  misc_feature (955)..(955): n is a, c, g, or t
tctagagnntcatgccaaggaaaataaancggggaaaatgccaaggaaactatacggagaaaatgccaaggaaaataaagggggaaaagccaaggaaaataaacgggaaaaatgccaaggaaaataaagggggaaaatgccaaggaaaataaaccgggaaaatgccaaggaaaataaacggggaaaatgccaaggaaaataaacggggaaaatgccaaggaaaataaagggggaaaatgccaaggaaaataaacgggaaaaatgccaaggaaaataaagggggaaaatgccaaggaaaataaacggggaaaatgccaaggaaaataaagggggaaaatgccaaggaaaataaagggggaaaatgccaaggaaaataaacggggaaaatgccaaggaaaataaacggggaaaatgccaaggaaaataaagggggaaaagccaaggaaaataaacgggaaaaatgccaaggaaaataaagggggaaaatgccaaggaaaataaaccgggaaaatgccaaggaaaataaacggggaaaatgccaaggaaaataaacggggaaaatgccaaggaaaataaagggggaaaatgccaaggaaaataaacggggaaaatgccaaggaaaataaacggggaaaatgccaaggaaaataaagggggaaaatgccaaggaaaataaacggggaaaatgccaaggaaaataaacggggaaaatgccaaggaaaataaacggggaaaatgccaaggaaaataaacggggaaaatgccaaggaaaataaacggggaaaatgccaaggaaaataaagggggaaaatgccaaggaaaataaagggggaaaatgccaaggaaaataaacggggaaaatgccaaggaaaataaaccgggaaaatgccaaggaaaataaacgggggaaatgccaagaaaaataaacggggaaaatgccaaggaaaataaaggnggaaaaatgcca

SEQ ID NO: 26126 - DNA, 1826 bp, Heterodera glycines
aaatcattggttcccacattaaaatttatttgtcgacccttttgaatttatacatattttgtcaacattatataaatttataaaatatgtattattagtgcttaattgatcccaatcccccatcattttgcttcatctttcgccaattatttcctttcagtcgcccttcttctccccctttttgctcttttcgcagtgccttccccaaaaattggtttggcacacgcatttggcactgtcagaagtggccaagcaccacccgtgcccattgcatccgttgtgtccaggacaaaaggctgaaatttgttaaaaatggcgggcctctaacaaagccaatttttaattagccagtttagcaaatgacttgccccatttgcaaagagggccacagaagcccttgaaacaaaggcacaacggatcggacggaatgccaaaacaaatgccatttgaatggcaatcggacgaagtgcatctctgctgaggtcagagaaagtgcttacaattagcccgtgccctccctctctcggcttcacctcttcgttgcttccatttgaaaaagttcggatggcaattgccaaaatcgccgtccgttcggtgcccttctcctcgtccctccccgcctctgttgatgaattgcctttggcttctgctaacggtgcggctgtcgttgcgattgtttcggcatttttcggcggatcgtcgcattcttcggagacaccgcacgacgaagaagcgacggacgcttcgatgagctgacaaatgagacacaatttaagcattaaatccactacttggtcaattagtgtacttacaattcgtttgggacaaacgccgcaagggaaagggcgcactttggacaaagcgacggagaaaacaatcagcaaaaaatgttgccaacttaacggcattttgacgagactctgatccgaatctctgtcacttttaggccaatggctcagtcagtcccaaaacatttgccataattctctaatcggtcgcttttattaatcccccacaaaattggcattttattcgtccgtttgtttattttcatatttttattttgttttattgttttgttcatcccatcccctttttattgcctcataattttactttcactgaattttaatgggaaattccgctgcaataattggcgaattatttatttatttttgttttgaggacgttttttgtacgttccgccgtttccgccaattgatcactttctttcgttctttctttcctctttctgatcgttcgtttagtccgtttcgcccgccatcagttcccaaaattcctcaaattcgatctttccgctgccgtcctcgtcaatttcgtccaccgccgcctccaaatccttgtcgctgagatcgggtgcaatttcatgcagcagtcctttgagcgtggggcgcgaaatgtaaccattgccctgaggggaaattggaaatattaaacggtgccaattatagcaaaatgccaaaggcccaattagcatccggccaatggatgaataataataattatgagtgcttcatctgcccatgccattccaattttactcgcctccttgtcaaacagtcggaatgcctctctcagctcttttcgcaacgtgtctttgtccacagtgttggccacagtgtacaccaacgcgcagaattcgtcgaattccaatttgcccgagccgtccgcgtcaaattttcggatcaatctgtcgggagcgggggagaacatttgttgtatggccaagtgcaaattatacgcaattactacccactttctgagaatgttctcgtcaaagtcctgctccatcgcgttcataattt

SEQ ID NO: 26127 - DNA, 1569 bp, Heterodera glycines
  misc_feature (17)..(18): n is a, c, g, or t
  misc_feature (29)..(29): n is a, c, g, or t
  misc_feature (36)..(37): n is a, c, g, or t
  misc_feature (50)..(50): n is a, c, g, or t
cttgcatttgcctgcannggtcaaatgtnacgatanntttttggcaaatnttggtgcaatacggcatatacgaatgcaagtttttcacaactattgttaaattgtgctactattattctgttaaagtgggaatacgcctgagtcacgtggtaccgcatttgttggtgagtccaatgaaataaaaaattacaattttgcaaagaataattattagtttacgaggacgtttttgatgcgaagaatgcctgtgatcacctcagtgggtttaacgtgtcgaaccgatatttggttgttctctactaccaagcgacgaaggtcttttatatttagatatttacacttttgaattgcttttttgctgcttttaaaattacttttaaacatgaaaaaattgtcaggcatggaaacggatggacacggacaaggctcgcgtaaaattggaggaagtgaaggaccgctacggattgggcggagacattgagaaggaaaaggagaaaatgggcatttacacgcccaaacacacgcccggagtgagcacgccgcgacacaaacactgacaataaggcgtggacaccgaatttttattttttttttaaagttaacatgaattataccaaaaaaataccatttcgacaggattgcaattttcataaatttttctgtaaagttttctggaattcatcgttaaaccaaagtttttagttattttaaatttggatctccaattgatatattttgctatttgacttgttatgactttcccatttcttaacttctaatatttccatatagtacaatggaaggcgatccaacctttgtaaatgttcaaccaaatttcgtacaacagaacttaagagaattgttagattcgcatttgccaaatcaaattgcccgttttgaggagagcagcgtaaatttggagagagtggctgccttttgtgaagcgaattaccttcaggtgaatttgattatctgtgttaacttttaagtgtttggtggtcatttatgcttgtgattggctatgacaagtccgaattgttcgctacgcaagaaaattttatttagtcgccaaacaaagccgaggcattggcggagacaaaacgttgcgcgctgcaaagtttggcgagttttgcttttatggttggcgatttgtcgcgctcacttttgaacgcacttgacttggaatcgctgaatctgtcggacaaaacttcacaaattcaaaacattgcgcaggcaaaaacgggattttcgaatggaacacattaatcgttcactaaatttttagttcgtttcaattcaaaaggaaaaatcggcaagacgagaaattggcaaattaacggcaaacaaaaatttgatccgtctcaacaaaatcacttatccttcttcagaagtacttacaactgctgaattatttttcaattgttttctttttaaaggagcgtaccccgcggtatcaccgaactccgattgattttgcgattctcgacggaattggaaatggcaagcgactagtgcaatcgactaatgactatggcacaattggggcggctcgtatgcaaggaacgtaca

SEQ ID NO: 26128 - DNA, 1313 bp, Heterodera glycines
  misc_feature (1244)..(1244): n is a, c, g, or t
  misc_feature (1265)..(1265): n is a, c, g, or t
cggaatgggagagaaggaagagtgatcggaataggacctttggaggagtgaacggaatgggagcggaggaaaagtgatcgtgatgggagcggaagaaaaaactgatcggaataggagaggaggaaaattgatcggaatggaagcggatgaaaaagtgaacggaatgagaggaggaaaagtgatcggaatggaagcggatgaaaaagtgaacggaatgagaggaggaaaagtgatcggaatgggagcggaagaaaaactgatcggaataggagaggaggaaaagtgatcggaataggagaggagaaaatgacgcgagagtgaagggcatttgcgggttgaatgatcggcgattgtgaagtgaacagagaagttcaagcgggacgaaatagcataggcaaactcaaccaccacggaagaacgcaagcaaaaaaaaccaaatgtcgataaatcaataccaccaccaccaccactgatcagtgatcactgatcagtcaggcaatttccattagcaaaaaagtcttcattctcccacagcagagcagggacctcaaaaaatttttgacttttttatgggttccatttttattctatttttactccatttgtaaatacttcctcattaacctccccacacgattagcaaagggtagttttttgtgcgttaatgatttgctaattatctaattaaccaccactcactcacatatgaaaatcaaatgacaacctttgtttctatctatttttttttgttcatccggtagaagagaattttgtcgatttttttaatcgttcctccgattttcacatttcattctcctctttctttcctatccattttctttttttttgatcagccactccaatcagtttttgatcactttgatcaatttgtatgagtcatttaatccaggctcactgacacattgcgccccattgatcaattcattcatcccattttgattggcaaaaatctgattgcttggccctttggcacaaaactggtgattaactcaggttaattacctgttggccctacacagtaatcacacattattactaaatgtactacttcttttcggcctcccggtttatttaattatatatatttttttttgttgtccccgtgttttcttatccaataaaattatcttttccatttatattaactaaaaaattatttttcgataattatgataataatacgggaaataatgcaaaatcgtggtctctaagtaattttaatnctttatgttaaaaatactacncgggttaatggagtatgctggtcacgaatttccaaatcccggacacga

SEQ ID NO: 26129 - DNA, 1373 bp, Heterodera glycines
tatttagagaaacctatccattagcacaattttgacccgtcttaagcaccatatttggtcagtccggttaaaatgtatttacaaaaattattcatactgtacctacagtattttgggaaataccaaacttctgtcattatgcttatactttatcattataaaagattgattagccaaaaatttgttgtgtaaatctgaaaattttagtttcggcaaacgcgctctcttcccttcggtggcattggatgataagcgcaacccaccgcaaccattcggtaaattcttggcatttagcaaattgctaattttttttttcaaaaattaaaatttctagtccgctttggtcgctcagcagcagaaatggtggaccaacaacaacagcagccctattttccagcgttatgagctagaattttggagggaatgccaaagaatgttcaaaacaaaaaaatgacatcatttgaatttgtcagttcgccaaaacgccaatattttttttttgcattataaatgattctgtaaaatccaaaatatttttgactttatattaaacttgtaatataatttaataaaacttcacttgaaattttattttgaaaaaatcaaattattcttattaagacaaaatatttttttttatttagttttaattagttttttacatttcatatttaattttcttaaattgcagaattataaaaatgtgatgactatggagctgacttaaatggatttctatatttttaattgaactcatttcggacttaatgtttattgtgttttagcttcttggaagaattttattcccaaatctttctatgtttcaaaatttttttgtctctcttttgctggatactcatataaaattaatcatccttttaaaaattccaaaatggaaaaaaaacaggtaatttgttttactaatttgtaagattaaatttgggtttgtaacttgtaagctatatacgcctatcgaatttcaaagccgagatgaaaacgaattaaaacaccattttttatattttttaaattttcatttcttaatttgttcatttttattttgttagcagtggaaacgtattagcgatgacaaattgggaaaaaactgtgcaaattccattgattgaaaaagagataaaaaaatagaatgaataaattaattttataaaaaataaacgaacaaaaataatattcattaatagaaaatgtattaggtaaatgaaatgaatgaaaagaaaataaaattgaaagtgtaaaaaaggaacgattaaagaatgttaatgaacccaaattagagggaaaatggccgaaatgccattgcggtaatgccaaaaaacaatttgttctccgctgcgcattacgtccgcttctct

SEQ ID NO: 26130 - DNA, 1327 bp, Heterodera glycines
  misc_feature (1136)..(1136): n is a, c, g, or t
  misc_feature (1147)..(1147): n is a, c, g, or t
  misc_feature (1228)..(1228): n is a, c, g, or t
  misc_feature (1232)..(1232): n is a, c, g, or t
  misc_feature (1277)..(1278): n is a, c, g, or t
gccgtgcaacaaaaccacccggcacagcaaaaaccctttcacaggaggaaaagcaattcgtggacaaccgacccagccgtgcgggtcatgtggggggacagatagatggagagggggaaaagaatgatgaagagagagacatagagtgggtgagagagcaagaaaaatggagagagatatagagagagagagcgagagagagagagagcaagacaaaaagtgagtgaggtagagagtgatcagaggaggtgtgaggcaagaaaaggaaagacaacgatagagactactaagcacactttcgctgatccctgatcagcttagttgacggatagaaattataatttaaaaaaaattatttttttaatccaattttatttaaatttatatttcccccaaatttcaaactttttatttcttagttgaagccttttaaagaaaaaaaagtcaatgccaacggattgcgtttgaataaattataattttggaaacaaaacaaagcaaaaaacggggcaaaaaagtttgcggagcacaaaggtaaagcttttggttggaaaacaaaagaaagcattttatgcaaaggcatttctgcaattttttgaaaaaattcaataaaataaaataacaatttggcacaaaatttttagttaaccattaaatggcacgaaaatgccatttttggcacatttaaatgccaatttgtgatcgttgtcaattaactcaaaacaaatgccctcattaggggactctgaaaatataaacacgctctttttgccgtgctcattggctgcccacccatcggacagacaaaaaatggcattttttctttattttaaataatggaaaaaacttaaactaataaatttgttttattaatataaactaatattttaaaattaattaataaacaataattatttaaaaaataattattgaaatagaaattagacataagcttttgtgcaattatccagtgcgaatattttgattaatgcaaaaaataaataaataaaaagtacacaaataataataatgaaaattgccatttttaattattatttttttggattttgctttttattggtaaagaaacaaaatttcttttattttttgaatttcataatcgaaaactgggttanatcttatttanattggtaaaaaattgcaaattcagacctataaaatgttcaaaaattatttaaaatttctgttttttaaattgtatgtatanattntgtcgtaaaaacgcaaaaatccagcaaaaaaaatgccgaattttnngcagatatgccagtccaaccctgccctctaatgatataaacctactact

SEQ ID NO: 26131 - DNA, 1002 bp, Heterodera glycines
caaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggaatgccccgaaaacaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaaagcagaattaaagtacaggctatagggaagctattcccgaaggattcggcctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattattaaaaatttttagatttttattcatctccctttttgatagtgaaagcatctgagtgcctaaaataacttgttaataaaatttgggtgcgtttcagagcagtttgtgaaaaaatatttatgaattaattttgctaaaaaaataaaatagtgaagctt

SEQ ID NO: 26132 - DNA, 1919 bp, Heterodera glycines
  misc_feature (881)..(881): n is a, c, g, or t
  misc_feature (898)..(898): n is a, c, g, or t
tacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaggccaacgccgngggaagaccggcagaanagccaaccaaccagtaacacacaaaagtgtgcaccggacggctagcacagatccaactacgagcttttaaccgcagcaataattctatgcatttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaacccttatcctccgttacccgtcatcaccatggtagtcagatacactaccatcgaaagttgataaggcagacacttgaaagacacgtcgccggtacaagaccgtgcgatcagcttagttgttctgagtcaacactggacgcccggagggcgcttggttttgtggcgaacaaatgcgctccgctctggggagattggagctttggtgcatgtattagctctagaattaccacagttatccaagtaagaagtcaaggtcaagtaaattatagctggtgtaatgagccgtacgcagtttccctgtctggcaggttaaacttacacatgcatggcttaatctttgaaatgaacacatcagttcaggcaggatcaaccagatagctgctagcgagcgttgccaagcgccgctattacagccgtcttgtaaagacggatagtttcagcagaaacaactccgttcagcgcaagcgtgcgcatgggcagcgaaggagacagagcaagtggtaatgacacagcgctggccaggcatccgagcttcccggacttgggaagaaccatctcgccgctggacacagctccgagggcagtgcacaggcactcacacgagcactccggatttcccggttaggacacttcctcaggccaaaggccttcgggcgcttatgtctcgtgttttttcgaatgcaagcacactggtccccaggcaaggagt

SEQ ID NO: 26133 - DNA, 1072 bp, Heterodera glycines
ttaaaaatgtctaaacaaaaaaaaagcaaattaataaaaacaaaaaaaaacatgaaaaaaagatggaatttgaaaaaaataataacaaatcataaaaaataattcatttttaagagttcaaataaccataaaaaataggataaaaattttaaaaaatggaaatgacaagatttagcatggaaataacaatcagaagcaatgattgattgtattgtcaagtgaaagttttgggtaaatttttcctcccaaaggcaaaaggataaaattacagaaatggcacaaagttgccacatttttctccatttatttgctcgactgatcggcgtccgctgcctccattgtgccgggtgcacccggcggaaggtcgacgcgcaattttccgcgattttgtgcggtcgaaggggcgaaattgtcggaattgtcccaattgttttgcgtttttgggggcgcgggggaggggaattgctgctgctgtcgtcgtccccatcctcctgtgtttcggataaattccgtttttttttcaatttttgccatttatttttcgattcttttcaatttggccaccttctacagctgctgttgctccctgctgctgctgcggctgtccccaattctgctgattctgtccccattgtcctcctcctcctctccatgcgttttgtcgctcgaattgtccattttcgccaccgttttgttcatgggtaccgtatctgctctgttgcccaccgtatccatagctgggctgtgttcttgagttaccgtaactgctgctccaataatttgttcctattgaaagaattaaaggaagataatgattgatttaacaggctcaataattataattataccagaattactcaaatatttcccactgaatttaaaaaccgctgggaatacatttaatgaaatgtatttttgcgtggatttttgttaaaagtaaatattttcttatgaacctttccttaagaaatacagcaagataaaacaaaaatggtatttttgctgcttttaccgtatgttccgctcccataactgtggctaccgtatcgctgagcattaatgacaataagaa

SEQ ID NO: 26134 - DNA, 1218 bp, Heterodera glycines
ggtaaaaagccagttttcagaaaccctatttttaccagtgcattttttggactcggaactaccgggttggctatgggtactggatttcctggatctgggtcttgaagccgggtaggtcaaccctaaaataattaaacatttcgttttgtatttctttctcaaattccaagtcgctttttcattttgtcccccgcttttcccggatccgataagcccatcaatcgacggatggactaatgaaactgtcattcacctgccgctgttgccccatcgtctaatgactctgctgtctctgctaattagtgttgagaatcatctcagggtttgctcctcaaattgtctcccattccaccgaattccccgggggataattcgcaaacattcgcttcacttctgtcgctcattcacttaacaattggactatttgctgcagtccatctgatccaaatcatcgcaaatcccacacttttgtccacttgatctgataattttttcggtcatttacgcctatgtacaaaatcagtttcatttttataattaataattgaaagtgtaaaaagcttttaacatttctctgttggttcatttttaaaatggcaaaaatgctcatttcacactttaaataattttgaaagaatgactttcttaaataaatttgaaatttgaaaaataaacaaaaaaagtggcaaatggcagagcactctctttttgaatcctttttctttctctgtcttggcataggtaaattgtttcatttggccaaatgttggcccttttttcttatcggcgggtgaaaacgcaaaaagcgcctccatttaattgatggccattaccaatagcaccacacaaaataacaattcatataaaatagcaaagaaataaaatgataggaattttatggtcgcataaattcgcattttttcatttgcttttgtcggattttctttgatcaaaatcaaagtccgttcttttgagtcattctttggcctcacaataacaaatagcgtgagcttctaatgacgccgctcatgctttaaaagtgctgctcgagggttaaaataattcataaactcgagaaccattaccaagaattgacaccgcaaatcgagacccaaaacccagagaaattactcaactcgaaaaccgagaatcccgagcagtgctacttaaaagcacattccgaccaatgcttgttggttactgctcgttttgtttgtt

SEQ ID NO: 26135 - DNA, 1937 bp, Heterodera glycines
  misc_feature (1800)..(1800): n is a, c, g, or t
tctcaaggtcatatccaaccaatttcgtttttcctccttggacggaattttttacttttgggatgaaccacccccctttggaggataaatttaccaaatcggcagattttctccccacatgtggtttttccttgggtgggtgtctctccacacttttcgcattttttgtactccctacaagcagtcttcttgtgagactcaaaacattccgtattgtagaagttgcgattacactccgcgcaataaatcccagcacacacatccgcacatggaaacccgaaccccattctacagcacttcttgcatctttccttacattccaatcgatgtctctccggcctttcgcgtgtcacttcacagctgacacaaaagtttcgaacacagaagaattgcgtaactgatttcattccgtcccagtggtctccatcttttatcacacatacttcatttttacgaattccttctcccttgaaaataggtttgattcccgttctctggaaaattaaatgttttttcaaagtgcgtaatttttttaccatgtcaaatgccactatgcgaaacatttccgggtattccttgtcccaaaagttctggatgagaccgaggtgttgtagaccaaaagttttttcctccccgcttatcccggccttttccatcaatttgacagccatttctctttgttttttctctgttttcatgagataacgaaacttgttttccgttatctcctttccaatcaatcggtaatttcgggcgaattcaagggagtaaaataggcctaaacaaaagttaaagatttgcaaatcttgtgctgaatttaaagtgatttcgaactcactaaatttccccttcggagcggaaaggcgtcccaattccttggtttcaacgcgagggcagaaacgagacattttcagcaaaaaaagttgaagaaaagggaataaatagaagacgaaatgtcaggacaaaaaaacagatagagagaagaagaattgaaaaaggacgaattaaattaggaaattgaagacaataaaaaagaaattagctgggcgagaaggttggttgaaaaagctgattttttgagagagtagaagagtgaatgaaaggacgccaattccggcacaaatgcgaaggggcggagtaattagcggaagggtgtgatcgattttcagtggtgtgtgtggtgaaagaagggaaaagaccggcgaaagaagcaatttgaacgccagcagagaaggatggcttgcgagagaaccaaaatttgaattttggcaggctacgaaatttgattgacaggtgggaaggggatggcaccccgagaggggacgttttttggtgcatgacttccgccagaagggaaaacgaagcgcatagagtcccgaaagattgaaatttgattgacaggtgagagggaaaacggtacgctagagtcaaatttgaatttggtcggcgacgaaatggaaaaggaagccgtcacattatttcactgctgcgtatttttttggctggcaccaatttttttggttggcacgggcgcaaaatgccgcttttgaaatatgattgggaaaaactgaccattaaatcacataataacacaacaatacctgtcaccccataccaattacattacgaaacattttttcaccattttcacctgttttgacatattttttcatatgtttcacacctgttatggaatattttgcccctcttttcaccacttattcctggacatttcacatatttccttggttttaacctcttttcaccaggacattttataagcaataaattcgtctctanattctgtttttgggtctcggcctttccaaatctatttgcttgtctcgcatttgttcttttaatttattgggccactctccaatgcctaaatcgggctgtgagtaagcgccccgataggtttgaccaatttcctttct

SEQ ID NO: 26136 - DNA, 1175 bp, Heterodera glycines
ttgccctggaatccggtgacaattgccagcgacaaatttcaagtacacaaaaaataatatatccatggacaaggacctatgctaggacaccaaattaaggacagtttaaaaagccccttgaaaatgttcaaggaccgaagtctgagtgtaaatttcatttcaagaacattaaaaagcctaagaacgagtcgattttaagtactgttcttgaaagcttaaaactaaaaaaaaatcgattttcaaggactttcttgaaattttatgtatccagtccctcgcctaaggtttaaaaaaaagttgatttccagctgcccgattttcgttttgtcaacctgagctatggacgccaaatgcgccagtacaatgccggcgcgtttgatcagttaaaggtgaccttccagttcaaacggctctacgggtattacattgttcaggtgataaagaagaatttaatttgataattttaaaatttaatttcaattttaaaaattaaattgaaaattattgtgcaattttttttaaatttcttcgttcacttaaggcttatttgccttcgtacctttttgtgttcatttcctggatcaggtagcatatttttttttgaaaataaattattgattgaaaatctacaaattctaagtttttggatcgatcgctacgcacttccggcacgaattttattgtgtgttaatgcggcatgtgcgctcatttaccaagtgggtgattaatagggcacatcaaaaaatatggatataaatttcataaagctttaaaataaattgtgtttttaatttagttttcttagaaaaatgacttaaaattaatgcgaaatttccctagcattttctacaatcaaatgatttgtttttttttacaaaaattcactgtttttccaaacttgaaaattgtcatgcatgtataattcaacatttttcaagttattgaaattttgaaattttgcttaaagatgtgatttttattgccaaaaaaattccatggctaatgccaaaatttgcctctgttcagatgggcaatgttgttcagaatttgccaagagtctcttatgtgaaagtaaaaaaaaatatacattttttggcaaaacattttttatttaggccttggatttgtttttctttgtcagcatttttttcatcttcatgtcattgtgtgaaatg

SEQ ID NO: 26137 - DNA, 1651 bp, Heterodera glycines
  misc_feature (20)..(20): n is a, c, g, or t
  misc_feature (37)..(37): n is a, c, g, or t
ttatgaagcctcaaagtcgntcacactcaaattgccnactttcaaagactcccacagcgaaatgacgatgttcccatttgttacagaaacagaaaataatggagttgaccatctgctgtcaacgacagatcagcggcaaggttggacaataattcaaaaattcgagatttattttttaattgttttgtcaatctggcatgataatggggattatgccattgatggggagatgagataaactgctggtctctattcggggtctctttgttctgtcactttcccatactttcaccttttaaaacctaaagtttcgaaaatttgtaaccagaagagctcttcacaatagtttttggttgttaaaaatttgtaaaaattcccaaaaaattttaaattaattttttaaatgccacaaagttcaaaaagggataatttgttgcttgagatttaatttaaaataattaatgcaaaaaatttattacattaaaagctttttaattactgttttttaacagttgaacaaaacgctacagaaaaaaatatgtgcaaatttggtgccatttcgtgtgctaattgtttaaaagaaaaggcaaaaaatgagaaaattcaggtgagtattttgcagttcatcttaaaggatcatcatcaatagggatgggatttctaagtttttacttattttttctgcggctttaactcaacgagaaatacacgaaaaacacattttttgtctgaaaattttgcgttttcacgcccttattcgaccttagaaatccttatttttgatgttcgcccttaaaaatccttattttggatgttcgcccttaaaataagtttttgcccttattttggcgttttgtccaaaatttattaacaaaaatgcaataaaaaacgaaaaatacacccctaagaatcgacccaaaaaaatttcgaaaaaatatacccctaagaatcgacccaaaaaaatttcgaaaaaatatacccctatgaatcgacactaaatttttcaaaaatagaccctaagaaatgaaaaaatttttctaaaatatagcttatttgtaactgcaatcagtgaataaaattgtttgccttagtctgaaattatttcatgtaaaaaacagcaattttaaaaattatgccctaaatttgactttttcgaccttattttcgcccttatttcgcgaatttttcgcccttatttacggccttattttggactttttcacccttaaaaatcccatccctatctatgagatatatttacccaatttttaagaaaaataagggttatagtggaaaatttttgaaaatttgtttggatttgttaactgattttgcctaattcggagatgattttttgataacaattttccatttcataggggtgtatttttctgaaatttttcggatcggttcttagggggtgtatttttcgtttttattgcatatttgttaataatttttttgaaaattgctgaaaatatttttaaaaatttctcaaaatgacagaaacagcacaaaaaagcactaaaatgccaaatcagcacaaaaatcaaaaaatcgagaaattagcaaaaatccgcatgaaaaagtgggcttagaagtctcaaaccaagttagaaatgcgtttttcatgcttattatcacgccccaa

SEQ ID NO: 26138 - DNA, 1450 bp, Heterodera glycines
caaaaaaaaaccagaatttctaaaaaaaaatcgctggaaaatgttacagaataaaaattaatataagatttttaaaatccaattttatattttgacaattccaataatcaaattaaatttatttttcttttacccttgacagaattggctttgtgtttgtgctcaacgattcgtcggcagttaacggcctcaacgatttgggccatgccattcacaacgtttaccaattcgtcaagatggacaagggcgccgccggagcgctgctcttcctcaaaaaagtacaacagaaatacaattttaaacccctacatggaaacacttaaaaagttcctaacccttattcaattaagacggaaaatttttcaaagttcaaaaatctcgcgaatgcgagaaattattaaaattgaaaaactggaccgggatttgaggcaggtcgtttccccagccgattcccatcccccggaaaattaaaaaaaataagtttaaacaaatttttcaagaaaaaattcttaaaaacttttgtttgtaagaaattttaatgaaaaaaaattataataaattttcagcgattttttggatttttttttttgaaaaacagtaactcatcataaaatttcaaaaaaacgctagaaaaattttttacaattttttttttgagcattgaaatgaattggccaattttttggatttctatttgtatcctgctgcagatgcttgaccaaattgcgccgcccaccggcagcgccgacaccgataaaatggtggccgatgtgcacgcctacttcctgcgccaccacacggaccaggaggtcgctgatgtgttcgggcctgactcggactacgccggcggcggcaccgccggcacgcgcaccgatggcacggcattccttcgtcgcagcggtctccaacggttgcccgccctgctggtcaacggggtgccgttggacaacgcattggtcggtggaaaccaataaagtttagacgactcaaacaaaaaacaatttttttattgggttgattaaaaagttctgaccctttaagcacttcaacattaaacaattttttatttcacaaaaaacaaatgttcaatcaatgatgcactcaccattttgatcaatgatcctcccccatcgttcgggcaacatttctatcccctttttataaaactgatcatttttcgatccaaaaaagccatccaatgcattttcgacctcgttttgatcagcaaattctttccctctcaagaagtgctccatagatcgaaacagatagtagtcacacgggctgatgtctgggctgtatggtggatgaggaagaaccgcccatcgaagtttctcaattttttgttgcgttgagaacgcaacatgtgggcgtgcgttgtcatggagaaggagtacgccgccgcggaatatgcggaaaatggaggacgacgaatttggtcatgaagatg

SEQ ID NO: 26139 - DNA, 1265 bp, Heterodera glycines
caaaataggcactaaatagcacaaaaatcctcaatattcactaaaataagcaaatagaaatttctttaacgcttttaaggtagcaaaacgtaaaacttgataaaaagaaagtaaatctggttaaatttaaattgtaaatgaataattaaatatctaagttttttttggaataagaacaaaattttaaatttaaaagattaccaaaataaatttttatttttaaattaatttttgggaaaattttttcaattcttaggggtgtattgtcagaaaatttttgggccatttcataggtgtgtatttttcgtttttattgtaggattttcagaaaattctgagaaaggcaccaaaagtggcgaaataggcacaaaaataggcgtttaggcattaagcacaaaaagcccataataggcaaaattgggcattataaaagtcatcgtagacaccccaaaccagagcggaaagggcttttttcgtgcttatctgtgcgtattaagtgcgcaaaaattttaggcattttccttaaaacgaatccctattagtggttgattaatgctaattgtctcttcacctttctgttaacaatatgcacggtcaaatcgtcggctggcgaactcagcggagggcatggactggagaaaaattaaaaaataaataataatttatttttaatggaaattttcacttttcgtccatgttttcgcgttttttgagaatccgtaccagcactgattgtgtgggtgagatgggcatcatgggttgattagtgccaggctttactgacgccgatggagtgccaagtcttaccgtcgccggctgctggaaattttgggccccgtagttggatgggccctgggagatcgcataaaaaattgtcaaaaaaaactagaaaaccgagccacagtcattagtgctgttcgagaacgaaaaattttccgatccaagaccgagacctgaccccgagaccgaaaaaacccgagacttttctcaagtcgagactctcgaacaacactaacagtcatgtcaccaaagtaactccccatccctctaacatgcctgctgggaaacaaactgcagttgggcatatggctgctgttgctgtacggcataatacgttggcattccgcccatggcattcggttgggcttgaagtgttggcgttccgcccatagtgttggcattcgtttgggcttggtgttggcgttccgcccatagtgttggcattcggttgggcttgaagtgttggcgttccgcccatagtgttg

SEQ ID NO: 26140 - DNA, 1716 bp, Heterodera glycines
agatacataacttgagaaaagcaggaatttttatactaccccaaaataaatgcagccaattagtgctaatgactcggtccttcaaaagtttccgaattgtgagcactaagcacaaaatgtaattggcctgagaaaaaagtaccctctaaagaaacatctgctgcttggctctcatttctcttctttcagttgacaaaattctccatttctttgattgcctttttccgaattgctaattgtcgatgccctccctcatttttggcacttttgccccattgttagttacgattcggcaaatagccacaggtgaaattggattaagagttcaacaattggattaagagttcaattcagagaatcttattcttcatttttacagttacttacaaaggaaggtccccaggtgtccttgaaagttttcgagaaaaaaaagtcggcacatcgagacagagacttttgtttatcaaatgattttatgacaaattaattgcttgtaacgcgccgaaaaaggcagctgacaaatgagttgaagtcagcttacaaattaggaaaaaaatttatgattctaattaaaaaaataaattgtggaaaataggttaattgtaagtctctcttttaaaaatcatattttggctaaaaaacgaagttttcatgaagtttaaaaaaactaatatatctttttgaattacaatcagagttgggctgattatgtagaaggcctcataattagggcgtgtaattatatggatataaaatcgcgaaatatggccataaaatatggaccaaaaatcgcaaaatatggacataaaatggcaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataaatttattaatttttaagaaaatttaaatgtattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggacaaaatgccaaaatatggaaataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctactgatcatgaatacggcatccatttcgaccgatttctaatcacgaacccaattcgaacaaaaagtcgaaaagtcacattttcgaattttgagtttgtgggtcgaactagctctaaataccttaaaatgaacttcaaaatcacataaaatactaaaaaatattattaagactctttttggtccaaaacccaaaattcgaaaatttgacatttcgactttt

SEQ ID NO: 26141 - DNA, 1164 bp, Heterodera glycines
caaatgtttggggtcagatgctgtgaatgcgaccgattcattgctgggagagtgctcgaggtctgttggcccgggttttcgaaccttcttccgtttttaggccggtggctacaaattccacccgacttgcgctcgctgttcacgctgtcagctgcccttcgacgacggggccgagatgtacatgcagggcaacgagatatggcacccgaattgtgagcactaccggacgacggagaacattgcagtgagaaggcggcgggggcaaaagcggagacgaatgggcgaataattggccatttcggacagatttcgaagcccagcgtaaagggcagcaaattccaatcgcaatttggtcagcacctcacttacatgtgagtgggaaggccgacaagtgaattgaagaacaattgccgcaggtatatgttgccggagactgaacagactttgctgaaacatccgatcgcgccgaatccgccccagccaactcagtaccacacgccgcaggggccggtgatcaaaatacggaagtcgcgctattcaatgctgaagacggggatgcagcggctcagtgagtccatcggattggaattcaaatggggaaaagggcattttgtgccttccattgtcagccgaagacttggaacggactcggccccgttctcgctcctcttccgtggacaacgacgaacccattgaattggctcatttccccggcgccaaagtgcccgacaaagacgcggtgccgcccattgatgtgtgtcggggttgggctgggccattcccaccgccccaatgccaatgcttcagagggaagactttcccgcgccgccttacccttatgctgtggaagagttaaagcgccgtttgtcctcctcctcggtggaaaatgacgacgaagaggaagaggaagaagcggtcaaattggcacatcacagggcgaacaaagcggagaaagtgatgaaccgagcgcagaaagtgttggacgacatcgaacagcactcgtccattgcgcacgtcatcaaacagaaattggtggaggacagcgagcggaagcagcgattgtgggagggggggggaagcgactgaggggacgcacacttttcagggggatggaccagcgactgcattgggacccccggtaattgcggacgggggggggggaat

SEQ ID NO: 26142 - DNA, 1051 bp, Heterodera glycines
  misc_feature (973)..(974): n is a, c, g, or t
tcgcatcaccgtttgctatggcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcatctcttttgcgtcccttaatcttcactctgagccgagttactgcggtctaaacacgtttttggtagaattgcagccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcatctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcatctcttttgcgtcccttaatcttcactctgagccgagttactgcggtctaaacacgtttttggtagaattgcagccagaatttaaaaatacagtttgctatggcttcgcatcacccgcttcaacgggcgctcattgtaaatatcgactggccattcaaattctgcctttccagccttatggaaagatattatgggaaactttggttccatctcanngtgtcacgccgcgactgaatcgttattatatcagtcgatagattttcgaatcgcttttaatcatctcttttgcgtcc

SEQ ID NO: 26143 - DNA, 1351 bp, Heterodera glycines
attcgactctacttatggcaatagtgacgttctagaccgaaaaattttcgacacattaaaccgagacctagagacttacaaaaaaatttcacacacttaaaaaccgaaacacacctgcaataaataaattttaaaaaactaatttattttttgtaggttttcctgtctagaccagagatggcacggaattccgggttcagactccgttttccgtcattttggggtcggaatttcgatttacaaaaatttttggggactcggaatgccatccttggaccagacgcgacaccaattcctcccgaacattatgaaatgggcaacacccgctgaaatgttttggctcaccgcgtcggccattccgtaattaggcaagtacaacacactgtcatacaattgtgctgcatcatctactgcttttgttgatgatgtcgaagctgctccgttgaatgatcgcaatgataatggccagcccttggccatttgccaaaagtttttttccgaacttttttctaatttgtctctttccattgctttttcttccaattttttgaacattttttccattaatttgtcaaattttgcccgtgccgatgactcaccactttttgaattttgcccaaacttttccttataataatccaaggtttcctgctcattttcaagttgaattgtttcggccaatgtcgaatcatttctttcaattaatttcaattcataaatacaaaatttcgaaaattttgccattaattccaatgccgacattaatgacatcaaaattgatatttgaaatccaattggttgcttgaaaattggtttcattatatcctcttgttcggcataaacattgaacaaaaattcgtaaacaatgcacaaataattttgaaacagttgacattcctctgggtcgataaattcttcaaattcttccctaacattggcacaatgccaattctttcgcatgtaaaacaaaatgcctagatgagtgccataaatttgtgccaacagttctttgctttggtcattagtgaccccttttccggcgcaaaatttgtcaaaattggcaggtcctttcacgaaggcaagaaatgcttcatcgtcaaactgcaattaattctcaattcaaatttttttgaaagattctaacaatttcgctaatttttttcaggccttcttatcttagaatataattaaaaaacgcctgcgggcaataatttaataaattagtaaaatggccaattcgtctctattaaacttaccgcaaacgagttaacaagtgagaaaagggagaaataaataattaaaggaagaaataaagaataaaataattcattttaatgcgttgggtggattt

SEQ ID NO: 26144 - DNA, 1631 bp, Heterodera glycines
ccaacgggaagtccaagcagttcgttctcgttgtgctggtccaactccacctcctctcccgctaatgaaagagtgtcgttgtctaaacgtcgagggagcatgttttggagaacaaaattttgagccggtggtgcaacggggtcccggttctgattattgggactcgaagttcgaattgggacccgaagtgagctaaaagctatttcgcgccgatgattttccataaaaacggcggctggttgaaaattcggcgacgcttcgaagttttccgccgcgtaatccgtccaatttgtgcgcaatccttgctgatgtgcgacgtttatctcgttgtcctcaatttcgactgcaactccattgtctaacagacgacgcaactcctgtcgtgtcatataccgacgactgttttccattgtgaagagaagagaagaatttgcaagtttctacaagaatgcttgctgctgctttttcttgtacacttctacaagaaagtgcacaaatgttgggcgatgggacgatggcgattttgtagtttttttttgatggtttgttactcttctacaagaatgagtaacaggcgcgtcaattgatgactcctttatttctctgtcgaatttgtggtgtggacaattgctaatagtccccgaattgttgttgcaccaccaaatcaatagaaattaatcgaacaaactctgctcacccttgtccaggagcgccatgtcgtacttttctggtgcgaaatgagatgtcggtgcggcaatgtcaatggaaagcaattagggataattcgactccttttgaaagcaattcacttttggttcgactttccaaaattccaaactcagtcaattggtggtcaaaaatagaatccaaattatatttagcacaaaacaataaaattaatgagaagacaaccaaaaaacataaaacataatggtccaaaaactgagaaaagaaaataactaaattaaaagagacaaaatgccacacaatatagcactaatttaaataattatccaattatcacatcccacccctttaaaatatcaacgtccctgttgagaatgaaaagtcaagagatcaaaataaatcaaaaataggcaattcggcagagtcaaaaaggctttgggtggcggatgagcagagatcactgttgtccacgtcgagagctacgaaactgatcagaaccacgacgtcgccaagacgccgaagcccattccgagcggtcgcgtcgacgccattcctgctggtgtccttcacgattagacgtttgaagagatggacgagaaaagctgtgccgacggtggtcgacaagaccaaacccgcggctaatgttgggacggcggcgctcttcagaagtactagcaccaggtcgcacaacttcagaacgcggtcgcgggcggcccaattccttctcaccaggaaatttcccaacttcgtaaatccatgccatcattgtcttcgctccatgttcagtcaagagtcccgactggttcactcgatttcccgcgtttgttcctccatagcgaaacacttccatgaggcttcttccttcttccgtcacagctccgaaccgaaatgtgagtgtcagtcgcagagtttgggcaagcgtcgaacgagttcgagaaattgag

SEQ ID NO: 26145 - DNA, 1505 bp, Heterodera glycines
ccccccccctaccgggggcaaaatcatcatccgtctgatcactcacttccctaggccatcaacaccctctctctccctctccaacctccccgccccaaactccgtcatatccgtcagccgcctttgccgcggcgatattttgtgagtctgacggcgtacggtaatttcgagcagatgagtggcggcgatggtcgtccaatttcccctcctctgcttctgctgctgtcatttcggcctcaaatataataaataagcttcccccccccgggcgcctcggctaaatgcttttcctcggccaacaaaacgccgcgggcaataaagtcacttttattgggccgtaaaagcaacttggaagccgagcggaccctgcacatttcggtttcaatcgcaactcacaaatgttgccattttgagtttttccccgccggcgatggtccgtcactttttttttggcttaacttttctcctttaaacaaattttctctgggggtaatccgtcgcgcggtcccccgcggcgatttaatggggcacgactcggcacattaaaactttgtgcgcggatggcgacattttgggcggacaaacacacaaataataagcggttttgaatgggggggggggagggaatgtccgatcagtgagggcaattggatgtccgaccgatgtttgttgggatggcgcggcgtttggaggtgtcggacgaaaaaagcaaagagcgcaacgaattgaatggatgcttcacaatgttacggtaaaagtgggtagggctacggtagggcaactcaaagtacggtgggccaattcaaagggcgacaaatgccaatttaatttctctgccttcggcacattgttcaaatgcttgttgcttcaagtttggccatttcccttctcctttctgtacggtattacaaatgattgccattggcaaatgaatgaatgaccgtcaccccctagggattttcgccattcattcgccgccgttccgctcaaatccgtcgaatgatagcgatctgtccggcgggcagtcattcagtcagtcggccattacatatcatttcagcgtcctcctcggccatccgtccgtcctctcaatcaattggccatactttgtccgccatcgttcctttcccaatcaatctccccccccctttttttccccttttccctctccgttttccccgggtgtctcccaacttttgccggcgattttgggcttttgttgaggttggatggacagacgaagtccaattgacaaattgacttcagtttaagttttcgcttaaccttcggggggaagagcatccaatcgccaaaagggacaatttttggatgagaaatcgaatgagagctgaatttttttaatgagtctaaaatttagggaatttgtcgcatatttttgcttttcatttggcccattcgtcccccgccgcttgagcagcacaatctcatcctcttgcacatctctcgaggctttctcacgagcggaattttatctgcccgtccgt

SEQ ID NO: 26146 - DNA, 1232 bp, Heterodera glycines
cccccccccccccccctcacctccctcccgttcgaatgatcgattattttattttctatttgaaataaaaatatgaataaaatttaaattgttaaaaaacatttaattccttacccttgggaattttgattttttaatctttcttttttttcataattttcgacttgtttgcattttctgagttttggcgatttcggattttttggctatttttttttggatttttatgattttttgcgatttctgatttttttttgttattttaggaatttttacgaattctatttttggcattttttaccaatttatcattaatttttatgataagcaaaatatgtatagtccttaacttaataataatgatgggtggaattactaattagcaaattttgatcattatgggaattctgaacgatccttcaaatatatttgatatttttttcttaattattttaaaattgaaattaagagtattttacctttataaattttttataggcataaggaatgtgtaattatgctcgtaaaaattttttggcaaagttctaatcatattttttcgaagaaatgaccaataaattttcctcaaattatttttattcaatgccgatattttttcaaaaaatttgaacaaatatcacaattatcgtcacatttggctcttaattttctcacaacttcctttttcattttgtctgactttgttgtggctcctctttccctttttgacccttgtgaggaggaactagagattgagccacacgtcgatgctgtgagggcttggcgagcattttcgcgttcctcaggtctttcgattcctagtcggttatatgcccgtcgtacatgttcctgagtttgcttttgtgttgcccacgtgtttttttgagaagaggcagagcgttccgatttgtcactatcgagttgctaaatcggagaagagtgttaccccgaaaattttatttgatatttatattacatccaaaagactcctcatcggggttgcttcgaccggaaattgctcctcttccgtgatttgaagcaacgggctttcggaaatgtctgagaaaacattttgatggtatggcggttctttaaagaaaataagattaccaattttgataatttaataagcaaagaacgaatttgtctaaaaaacagggtaataaccggaaaaattttggggtaataggattaataagaagtttttcagatttttatttgggggactggtg

SEQ ID NO: 26147 - DNA, 1239 bp, Heterodera glycines
agggcgcgaagcggtcaaattccccaaaaaattaaaaaacgggcgcgaagcgcccgtcctgaggccgcgaagcggccgaatgtcccccaaaaacttaaaaaacgggcgcgaagcgcccgtcctgaggccgcgaagcggccgaattccccccaaaaattaaaaaacgagcgcgaagcatccgtcctgaggccgcgaagcggccgaatgttatcaacaaaatcaaaaaacgggcgcgaagcgcccgtcctgaggccgcgaagagcccgtctggccccacaaaattaaaaaacgggcgcgaagcggccgaatgttatcaacaaaattaaaaaacgggcgcgaagcgcccatcctgaggccgcgaagcggccgaatgttatcaacaaaattaaaaaacgggcgcgaagcgcccgtcctgaggccgagaagcggccaaatgccccccaaaaaattaaaaaacgggcgcgaacgcccgtcctgaggccgcgaagcggccgaatgtcccccaaaaaattaaaaaacgggcgcgaagcgcccgtcctgagtccgcgaagcggccgaatgttccccacaaagtttaaaaatgggcgcaaagcgcccgtcctgaggccgcgaagcggccgaatgattaccacaaaattaaaaaacgggcgcgaagcgcccgtcctaaggccacgaagctgccgaaaattcccaacaaattaaaaaacgggcgtgaagggcccgtttggccccaacaaaatttaaatcgggtgcgaagcgcccgtccaagcaaacaaaattaagaaacggacgcaaaagcgcccgtctgaggccgcgtagctgcaaatgtcgcctttaaaattttgaaaaaacataagcctattaaaattttgaattttgaagccgagcatgcactagcaacgaagtcctttgcgcgaagcgctcatgtcagcgcccgcccctatataccaaaagtatactgtctacaccgagcaatcactgcgccacccgctagtttatactactatagagaaacgttgcagttcgtcttaaaaaacaaaatctcccggccgaaggccgggagcgccctgaaagtagtggatgggtcttacaactttttgaggcgcatctgggaaaaataagggttttccgctccggtggccaactgagtcccggcggctgatttctcacttttgcttgcgtttgatggcccataactttttttctaaaactctgatcaaaaaatgcttgctggtagga

SEQ ID NO: 26148 - DNA, 1349 bp, Heterodera glycines
tcattttcaccttgatgtcgccctgtcggactttgtccgcccgttcagtcaaattgttggccaactgcacaatttgttgtgcactctcattcagattctaaaaaattgttgtccaaattttttaaattttccatgttttgtaccttaaccccctcctccgccagattgacttctgtgctgacgcgggtcactcgttgattcttttccgccaacatttcccgcgttgtgtctatttgcttttgcaggtggtccatctgtcgacgaagttgttccatgtcttcctgtttaaaggaggaaataaatgttacaatctcgcgacgaaattactccaatatagaaaaaagatatattttttgcttacttttgttatgtttatgccttccatgcgtcgtttcacttcaccaattttattttccatctcaacgaaactgtcatcatattccgaggaaattcctgaaagtaacataaattaaaaatttttaccgggtttttcacaaaatttcacaccggtgtcctcaatgttattggcacggccgatcaatgtttccaactcttggccaagtgtttgcaaaattgcgtcccaattgtcaaagcattcaccgcacgcttggcaacgaggccacacaccagtgtaactgttcaatgtgagtaaattttcaaaatcattttttaagttaatctgtggcgttatgttcaccctcgtgcgcattggttacactttgggcctccactgcccggtttgcacatgcagttccccgtctgccgatcgcactgcaacgtttgcgacccataggtgtcgcactcgcatggcatgcattccccagccagtggattacctaaaaaataataattggccaaaatggtttttttttcattttttgcaccccaataaaagtcttggcaatccgcgcaagttcgtccccctcttccttgcttgcaatggcattgtccatcaatgtcgttacacttaaaaaattattatttaataatttagagaaaaataaacggagcaaggatgatcttttagacgattttcattcttggtactgtttgaaagcgcttgttaaactttattaatttaaaaattaaaaaacaattttcaacacgtataaaaaaagtcagggccaaaatactcattaaacgactgacttttctaactattttgcaaaaaaaaaaaattcttatttagttaaacagcagatggtctagaaaatcgtccagcaaaacgttttgttaacaatgaaataatttttaaaaataataataataaaccaaccttcaaatatggttcacccgtgcttgggtcatgttcacgccgttagggtcacatgcgcacgccgaacagcctg

SEQ ID NO: 26149 - DNA, 1849 bp, Heterodera glycines
  misc_feature (31)..(31): n is a, c, g, or t
gaattggatgatgagggttataaaaataatntaataaactttttgctaagatacggttacggtttcattcgaatttgtgttcaaataccgagatttttttggcactttgtatttaaaaatctgaagcggattaattcaattttttttctttatattcttagtttgcataataaggaacattttcatttttttgttaattttcctgtccaacgggaaatgcatttgtacctcagttaaaaattttattttttatttcatttttaaacattcagacactcgagtgtcggcaatataacttcacctcaatgagccaatgaaaatgcccaggaatttatttcttattcaaatttgggaaggaacatttttaaattcgctaaaaaatttatataaggaaattaaaaataataatttataaatataatggcactaaacattcgatcacataaaaagagttaagtcacaaacaaacctaaacaaagccatctatcataaatataatggaaaaaattagagttgaaaaaatgattgtttggtctgccgccatccaaaacctttatttaatgacgaaataagacaacaacaaaacgataaactaaaaagcataagatgttatcaaaaaaattttagaaaatgcaaacggcactaattaagaaaattatgacttttcccgatcaaatagtcattcgctcaaacagctcgtagcagccgatcataccattaatatcttaaaaagcaaaaaaaaaaattattaaaaaagagagacaatcattaaattacaggcgtccagaaggcccaaagccgaagcagaagaacgcgacgactgacagcaaacacgaaccaaatccgaacatttattaagcacccaaatagcctgtgggaaaatataagaaaaatttagttaaattcaaaaattttaagaagcaatgttaaaaataagaacaaatttaaaaaaatccattggtaacttacgtaattgtcctcttcatcaaaactgagatccgttagagcgggcagagctgtcaatgatggaaccgattcagcgaattttttcagcccttaattgggatcggacccaaatagaaaataaaaattattataacaattatttagggagaattttggcaatttggccccaaaaatcgaaaatttgataaatttaagcataaggagtaattttaatttgtctgaatttgattaaaaaggtctaatttatttgatttgttgccttgccattgaatgcgcgacacgtagctgttgttttttgttgttcatcttcgatcccattgatggcgttgcatagatgatcaatggactccttgcataattctacctgcgaaaattatttatctgattaatagtaaattaattatttaaatgaccatttttttcatctcaattagccaatcacccattttttccagcaaaaatttgtcaaatgaaaatgacacgcggtaattagcccattttcggtcaaattttgcgaaattactcagctccaaaattagctcggctggcagaatttttggcatttttcagctatttggaataattttaagtctgcctggaatttccttgaatccaccacaatttaggagtttatatttgtggtaccgccttatcatccatcagtcggctatctcaagtaaaagaagttgtcaaaaaatgaaaaaatcggtaaaaatcaaaaaaggaggggcggtcaatccgattattttatctatttataaaatcagagacacataattaaatgactaaccaaaaatgtgaatgttatctcaaacttacttgttgctctttgttgaccatattagctataatagtaaatttcagaatgagaataatagaaaaa

SEQ ID NO: 26150 - DNA, 1335 bp, Heterodera glycines
  misc_feature (87)..(87): n is a, c, g, or t
  misc_feature (129)..(129): n is a, c, g, or t
  misc_feature (164)..(164): n is a, c, g, or t
  misc_feature (208)..(208): n is a, c, g, or t
tcggcccgctgtgcgactccccacgcgtcggcccgctgtgcgactccccacgcgtcggcccgctgtgcgactccccacgcgtcggcncgctgtgcgactccccacgcgtcggcccgctgtgcgactccncacgcgtcggcccgctgtgcgactcatcctccacncagtcccgctctgtcccgtctttctcctcgggtgttctgcgctntaaagcgcttaacgcggaaaagatttgtaattccaattggaaggcggacgtgggcacattcggtgaactgacgtaacttatcgcgtcgtcatcgggcccatatggcacgtgccgccgctcccttcgccaacggatgacttaaaaatttccatttttctaattaaatgaattacgtgagaaagtcccaattttcctttttctttttaaacaaaaacttctctaatttaaattcctttttctattttcctaaaaattctttaagtgtaccaaaatttctttttaaatgttcactctattcactgaatttttgccaatcccataccagtcccgggaaagtttcgttttggcgccaaagcaaaagcaaaaaataattaaaaaacaaacaccagcagatttatttaaaaaatattttgtaaaagaaaaaaatatgtattcttttccttaggattcttttttttctgaaaattttcttattttaaagcatttgttaggtaaaagcatgcaattatgtatttacagctttttatttggtataagaatgacataataatgtatagggctcggatttatagttgctaaaaactgccaaaataattaatttttagtttctaaaaaacccccaaaatagttactaaaaatgggtaaatagttgctaaaaagttccgaatttaggggtgtaaaatcgaaaattttctttaaaaaggtaacaaaattattcaaaacagtattgagataaataatttttaaaatcacacattcttgtcaataaataaataaataaattttggatatgaattttcgagaaaattttcatttctcaggggtgtatttttgaaatttccgggtcgattcttagtggtgtattttttgaaaaaaaattttaagttgattcttaggggtgtatttttcgtttttattgcatttttgttaacaaattttggcaaaacgccaaaatagttgaaaatagttttttttcaaaaaattatagttttttagttgctaaaaataaaaaactataaaatagttgctaataactcgaaaagtagcttaacaacagccgaaaaaaacatgttttttcgcgcttttcaggctacggggagctcagggaaaaaatagtgaaaaaacta

SEQ ID NO: 26151 - DNA, 1679 bp, Heterodera glycines
tttgtttaaactcggcatcatttatatacctgagaattaggactccgcccactttaagcagattaaatttacccgctcaaacccaaaatcatttttacaaaatgtcatcatcatcatctcccgaaaaaattttggctcaaccttcgtgcccaaaaaaggcaaaagtggacgagcgagctctgtggaaaattttcaaaggcaaatacatgctagcgatttatctctgcgatgatgactggcggaatctgttcgagaacaaagagaaagttcgccgaatggacaacgaccgtgtggccctaaacttcgaaatgtgcgaaaattgtgctcgtgtgaattgcaacggaacggacatattggctccgtcaaagaaacgaaaactttcaaccgatcaagcttaatgatatcatgatacctttcttttattattattattatgtgttttgccctcaaactaataaaaaataatttaattcaatttgcgcaatggtggcagggggtggggggagggaaggtagccatctgtcggcagctacatcgcatggttgttgttgttgttgttgttgtgttgttcggcaaatatccacacacactctgccctcatccttttccttccttatttttgcattttatctcccaccctcttcacggttaataaaaatgagtgcaaattccgcatcggttgaaactgaaattgcgtcactgaaacaaattattggcgcacagtccgtaaaattgatgcagatgcgtcatcattttgtgaactaccgcttcagacttgagcaacttgaggcttgggccggggaagtaaggtattcaatgttttttgtgatcacaatttttaactagggtaaagacaaaaagtttgttcgttcaccaacacgcaacaaacgattttctgtggacgacgagccagcaacatcggccgcaacttccggtaagggtagtgtaatattactgggaacagtgcgctttttcagatgggatggcaatggaaagcttgaaaaaagattttttggaggccaaaatgaaggtacttgtggaagagaaggtggccgaggcaaaagaattggcagaattttccatctctgatgcggagcgcaaaatgaaccaaagtttgaacaacgcaatgcgcgttggacgtgaaagagaccatcatcagttacgctgtgtagtggaggagcaacatatccgctgccgtctccttaccctgcaaaactaccccgtcgccacaatgacaaagctcaacatcgagttcgctacctcgcgacgtgtctcccaaacgggagacgcatcgcatgttttgtctgatagacgacccgatgtttgggagtgaatggtgcgcacatgtgaatgtgtgcgctgaatgctcgatcgtatggtcagtgggatgatcagtgcaaatgtttggcttgtcgatctacatgtaataagtttgtctatggtggccataatccatccccctaatcttttgcattttcctttcattttttagtaatgccatttttaattcatcaatgaaaacatgatctgaagcatttttattaaaaaataagaaatgggtaaatgttaagtatcggatggcaaattcaaccctcggacagcaaaaaaaaaatgagcacaatgttaaccctcgggtggttcgtgcatgcactaccgtccaaacgcctccaagcaatttt

SEQ ID NO: 26152 - DNA, 1879 bp, Heterodera glycines
  misc_feature (701)..(701): n is a, c, g, or t
cagtagtacctatgaatttaaattttctatgaatttctatagttttttgaaatttttttaagtgcaaaagtggtggtgtctgcaaaaaattttcaccgggtttaaaaaatctaggaaaattagtaagcatttgtagtgttccgatacgtattcctgcataatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggggggcgaaggcccaccacgaggccgcgaagcggccgagtgagtacctcggtgcatgaaaattattaaggaagagagttcattatttgtttattttttgcataattaattcataaatattttttccagaanatgctctgaaacgcaccaaattttatttacatgttagtttaggcactctgatgctttttctatcaaaaagggagatgaataaaatttttaaaaatttttaattcctttttaaacaggccaaaaagtttaggcttaactttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgcaatagtcaatttttaaaaatttttgttgaaatatttgtcgtg

SEQ ID NO: 26153 - DNA, 1968 bp, Heterodera glycines
ttatggcatagtttcctagcagattttgccaaaaataaatctcaacgaacttttggaattttactttggatgcccggcagaaggaacttatccgttcggcttcttatcaaattcatcggcgaacagccctaaggcaatttttattatggatttgttgattttgatttcttattttttcgagatcgacctggacttgaatccaggcctggatttttccaggatcctggtcccgtccatttttcggcaacctcgatttttcctggacctggcttttcctggatttttgtccatgaaatcaaggtccacgtcaaatgtgaaaaaaatccaggtccaggcaaaacaggaacaaaccttgattttcctggacaaaattttagaatttattttttcaagtgcccgatgttttttcaagttatcaaaatcagattaaataaatttaaaaacacattattattatcattattaattagatatttttagatacttctaagcaaataaataatttcttctatcattttctttttcgatttttaaaataattccaaaaattcccgctccaggcctgtagcctcatctcaatgacctttcatcgtccttggacctcaattgttcttccttctcctcgagcaccgtctgccaaagtttcacttcgcttttgatgagtgatgttgtgtcctcgaagtatttcttcaccaaaagaaaattgcttctgtacgctctcttttcgggcgcacaattggtgcactaaaagtgaaaatttaatttagaaaaggagaaacaatagaaggagcgaaaagaaaaccacaaaaagaatttttaagcaaatgtccgtaaattgggaagccaaatttgaatggttttccacaatatctataagctacataaaaggtcaattactttttcgcttaaagcgtttgtcgccttctttaactgatggactgcttcttgcatagcaattggctaaattaaaatgaaatcttagctaagtacgagaaagaaaaactaagtatttaaagtgagaaaaatttcaatttttgaaaaacagtgcaaattatacacagatgaatgacttatgcacttaagcgaccgattttatatatcaactttaatttgcctttggacgaaaatcgattagaaaaaggaaaaggcaatcgaaagtgaaaaaggcaaaatgatttaaggcaaattttttatttaataattggcttttgagtacggaggtgaaaagtcgtaaattttaagttttctaaaaaccattcaaattcggccccttttctaagcaattggtggttcgctgggggatatcctcccattaattaatcaatgtttgtgttagtgtggtgtctcccgccgcgcaactcaaatctgccaaaggaattgtttgggactgagaagactgcacgaaataaaacattttgccacaaataaatttttaacattttttaaatttttcaatttattgcgtcttttacgaccgatgagtcacgctaaaattagaaatgttcagcgggtttactattgttagttccttatcaaacctattttaattataaaaacaccggagaattttttcaacaaggcatatcttcacttttattttaattttgtttttatttgctgtatattttacaaaatgtccgtctcgtggggcactcaatactccaaactgaagacaaatcttcggctggctgcaaatcgactccgattgttgcagaagaaaaagactgagcaggcggtgaaggcgcgctgtgaaattgcggactttttaagcagtaattgaccattttagttaattgctttatttggaatggcttaaatttccctcgaaatttttatagaattcagcgctgattttcggattaattattcatccaaattttagcggacaaagaggacagagcccgaattcgcgtggagacaatcattcgcgaggattttgtgggtgaggcctacgaactgctcgaaatg

SEQ ID NO: 26154 - DNA, 1682 bp, Heterodera glycines
accaattttgcgaagtggtccagggccatgtaattttttttttgtttcaaccgtttttgcgacgcgctttttttaaaaaaaaactttcgacggaaattgtccggattagggcccacaaatttttttttgaccattgatgagattgattggttggttggacccacttgagccggtcactgattgtctccgcgctgcgctccatttgcgtcgcttgcgcaccgccggcccgcggaattggcatcattttgtgctgctcgtccggccccacttgccagtccaggtacacaaccttgtgtgagaaggtggagaactcgttggagaagcaaactttgtacgtgccgttggcctctgtctaaaaaggcggaagcaaataaatttgggtagaaattggtcagttttcgggtaaagcccaaaagttgaagaaatccgaatttccggcgccccctttccctaatttcggaaaatttggcccctatataccagtttggtataatctgaaaccttcaacaaaaaaaaaattcaggatcccaaaaaatacaggaaatcctccggcgtagacaagccaaaagttggagaaattcgaaatttccgtcccccgacctcctcaaaatttgacttatatacaccagggtttggcataaaccgaggcaaaaaaacctatacaggatcaaaaaaatcaggaaattttccggcgcaaaatattcaaatttcccaatccctaccccatattataccatttgggcaatgccaatatcatttttgatggttattctattttttcaaaaaaaattttttgtgttgcctgacaatgagtcggcagagtagtttttttgagtgttgccaaaaaaaattgataaacaattcaaaaaatgtgtattttttcaatccacatattttgaaaatctcaaaaatttactcttttgtcacacaaatcaggacaataattcagaaaaatggaggcaaacccacattttatggttttttaattttatgaaaaataaacctttggcattcgatttcaccggtgccatcactcactttgtacgtgtgggtgtccaactgtttcctggcctccttgtacaacactttgccattcggatcttctaacaccacatcaacatcatattggcctccagtgaccacctgcggaaaacaaaacattaacattcggatcaaacgatgcaaaaatatgacggaaaaaatgtgtctttatatttagatgggaaaattcaaaatttctaatatttattccttattttcgggatgttagaaaatatttttggggaaaacagcaatgaaaattcacagttaacacactttaaaaaatcgtaccggatttaaatccttaaattttgtaacctccgacaaaaaacttgagtatcccccagacatgaaaaatttttacaatcgtaccggcttttgggcactttaaatttgaaggatccataaagaaacttggtatgccatgattttaaaattgttaaagaaatttgaagaggttgtagtatcacctgaaattccaacgaacagtcaacatcctttttaatttcttcataaaaacattgatttgcattgtcgggcaattcaaatgtcaattcagtggccactgatgatggtgtgaatttggaaagcaaaagtaacagtggcaaaaagaggaccgaactcaaatggtatgccgtcat

SEQ ID NO: 26155 - DNA, 1348 bp, Heterodera glycines
  misc_feature (50)..(51): n is a, c, g, or t
  misc_feature (78)..(78): n is a, c, g, or t
  misc_feature (92)..(92): n is a, c, g, or t
cagaagttcatcgccgatttcatcggcgccctcaaatttgatcccgagcnncggccgacgtttcccacgccgttgccnctcctcggcggtgngcacaatgtgagcggcgaaagcaccggcgattgccaatcgaaaaaccttaaaaatccggcaaaaattttaaaaattcgattcggcacggacacccaaaagcagacaaatgcctgccttaacacattatcagctgtaatcgccacactgagagaaagcggacaaaatgattttttgggaattaattttaattagggaccgaattttgttacacaaaaacttcaaaatcaatcacaagaaataatcatattcataaggaatttttgtaaaagaatgaaattttaaatttttcttctctaaaatattttggataaaataaaattttttaaaattttgttttaaataaattatttattcattctgataaaatttagtaaattttttaatattcaattaccttatctttttcatttctggtaaaaaattttgtattttaaaatgttaacaataagcacattttgtgtattttctgaaattttttcgggcgattcttaggggtgtaattttcatttttgttaagaatttttccgaaaatcctgaaaaaggcgccaaaaatggcgaaataggcacaaaaataggcaaataggcattataaaagtcatcgtagacaccccaaatcgtgcttatctatgcatattaagtgcgcaaaaattttaggaatttgcctaaaaatggaagccataataataagtttaaaaattttggatttgtttatcgttagaccgcaatttttcttaattgttttcgagttttgactgttgcctatttgttaagcctgtactaccaattttcactaaaaagcattagcaatttaatgcaatttctattccttttcagtttgtgtgccccaccgaaatcattgcgttcagtgaccgcgtcgccgagttcaagcagctcggctgtgaggtgatcgcctgttcatgtgactcgcatctcgcatttggtgttttttttttgttttcaatttttttgtactcgtataatttggtccatttttcttaggcttgggtgaacacaccgcgcaatgatggcggacttggcaagatggacattccggtgctcagtgacttcagcaagaaaattgcggctgactttggcgtgttggacaaggagaccggactgtcctatcggttcttttttctcggccaaattctaatcgttaattgaaaaaagtctaaactttccgcccatttcagcggtctttttccgattgaccccaatggcactgttcgacattgtttggtcaatgatttgccgg

SEQ ID NO: 26156 - DNA, 1398 bp, Heterodera glycines
  misc_feature (47)..(47): n is a, c, g, or t
  misc_feature (94)..(94): n is a, c, g, or t
  misc_feature (128)..(128): n is a, c, g, or t
  misc_feature (218)..(218): n is a, c, g, or t
  misc_feature (1348)..(1350): n is a, c, g, or t
ataactgataatggggaagagttcgctgatgggcaaaacgacaaaanttcgagcagacaaacgacaatttggcgttacgagaaaaaaaattttntattttttttttgtctaattaggtaagttgtttntggcatttgttgatttgtctctattatatcgggttttaattattttttttttcgttaattttaattttttctcatttttaagccttaatntagtttcaaaagcgggttgatttctgttatgacaatttgataaaagacatacttttttatgaagaaacttttgcaaaaattttttgtttattgtatttataaaagatgaattttttatgaattaaaaattcaaatttttaaattttttgaaaagtgccgaccgacctcagtaatttcatttaaatttgacaaaatttaatttaaagctttatgggatatattcttatggcaaatttaactcgtttttggcatctaaattgattaattttcttggaattataatctggcaaccccatctcattacataattgcaacaccaataaacgagtttatttatttcaaattatatatgtatgttatgtatatggcatgtgattgttgtgtgatggaatatttggatgacttcgacgatggttatcatcataattattatcaatcattatcagtgatcggaaagggaaaattgccaatttgttctgccgcactgatcggaacatataaaattattagaaaaagaaaaggcggcactgatcaaatatatatctcctcatcctccgttttcaaattagatccgcttttgatgctgcttaaacatagctgacgtcgttgtcattggtgcccaaaaaggcggacttaaagcacgatggatgccgttgctgccgcctttcctcgttggccaaaaagtgctggtcctaatccaaaaaattgggttttaaatgggttttaaacattggcatttgttggccctaatcccaaaaattgtttgaatggctattgatttggtgttttgtcataggcccgtgaaaagaattttaaaaaatttaagggcggacgaaagtgtcggacggacaaccgttttatggcattttgccaaattttcaccattacaaacacacagcaatcaccaggctgccagagaccgaaaattttccacgggtcccgaaactctagacggaaaaaacgcgactcgacaagggcccgagagcccaaaaaacaagagagagttgaggtttgaccccaaaacacggcacaagaccccgggcagcttgatcccgagactgaaaggtgagaataatctctagtagcactaatgatcagtatcctctccactgtctgaccgagaattatannnatttcgatcagtcatcgctcgagtgatctcttctgatcagcgatcact

SEQ ID NO: 26157 - DNA, 1804 bp, Heterodera glycines
taaaaatcatataaaccttttttttggcaaaaaagagaaattggaaaatttgaattttctactttttgctcgaattcgggtccggggttctacataggtcgaaattgatgccggattcggattctcttaccctaaaacccctaatacaatcttttctcgaaaaaaatttcaaaaatttgattttttgaaaaagggggactaccatcggtactattaccgtatttttgtttaaagtgagtctagaatatcttaatttgctcaaaagtttgtttccctatatgtaagccatttcaggaagcaaaatgagaaattcgaaaatttgaattttctactttttgctcgaattcgggtccggggttcgacatacctaggtcggaattgatgtgagattcggattctcttaccctaaaacccctaatacaatcttttctcgaaaaaaatttcaaaaatttgattttttgaaaaagggggactaccatcggtactattaccgtatttttgtttaaagtgagtctagaatatcttaatttgctcaaaatgtcttgaaaatggttggttgtccaccaatcgttgtccgtaacgccaacactcctccgacggcaccgttttggtgccattggatcaacaacaaacgcagaggcatttaggtgactttatcatgaatagcttttctaattcatccacgattttaccgttgttttgaatggtttgttaaaatttgatgggacaaattttccaaattcaatgttaacatttgtgaaaatcgtcccatccgcctttcctttagctttccaccaccaccgccattttagtccaacttctccgtcttccgccatggcaccgtcttcctcctctgctgccgccatgacaccactcggcgtcattttggtgtccaaggacgagtcggccgagcgcgtgctgttcatgtacccatttgagcgccgtgtgtcgccgcactccgcccacattaacagcaggggtccgcaaacagtgggaggagcagttcaatttttcttcacccattctctccccgccaacaaaattgatggtggaaagaaattcttgtaaatattcaaaaatagaaaaacgctttttttgaagaaaccaaaaagtaaatcaaaaggtatagacgaggtaatccccatcccaatttcctatttgccatttgttataaaaaaattcagaaaagtgccatgagcacaaggactcagtggtgtcaatgattggtaaagacgtgccaaagttgggcggcggcggtacgccggacgacgtgccgtgccaaccagctgcaattgacagcggtgatcagcaacaacaacgtctctgcgacggcattgcgttggacggcatttcgactgggtcggccaaaaatgtaatttcgcaattaattttttaaacttctttcagttttcccgtcaaaatgttggcccctttgctcgtcgccaaaggctccaacggaaatgggacgccttttgatatcaaagtactcttttgaccaattgacacgagtatgaggccttataactattttttatataaatatttggtttttcctgccccaaggcaacatttttctttgaaattttattgttttccggtggacaatctccgttttgtcggctttccgtggcacattaccagctgtgtccattcgttggccgtcgttcattttgcgcggctccgccgaccgacacattgttgacgcattccaacggctcagcaaaaaaattgccattgccatcaatgtgacgaaaaaacaatggcaatgagtgaaatgtgctttcaattcacagaccgaacagca

SEQ ID NO: 26158 - DNA, 1897 bp, Heterodera glycines
  misc_feature (1694)..(1694): n is a, c, g, or t
gaaaaaggcttcgcgcaagtcgacatcgaaaagggtgggaatgcctttaaaatttaattgtgccattttcgtaatcgacttaccaccccctctcccacatcgttcagcgaactcaccggaggacttgtggagcagggtcatcgcagcgtcgcagtcgttcaagaaagccgcgttctgtgagcaagtcgccgaggaagaagaaggctgcgcctggctcatccgcgcggaagccgtctcgtcgtcgtccacggaccgtgtcgcggcgccgtgccaccagcaagcgtcgacgcagtgccagcaagaagaagacggcgaaatcgtcgaagaaggatggagccactaccaccgccactggtgctgatgccgggacgacttcgacgacggcgacggacaacaccaacgcttcccagcaaagtgaacgtgagtttctggcgaaattcaagaattgggaggagtacgggtgctgatttcgaatctgacactttcaaaattcttaggttctgaagggagtgcaacggatgagtcatcgcgtggttctgaggcggaggcgaccaacaccggtgggacagcggcggatggaggtcgtgccacggagtagaagcaatggaagaacaccaacaatggatgatgacgaatcggatgagaagcgattttccagcagaaattaactgtattttttgtctccatcataattatatgttgagagtggccctctttctccaattgtttgtgttgtacaatattcatttcctataagcccgtgagatgcttgccacacctccgttgtatgaattccccctaatgtcagtcattctgatgttgtattgtcgatttaatcgctatgtgttgtctctcaattatgtttgctctaccataataaacgataaaggctctttcgtgacaaacagtggaaaatgaattggcactttgttataacttataagtaaaaggattaaggatatgggagggatatattttgagattaaggagttggtactctttcggtttgggtccgcctttcactcttgacgatttattcaaagtattggctcttcaagacaaagacttttttccacatacatttctgattttttgtggcgtaagcaatttggaggaccggatattttttataatttgtggacccaaatcgcggaattgtacccaataagcacataaagctcgtttatttgatatttaaagcaattgtgacaataaaaaaggaaaaaaaattgaaaaatttgaaaaaaaaaaaatggggatacaaagtaaattagtaccaaacaatacagtagtaaatcccagaaattgtctggcatagacacggctagagcgattattgtctcccacccatttttaattgatcgcttttaaaaggccaaaattgtcaatgttggcatacccgttttgcgcatttgtactcaaatccacggcattggcaaatgaattcgttgagctcatcagcagacatcagttgggtgactttgagctgctcaaacacgggcaacaactgctccaactcgcgctccacaaactcggccatccaaccaaaattaaatgtttcactgtgattttattaaaaatagttctccattaaacagaagccatttatcagtttttcgatgcttgaagggggaggagaaacaaagctaaaaaagaaaaaaatccgtaaaagtaaatactagagatcgacctgnactggatttttcctggacttttcccggcggcgcctatcggcaccgccggatctctacgctcgcacattcaccaagtttttttttttggaaaaatgtgccacaagaaaatatgttacaaatctgagttccaattttgcttgagtaaatcatgataatttaatatattaaaaaaacaaaaatttatcgtaaaaaatttttttttt

SEQ ID NO: 26159 - DNA, 1844 bp, Heterodera glycines
tttatctgaaaaactaacaggtattatcatttattatttaaatattaatcgtaataaaaattacaattatttagggacactttctccgtggcggtattatctctccgttctccgctggaaaattcgtctttttaattctcaccaccaattttattacgtcgggaataaggtattaaaagggtcaaattaagcatttgtaatattattttgttatggggaaatggacaattttgaacacccggaagacccggcgggacaattcgccttttggagtaccaatgaaaagaagcgaaacgcaacaatggcaccgttcatattttggcacacattccaatcggcggtaatgcggggagggggggggggggttcaaagaggaagttgaattaaaaaaagatacggaatttgtgggaattaaattcaaacagaaaataaaggggctcattgatttaaagtgtcaaatgtaatttaatcatttatttaaatgaattttaatttatttagcctacgaaatgtataaaacgaaccgcgaagattggaaaccggaaatgtctgggcgatacaatcagcggctgtatgaactttttgtgaaatacgccccatggattggttggatgctttttgggcatttgcacacggacacttttcgcattataaaagtggccaattaatgctcaattaattttaattgtttccaaacttttgcccagtcccccgatggaagtgccgttcagcgaatgtttctgaatccggcggtcactccgctgttcaatctcaacaaccccgccttccgaatttacgaatataacacgaaaagcatggaaattgaggacataaaatatgtttaaacttaatgaaataatggaagcaatgcttttcgttttagaactttttttgttaacttggaagcactgaacgcaaacggagccgaaattagcgaagcgaaatttgaatattcatttcgccaaacttatggcatccaatcgccgttaaatgcaaaatcattggacaatcttgtggagcggatgaagcaaaacgaaacactgtttgaccagtacttcaactactcctccgtccaatggatgacacgaaaactgaatgaaactgaaaggtgccaaaaaaagacggatagagggagggggcggggaaatgccatggcaaaccaattatcactaattgataaaaaatgcaatggattcaggaagtcgcatctttgtgtcgttgaattcgttgactttgatcagttggagcgatgtatcaatgcaaaggtaagcgattggaatttataaaattaattaaattaaatttttaacttcatttttcacagatgtctttgccttctttctacgtccttctgcttgtgggttctctttttgtcatttccgttgcgtttttggctgcttttttctttttgccttacattcgaaagaaaatgggcaaaatttgaatttatttgtaatttaaaaaggcattcttttcgggaaccggccactttggcgcaggccattttggcgcaagactctatatcattttgatttcacagcaaaattaaataatcttggtatgattttaagtggcttgatagtgcctattaacctgcaaagtttcaaaaaatttagctgagaaacaaaaaagttatggccaaaaaacctcaaaaatgcattttcctggccattttggcgcagcgcgccatatcttttttaaaacctaatataattttttgaaattttgcaggctaataaagaacatttagacctattgattaatatcaacattattttatttggtcgaattaaaaaaaagttatgaatctttaaacttgcctgcgccaaaatgaccccgaccct

SEQ ID NO: 26160 - DNA, 1269 bp, Heterodera glycines
  misc_feature (31)..(31): n is a, c, g, or t
  misc_feature (83)..(83): n is a, c, g, or t
  misc_feature (1168)..(1168): n is a, c, g, or t
  misc_feature (1186)..(1187): n is a, c, g, or t
aaatgccacagctttccctgccctaaatttngtcaagccagttttataaagtgcagctgttcgcgttcattatacgcacaagntctggtcctgcctaaaaagtggaactcaaagacggaatatactgccgtaataatacaaacccaattattctgctacaattctaaaatttatttatttattgtatttgtaattaattaaggagtcaaaatagaaaatagcgcgatgtttgaaggataactttctagaaatgcgcgatgttgaaggataaaaatgccacagcttttcctggccctaaaatttgtcgagccagttttattgaagtgcagctgttcgcgttcattatacgcacaaagtctggccctgcctaaaaagtggaactcaaagacggaatatactgccgtaataatacaaaaccaattattctgctacaattctaaatttatttatttattgtatttgtaattaattaaggagtcaaaatagaaaatagcgcgatgtttgaaggataactttcttaaaaatgccacagcttttcctggccctaaaatttgtcgagccagttttattgaagtgcagctgttcgcgttcattatacgcacaaagtctggccctgcctaaaaagtggaactcaaagacggaatatactgccgtaataatacaaacccaattattctgctacaattctaaaatttatttatttattgtatttgtaattaattaaggagtcaaaatagaaaatagcgcgatgtttgaaggataactttcttaaaaatgccacagcttttcctggccctaaaatttgtcgagccagttttattgaagtgcagctgttcgcgttcattatacgcacaaagtctggccctgcctaaaaagtggaactcaaagacggaatatactgccgtaataatacaaacccaattattctgctacaattctaaaatttatttatttattgtatttgtaattaattaaggagtcaaaatagaaaatagcgcgatgtttgaatgataactttcttaaaaatgccacagcttttcctggccctaaaatttgtcaagccagttttattaaagtgcagctgttcgcgttcattatacgcacaaagtctggccctgcctaaaaagtggaactcaaagacggaatatactgccgtaataatacaaancccaatattctgctacanntctaaatttatttatttattgtatttgtaattaattaaggagccaaaaatagaaatagcgcgatgtttgaaggataactttc

SEQ ID NO: 26161 - DNA, 1312 bp, Heterodera glycines
acttttagtgaaaaaactttttttttgctctattgttttgaagaaaggagctcaaaaaacgcatttctgcattaaaattttttcatttggacgtcacttttcgtcactagaaatcactattttggcgttttgtcactattttttcactatttcaacattttttggaaaattccttaacaaaaatgcaataaaaccaaaaaatacacccctaagaatcgacctaaaaaaatttcaaaaaatacacccctaaaaatcgagctaaaaattttcaaaatatactcctatgaaatgaaaaaaaattttctcaaaaatttactttcttggcaaaaatttttaattttaaaaatttttttaggtaactaatttgggttttttggtcttaaaaatcccagtcctactcatttgcaactgcaatcagtgaataaaaattattttggcttattttttggctgaaaattatgtcactattcgtcactatttcggactttttgtcactatttcttcactattttggcatttttactcactattttagttaactattttgggatttttcgtcactaaaagttgcggccctagtcattagcataggtaacttacattggcactctctttccactcattggaacttaattgcatcatgttttttatctgcccaaattttttccggcacttattgtagattttgagtcgacaaaatattcgattagtgattacttttgataatttaagtcgggactcttgatttgcaaaatttttttttttgaaattagttaattaaacacatttttaagaatgctgatcattaatatgctaattgctttggtcatttttgtttttttttaaattctttttccaaatctaaagttgtttccccattaaattagcaacgaaaaacttatttttccaccctaatattttttttgtcaacctctaatctacagaaatgctttttttcctgtataaaagcacttggaaatcgtctaagtctatcactttcgactctttttttttgatgaatctactcactctccataatttcccacacattttccccaaataaaaagtcatgcattttcgcgccgccgttttcgcgcgtagcccgagtttttggattcgaacttttttctttgtcggtcaaatctaacaatcttggtatctttcgaaagcccttcacaagctctattagcattacaaattgcaaaatgattttctggcaaagttaatagaaaaatttctaaaatttagatttttttgcaattttaagttatatctttttttagcaattgtctaatcgacaagcaattgttag

SEQ ID NO: 26162 - DNA, 1704 bp, Heterodera glycines
  misc_feature (1696)..(1696): n is a, c, g, or t
attaaaaataatgctatatttaaaattaaaatttttttaataattttaatatgcaactttttcgtcattcaatttatttacaattaaatatttttgatttaattaattatgaattttaattgtaattttaatattattctgactaaataatcgccgctgttttattacttaaatacatttcttgtttattgtgatttgctttttaccaaatcaataaaaatatagtaattaatatagaagaatatttttttctcgttaaataagaatataaacatgaaaaaattttaatgcttcaaattatttgtatacccatatgttaaatagttgatgaattgggaaggaaaaaaattccttgtaacaattatgcttttgggcaataagttttgattttttttctattactgtaaagtgcattgctttaattaaaaaaatatttgtatttttcggcgtttaagaaaataaatttaaaaaactattttaagatatttgacattattttttaaatttatatctttttgtttaatttttgccttgctctctctatccagtgataccaaatttataccgactttttgactaacagttcgcgaggttcccttattagctatgtttctaaatttatgttccaaaaataatttttacgttattttttaagtcattgaaaaaaataaataattccattcttgatttcttggagtgtttttttaagtatgttgattttaggcaaatatttttacaaatgagtttatttaatattcttttttcaattagagtatactataaaattagttaaatcagtaatccctcttctttcatattaatattttaaacaattattaatttatttatatattagcattagttaattaaaattaatgttaaaaatagcaaaatatattttactttatattataaacttgttccacaaatgatccaattccctctcaagcaaagttctcatgaattcattaattgttttttttaaacttttatctgaaagctaatataattacaaatgaaaataatcaaattatcaaaataaaatgttaacaaaaagtatttttaaaaattaaataaaaataatgataaatttagctgatcagaataagtaaatttatttgaattaaactctatttttttttctttatccggtctaaattagtttgaacaaatatctgaaataaaaagatgaataatagaaataaataattcaaaaataaatatcataaaaataaaaaactttttttgacataaacaaattaatacagaaaatttaaataaaatattaaaattatcaaactaatattgaaaaataattaaaaaaattaggaccttggagaattaattgtaaatgtatttgaatgaaaataaatttgacctttgaaaaagataaaagaaaattaaaaaattaaattcttatgtttgattttattttcattttttaaagaatttaattgcccatcaaaggtccgacgacgcgaaaatcataaagcccaacgagttaattggataaaaatatttttttgaaaattgtaaagaatatttactcatataattatttaattttcataaaaaattaataatatcgatgataaaaattgtattacaatttttatagttgccaaatgaataaaaatttttaaataaatcaatcgagactaacaatcatcttaaggatgacattatatttagcaanttattcat

SEQ ID NO: 26163 - DNA, 1977 bp, Heterodera glycines
tgaattttttagcgtagcaacagtagacgttttggtttttttttcatattttgtagatttttaatcatatttttttgttcaattttaataaatttatgtaaatgcaaaaaattaattaaaacaaaaagtatatattgaaatataaaaaataaacattcggttaaatggcaataaaaatttttcttttaagaaattaattaaatcggattcattgcgaggaatagcattacaatctaaacaaagcaaaacatgttggaagaagccggatgccattgaattggttcgccaattttcattccataatattgtcgaaagaaattttataattgccaaaatgttggagagttggcaaaacaacggaatgccatccatggaacagtctttctttatcaaggcatatttcaagcaaatttccataaaaatttctgaaatattattaattgttggcggtagattggaacatcccgaaatgaatattttcgcaaattacggatttaaaatgcaaaaatggcagaatgaaggagtgtttgaagaaaaaattggcacaaattgacgaaatgccaaaattggtccgagttttttgtacatttttcactggacatattgatgccgataagttgattgatgctctgctacactcgggctggtccacagttttcaacgctcaaattggcgaaaagaaacacggaaaaagcattttggagaaatttaacctggaaaattaaaagaaaaattggattgcaaagaaagtgttgacaagtatcactcgttagttgtccttgtttttgcttcattttcagagaaatttcattaactttttaagcaatttttttggtgcttttagaccatacaatcacaaaactttgtcatcccatgtgatcaattagtgatgctcgagagcgaacattcccttttctcgaaggactcgagactaacacaaaagcacagccgactgaccaatcataaaatggaaaacccaaaaaaatgacaaacaaaacaatagatttaatttatatgaattttttttgaaggttactaaaatattgtcccagctcctcatttcttaacagggtatttttgactgaaaactcaatttctttaatggcgtaaaaaagtctcgaaagccaagacttaaaaacccgtgacttgagccgagaacaaaacatccgaatcgaattgagtccgacactctcgagaatcactactgatcatcagacttcactctttctctttctctcttttttcaaattattaatcccactatttatcatatagtgtttttttcgcctttaattgttttcaatttttcggcgaataaagtttgttgttgatcaaatggccaaggattttagttattggtatttatgacccccggaatttggcgttttttagcagatataaatcccatccctgttcataactagagctgagattttttccatttgtatattttgtgccgatttactcctaaaattcttccaatttttgtctcaattttatattgggttttccagtgatattttccttttgtctacagcttttctttaattatttcaaattttctaatcatttctcttttttgttgatcatttggttaagctaaattttctccacccatttgattaacataatgaataaattccgaattttcctctttttgttcaattattgtctctttttcttcactttcatttttgtcccatcgatttacgaatatttcatcaaaatttggttggattttggcggattcaattttataagcaattaaatatgttataaatattaaatgccagaaaagcatttttaaattcgtatatttatgaaaaaaatattttttataaattattattataggaagaaattattattcacaaatatattatattttttacgtattattgcaacactatttttttattgttttgttaatctacgtataatgaaataaaatcaaagaaacagaactttgaaaattga

SEQ ID NO: 26164 - DNA, 1287 bp, Heterodera glycines
  misc_feature (1178)..(1178): n is a, c, g, or t
  misc_feature (1185)..(1185): n is a, c, g, or t
  misc_feature (1254)..(1254): n is a, c, g, or t
ttttatttccatgaacattgaacaataaatcatcccactattagctcaggtactaaaaatcagctcattatattcccaataaggttcagaaacgcttctccgaccctgaaaacccataaaatgactatctcgtgaacaaaaatttaaattttttttctaaaaaaaggggggggggtaccatcggcactatgagaataggacaaaagtgatttcggcggcgtgattttggggtgcactctggcactattaccccaaatatcattcatcagagaatggtgtggcagattattatgacaaaattggcttaggattggtttatttgcgaataagtaatacatacaatttatagcttgtcagggaggagaaatgaagtgaaaattgatgtgctctcctctttcactgatcgcctctttctttttgtgtctctgaattctgttccgttcgtaaattgtgcaattgttgtgcgttcgccgtttgttgctgagacactccgccaaaccttttctgctgagtctgaatcggagaagagtgtcaaatacatgggctttccataccaaacattgaaaacgttggaatgtgtaatgcacaaattcgcctttgtcggttacggagggtgtcgaattgtcagaggcaacttccttaacgccggctaaaagggaaatacgaaaaaatgtctaaaagcattcaatgtgtgcacatacgcaaggccaaatcggaatccccaaagtggtcgaagttggaagtgtccgcaattcccttcacttcgatgcgaatgggggccggcaaaagcctttaaaaagaagtataaagaaccaaaaagtgagggaccttatgttctgccagtcgaccctcttaaagaaagggcactgtttgatgctttcaatgcccgaatggttgccgagtctcttgtcaacttcgcaacagaacccttttattgtctgcagaaagaaagcattaacaagtgcttatcgacagtcagaaaatttacattttttgcttcggttgaaataggtatttcgggcggaaaagcgagggtttgctgccaattcatcacttttctgtatgtctcctggggagtctctgagcagaacgggggatagcctgcaaaacgcatgaaaaggttagacaataccaaattattctttctgttcgggttgactgccaggccagtaaattgngagaggngtcaaaaattgctctgccctgcatttcgcccattccaatctcagagatctaacaaatttaacatttgangttgttggaatcctttgataacaatgcattacc

SEQ ID NO: 26165 - DNA, 1028 bp, Heterodera glycines
  misc_feature (979)..(979): n is a, c, g, or t
  misc_feature (999)..(999): n is a, c, g, or t
aaatataaatttaaaatttttttattgcttttaaatatgccaaaaatgtaggctacttttttagtgaaattcgatcactcatatttttgctaatgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaaaacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccantaattgtttgagtaccccanaacggacacttgaaaaaatcgatttattt

SEQ ID NO: 26166 - DNA, 1366 bp, Heterodera glycines
  misc_feature (37)..(37): n is a, c, g, or t
  misc_feature (1307)..(1307): n is a, c, g, or t
gagatccatgaacgcgttttgcgcaagcgggctttcncaatttgccagagggatgtgttgccaagaatccaaatgccaaggctggtgccgccaaaattctggtcgatgcatggcacgttttcgggaaaagattaattttaaaaaatttgttaattaaaaaccccagttaatttgggttgaaaaaatttagggttttatttttttgaaattgagaaaatttttaattttttgactttagaatttaaaattccattgttttatttaaaaactttctgatgaaaattccttttaacaatatttttaaaatataaaaaatttatttaatattacaaacaatctttttatattttaattcatccaattaattaatttctaggagaagattcaaaaatccggcagctattatcgtttccattgtgcataaagaatacagctattggcattttctcaagcgttacgatgagtacgaaattgacgaactcacaaaatataaagccaaagttgtgtatttgactgtgttcgaatgtggtaattagtaagtggaaacgaaaattaaaacttttttttattttaaaattttctattcaaaaataataattttgtgttttgcaatttaaattatttttttttaataatttaagcctaacattggatgatgatttaacattgcgtctgaaaggtgatccagttgctgttgtgtacgcaaatgttgtgatgactggtcacaaaatgctgcccgaaacattggctttattcaaaatgattgaacgatcgacagcttttgtaaaacaattaaaaatcattaataattaatttattacataattataaaattatgttaaactatactaattaattatctaattataagattatgttaaatttattccttttttctccagtattcttcaaccgtatgtgctgatttgagtcaaacaaagattgttcagcaggtaaaaacgatctgtttcaattcattcattttaattaattgacaatttaattggttcttaatttgcatcatttaaaggtgcttacgcgaccgggaatggttgagaaatttttcccgagtcccggcgaagcgccaatggtcacagcaattcgaaaaactttcgccaaaatatgggcattggataatgatgacgatgacaccaaggccattattgcggtaataaatttaaaaaaaattttttttttaatagtaatataaaattttttagcaaaatgaaacttaaatgaataaaataaaatttaaatttatttctttattataatgagctcggcttacattgaaaggatttgggttncagaatgttttcggctaaattttaaacagaaaatttacgaaaaatattttttttgacca

SEQ ID NO: 26167 - DNA, 952 bp, Heterodera glycines
aatagggctgggatttttatgtgctaaaaatcctgaattatgtaataaaatatgtgctaaaaaatgctgaaatatgtgctataagccaaaaaaaatgccaaaatatgtgcgaaaatatgtgctaaaaattggaaaaaccaatggtatttttgcataaaaattccaaaaaactcattcttttcattttcgcccgcacaattgcaaataaaaaacatttggaggtgtttgggggtaaaattagtccttttttgataaattgttttaaagattatttttccatcagttgagtaagtgccagcaagaaacttcgatatccagtaacgaattaatggagaatccgattttcggtacacgaaataaataaagaaaatttttgaaagagcctataaaaatggcaagaaagttgatttttaggggtgcatttttgaattttttgtgtttttcttagatatttttttcaaaaatgccaaaatatgtgcaaaatatgtgtcaaaccccgaaatatgtgcgatatgtttttatgtgcgaaaacgccaaaatatgtgtttttatgtttttataagtcgctctaattcgaaaattgttcggagaaaatgttatttttgggcttctctcgccataactaagccgcaaaaaaaatatgttaaaacataaaaatcccagccctaattataaatgatcaaaaatgatttaattcaccaaattcgctaatatttgtatgatttaaaatttgcatgtacagtttatttattgtattaattgctcacacaaaacggtgagctttgctcggcgagaaagttttgtgattggttcatcctccgaagaggaaagctgacactgaaatgtcaaaaacaaattaattactattaaattagaatttgattttgcatttaatatttcacattttattaattcaatcgaatggtggtaaatcctgaactaacaaatacaa

SEQ ID NO: 26168 - DNA, 1521 bp, Heterodera glycines
attggagtccaataatccgtataaaaaaaattgctattttgctttttagttaattataattttgaaatatttaaagtaacaaaatttgtcttttcaaataatttttgaatatttttataaatttttaaatttttttaaaattataatgtttccgtggtgtttaaaaaatattgcttagaaaataattatttttttattttaatatttttcaatctcttctatcttctcttcattcatttttaaatttagaattttattttaattttgatgaaaaattattttaattaatttttaattaaactagtggataaattaatcatttaaaatatgtttttatttagatgggcaaagatttacagtaatattctctcgtaaatgaaaaattttattttgaatttttccatttttttaattcaaaaataacttccaatttgataaaaatatttaatgattaatatattttttgctttcatactgtacatttgcttttaattattttttttttcatttcaggcggatttcacatggtaaactcgcaattgatccgataaagacacaaaatcattgatcgcttaattatatagattttgtatacattaataatgctttttggttcgatcaatctgttatgcaatatttaaaaacaaatagtgtaatatgcgtattattgtaactttaaaaatattatttcgatttcatgctttttcaataaaaaaatttaattttcattactaattatgtgttgcaatttgtgatcttttgtttataaaaatcaataaaaaattaaatttaaatacaacaattaagaatatgaataatgaatttctaaatttctttcttaattttgtttgcatgcggaatttccttgtcgcagttcaaggatgattcaagcttccttctttctatcatttttctataataatatttcttattaatttttattcattattcacaatttttataaattagtttatttttattttttactctttcaattttcatacttttctttaaaactattttctacgagaaatgcacgaaaaacacaatttttgttcgaaaaactttcgttttaacgcccctatccgactctaggaaattattgaacttttaattctttgggaagtgccgaattgctttttttatacctataattaataatgcctagattatattatgcatcgtcgttatttatcgatgaaattataaatatttaagaatataggtttttaaattttaaatttttttaattttaagaataaattctgttttatttctattagatttttctaaattgaaaaaattattaatttgcattattaaattgatattcataaaactccaattaaatttgcaaacacaaaaattgtcacaataataacgtgttgtgaaaatctgatatttgctgttttcattatttaaattaaaaaacaaaatttttttttactaaaatcgtataaaaaaacaaaattgcaacgaattatttctttttttattttttacattcattttatgttctaa

SEQ ID NO: 26169 - DNA, 1548 bp, Heterodera glycines
  misc_feature (1377)..(1377): n is a, c, g, or t
attaggtaaatccaagtccaggttcgtaatcagtggggatgggatttttagtgataaaaaaatcccaaaataattaactaaatagtgaccaaaaaatgccaaaatagtggcaaaaatattgtcgaaaaagttccaaacctagaggtgtaattttttaaatagctgtttttaatttgaaaataatttaaaattaaggaaaaagattttattcactgattgcagttacaaaatattttcttagcaaatattgaacaagaaaaaaaaatttgggaaaagaatttttgtgaaatttttccaattcttgggggtgtatttttcaaaatttttatgtcgattcttaggggtgtatttatcgtttttattgcaattttgggaagttttccaaaaatgccaaaatagtggcaaaaataatgacgaaacgccaaaatagtggcaaaaaattattttagttgccaacttccgaaatagttaattttcattagtaattttatttctatttaccaaaataattgtcaattggcaaaataaggattaaataaaattttacattaattaaaattccaattctattgtgttttaataaaaattataaatatatcttaaataaataaaataatacactgcggagatcggacggatttgaaaggacagttctgcggcggttcatattttttttggcattttggagagataattcagattcagtccttggcaatttttcgtgaagaatagggttttttcactaaatcgcgtttatcagagattgtagagaatagaaagagctacaaaatgttagcataaaaacattgtgcataattaaataataaaatcagtcgaactagcattttcaaatgaaaaaaaaatttggagaagaattgttcaaagaacagaaatagacgaaagtgattcggatcgttactgtttaaattagggttgggtccccgaccccgctccgaccacgaaccccgacatttttggccattttcggggtaaaccacgaccccgaacaccgaggcttccaacccctacaaccccgatccccgacccttaccccgactcggggtcggggttaaatatacacccctaagaatggcattttcgtgagagaaaaggcaaagaaattatacaaaatttgaaatttttttaaccattttgccaaatttttattaaataaagtaagtttgctgatgcttatgtgggtattgcatcacacttaaattactttctgtcatagttccgtaccggttgagttttctttttcaatttattttttttgtgattaatatggtttttcaaacaaaaacatccattaaaattggtcatcattggcataatttattgacaaattaaatccaatcttcctttcgttgaaattanaaaatttaattttccttgactaaatcatggaaagttaatatttttcaaaatattttttacaaaatataaaaaagtaaattaaattttacggaaattcataaatttttggtgaaaactattagaaaataaagattaatttgacaaaaaaaaacaagaaaaaaacccaaaaat

SEQ ID NO: 26170 - DNA, 1978 bp, Heterodera glycines
  misc_feature (64)..(64): n is a, c, g, or t
  misc_feature (1283)..(1283): n is a, c, g, or t
  misc_feature (1304)..(1304): n is a, c, g, or t
actcattctgatttcggttagtcggttcgcaacaaatcttggttgatcgctctctgacttaacncaacacagtacaggtttcgaatcacaccataagaatttgttttttatttttattcccaattcgttctccacgaatttcatagcccttgttccaatcaaaacccctaaaagttccattcttggtatagaaactttcatttttcttggttttaagcggctccttgaatataataaattaatttcacatttttcacaatcatttctgaaataaacacatgccgcatatgcatccttcgatgcgtctacaaaaacatgtaattgattattttcacttttacccatttcgattcttcttttaagtgtgaaattagcctttttccagttttgtgtgatctgaatccatttttcacattcattttcgttcaaattgtcatcccattttctttccgagtcccataaagtctggaaaaataattttgccggtaaaagacatggtgatgtccatccacaaggatcaaaaatggagtttaaatcctttaaaactcttctccttgtcatttttgaattcgctggttctgcaaatttaattaaaaattcatctttttgtacatcccattgtacacccataatctttggtttttcttttccgagtctatcattttctagtatctgattattaacccaataagaattcgaaacgaattctctcaaattcatccgagcatccgcaaatatttgcttcattgacacatatttttccatagcttctttttcgtctttacagcctacaaaaacattgtcgacaaataaatttttttgaatttcattagtaagttgtgaatcaatttgacttaaatgataccgaaccgtcgcacccagtaaaaatggtgaggaaattactccaaatggtactcttttaaaacgtagaactagaagattttcttttgtaattggttttcttatatctcttacccataaaaatttaacaaattctctgtcttcctcttttaactccaatgtccaaaaggctcgttgaatatcagcccataaagcaatttttggtattcgtgatcgcattaaaagccctggaagctgtggcatttcgattgggccgcgaaaaagcatgtcatttaggcatttaccactccttggttttgctgagccatcataaccaatccttggcttttttcccggtgcgaagacacaatgatgagggagaaaatgttcgccaaacccttttattgaggattcttcaacaatttgctcttttaaattttctntaaatgactcatccaatgctntaagctgacttggggttattctcatcttttctaacatactcattaaacgccggtatgctatagcaaaatttgttggtaattcttctctagggcctttccatggccaacttaccacgtatctcccattttttcgttgaaccgtttctttaaacattttcaaggcaatctcatcatccttctcttccgggttatcccatactcctatagtttctaaattccaaaattgttttggttcctcagtctttacactgactgcggctgttatattttcaaataatgattccaatttacccgaattatttttcatttgaccgcaaataatagggccgactgttgtgtccactttaaacaaattttctttaatctgttcgacacttttaaagaatttccaaaattctgccattccaattagtatgtcaggtttttcatcaataaattcagttttgcccgaatttatgtcaattctctttagtttacccgtaatctgatcaattctgttgacaattaagctctctctttttccattacttaattccagctgtaccaaatattttggagatttaattcgaattgatgatgtttctcggattgacaataagtctaaaaacccatcttcaattctgggtggactcaaaatattgaattaattcgtcactgataaacggaatttgact

SEQ ID NO: 26171 - DNA, 1570 bp, Heterodera glycines
  misc_feature (521)..(521): n is a, c, g, or t
  misc_feature (548)..(548): n is a, c, g, or t
  misc_feature (636)..(636): n is a, c, g, or t
  misc_feature (692)..(692): n is a, c, g, or t
  misc_feature (1525)..(1525): n is a, c, g, or t
ccccccccccccccgccccccccccccccccccccctctcctttcctctctttctttttttttaaaaaataataaaaaaaaaaaataaaaaaaaaaaaaaaaaaaaataatatttttttttttttttgttggggggggggggggggggggggggggggggggggggcgggggcgccccccccccccaacaaaaaaaatttatatattttttttttttttttttttttttttttctccccccccccccccccccccaacaaaaaaaaaaaaaaaaaaaaaaaaaaaaaaaaaaaaacccacccccccccccccccccccccccccccccaccccacaaaataaaaaaaaaacacccccccccccccccccccccccccccccccccccccccccccccccccccccccccccccccctcttcctttgttttcatttaaacaagcccaaaattttttaaaaaaaaaaccgcgggatgaccaaaaaaaaaccaatttttttatttatcatcccctccccccggnttctgtgtcggtcagtcggtgatgggnccaacgctgccgccgccgccgctttttttgccaattcacgaaggatgacaatgccttccagggtgggcgtcaagggttcatctgcacnacacaaaataacatttattatgatacggtcacagtagtaaacaatcaaatataccncagggaggaagaccgcacccgaaatttttaagggaaaatagtatttttgttgaaaattttcgggtttccttgttgatttgcccctccaagaccaacctcacaaaagtaccaaattttttggtaataatctattaaaatcgaggaaaatctattaaatttcccaggcagtgccgtgaccctaatttattttaaaaattgatcaaaatagcgaaatttggtcattttatgcgaaattcgttgggaaaaaactgatacttgtccagttaatgggcattgtttttgaaattttaaattatttttctgggtcgggccacgacctgcttgctcccctatgagaacatcacttacattcttcaacagccagattctctcctccggctgctgcgaacgtcagtcggttgatgggccaagcttgtggcgcagacaccgccgctttgcattactggtaagaagatcggttgcaatgaacggcgcatcagaacgaaattcattagaagccgagcagtcctcccgttgccgttgtagaacgggtgtattacacttgagtttttaatacatcatttttttttatcaagtttttgttttttgaggagggaattttcacttttggggagagaattttcacataaaaggatcattgacatacctccaagctgcagttgcaagtgatcggctgacgcaacagccgggcaggcggcttgcgcgacatcgagatgacggtcgagtcggtgaccgccggggaatttgcggcgcaggcacaccataaataatctctaagctaaataaaaaagggagccgattgtatcaaatttattttaatatattttcagctngattatgtgacaattgaaaaataaaggccccgggctctattttag

SEQ ID NO: 26172 - DNA, 1279 bp, Heterodera glycines
acttaaaatgaatgaaacaatgagaaatgggggaagaggccgacaattaagagagtgattaagggaaagaggggagggggagattaggggggggggtgattaagggaaaggactgattaaggggagggatgattaaagggaacgagtgattacgggaaaggattaattaaggaaagggcttattaaggggtgggatgaactttattaatatacttgagaagtggcaagagaatgagcaaacaaaattgggaaggaaggcgatttgggatagaacagatttgggcgaatgctcaaaacaaaatattttattttctttgatgaaatgaaagccaaaatttaaattcacagattttgaaaattttgtgcttaattaaaatgaattaatttgccaaattaacggggaaaacccgaaacaaaagaaaatgaaaagaaaaacaacatccaaaagcaaacaaacaaaacaaaaaaacaggatcagcagcagatgatcagcagtgatcatcactaccggttggaaaataaaagaaaacaaattgagatttttcagttgcgagcaaatggacgggggaatttgggacaaaacgaattaatttggcaaatcgaaaataatacggtaagagaataaatggaatattattaaacattaatttcaaaggcaacgttcgcttcttcagcttatgctttgtttccggtaaaaagactaaaggaaaagctgacgaaaagccgaaaaacagcttcggattcgactctttaaaggtgttctgctgcgcttggtcattcagtgagacggcagcaaaagatggcacttttttaattaagcagagagtgccatttcagattttcaaaaagcctcatttgccgggcaaaaacatcaatttgaaggtcataatgacttttttaaatgtattcaaaaggtaaaaaaactaaataataataatttccattgtccattaactttgatcatttgtcaaaaagaaatcaacattttgtaaaattcgagcttgaaaaaccaaattgactctaattttagctaacgacagattttgttgaaattgattaattttggcttttatttaaatttgaaaatctaaaggaaattgtgccctttaatgggatctccttatttatacggggattttcaaaaaagttgaaccctgacaaatttatatcgaaagtagagttgcacgagaccgggaattttgacaaaaaccgggaccaagacttaccgggaccagaaaagtcggaaccgggaccgggaccaagtttttcgaccgggacc

SEQ ID NO: 26173 - DNA, 1640 bp, Heterodera glycines
aaaataatttaacatttaattttaatataagaaacacaaagatttttgttaaaatacaaatatcagaaagttcttttaaaataaactcgcaataatttttttttacaaataatgacatgaaatgggtaaaaaattataccgaaattaagaaaaaaatcaaatttataaaataagaatcggtaaaattacttatgtttaacattaattaaattttcctgagtatttctaacatcaaaagtttaacaaaggaccaatgaatgaccaacaaaaataattttcccaaaaatattaaggaagaagttgtgtaaataaataaattatctatttccatatgggcatatttttttattaagattttaatttctataataacaaagttttgaattcatgatccacaagaacaagaaatggtctagatcgtgatgctcttttttgttctatatgttctatattatttaaattatatacggtgtatttgatgttttaaatcacaataaaattgtatcattttaatatcttttttattaatatttttttatttaaatagatacgtgaatatatccattattttgttttttatttttctttttcattaaacaaaatcgatgatcagcgaaaaaatctttttgatatattaataaaattataacgaaaattaatttggtccttcgactgttgatttttttccataccattttctgttctatttaaaagattatgataaatttaattaagtcataagtacggttaggaaatttaggcatttgtttaatattaaattgactcaattgtgtatttattttttatgtctatccgcacataagattttttgtttattaattaaaattataattcagctatttttctttaatcattttaaattataatagatactgagtacaattaaattatcatcaaattttgcatttaatttttggtattagtcgatattttggaagccgaaactttctcataattgagaatttatattttcgcataataagtgatttcttccttcaattgattagatttataacaaagtgcttttctttttaatctttgaaaagcattaagtatgaaaaagaattgtaaatagttttgaattttgcagagtgatagaaactcctacagctaacaaaagatattaagaattaaaaatttggttactttcgttaaaaaatgttcagataaatggtttttaaataacttctcccccgttataataaatttgtttggtcgatttacaaaaatgcaataatagcacttgtaatgtgtgacaattttcatgcatatttctcttcctttttgactcattttgttttgtctcttctaaacaataaatatttattctctgcccatgtaaattatttccagctcagtcaaattctttttaaatttaattattatttattgtctgacgcctttactagcacgtaatacacatctgccagggacgtcaaagaattcttattaataccagaaggcttaaaaataatacatgaaataaatgaatatattattaattttttaaaaatatccaaaatggaaagttgactttctgcggattgagcatcggtagctaattacatcccagactaaaaaacggaatgagggggaatagatgaatttttaattaaaac

SEQ ID NO: 26174 - DNA, 1296 bp, Heterodera glycines
cagcgatttgcaattatgtgaacatttttgttgggggcgcagggggagaagcatttgcgcagcaaaaacgcattcggacgaagaatgaaaaaataacaacaaattaattaagcgaaaaaattaggtgaaatttgtggaatttttttttaaagggttgggcactacggtaggaaaacagcagcatacggttaagcattacggtaaaaaatggaaatttgagtgaactggtgggataatggaaaattcgaacattaagaaagtaaaaataattgatactacagtaggaaaacgggaagcgttacggtaaaaggggagtgaaaattgcgcaatacggtaaaatgggaatttttgtgcaacggttaaaaaaggaagaattaataaaatttggcactgcggtaggaagctgcaatagttactgttaaacaaaaaataattgtgccactacggtaggaaaacgggaagcttacgataaaagaggacgaaacctttaaaaatgggaaaactttcgtgcaacggttaaaaggcaaattttaaataaaatttggcattactgtattaaagctgaaattgttacggttaaaaaaggtggaatttgaattcgctatggtaaaaagactgggcgattacggtagccgacattttaaatgcattgacatttctgctgaggttaaggccaaaaaggaaagaaaaagaaggatgggtgtgggtaattattataataagcgattagatcgcttacatatttatgagatggagatgaaaatttttagaaaaataatgtaatgaaataatggattattatgaagaaaaaaattactgttatgggaataagtacagtggggatacggtacggcatggtgagacactttgttggagagataatcaagaaaagattcccgaaaatggggtactgtaggtgagcagaataaaaaattcagcgcgaagtttttctcctaaaattgctgcgaaatttttatcaaaaaataggcggattgggtcagcaaattaaatgcccccggcggtgggaaaattgcagcgcccaaaaatgccttgggccaaaattgaattgttttgctcgccaaaaaaaaaattacagcgaattttccgggccagcaatttcggccactggtcattaatattgcgcccgattttgttcaccccgccggggccaattggcgcgtggtgtctgccgttacctctgcatctttgtgtgtcccgcagttgcacactatttccccgccgatgtcccgtttctcgctgtctgcgctcagcgatttgtgtgcagcgcatccataa

SEQ ID NO: 26175 - DNA, 1107 bp, Heterodera glycines
atgccaggagggcaacaggtgacaacgaacggaaggcaaaggcaaagggcaagcgaaaatcacgcaatggaagccacggcacaatgggaaaatggccaaaccaactggcacaacaaatacaaaagttggctaattaattggcccactttgcgattatcccacgcgtaatgtcaacggacattaactttcaaatccctcgccataaatttgcgcctcattagcgtaaagtttgcttaatgcttttgtttgattatgtcttgtcttttatgtcatcgtttagggcttcaattcattatgaaaagccaagccgcacttaaacaaatggcattattaatgaatgaccttttcccttctcctctctgctttattcacttcattaaaagcgcatatccttctcattcgtcaaatctctcgctaaacccttttttatgttaacaataacaaattaacacccataaattccttccgcattttttcaattgctaggccattaattaattaatcacatttatcagtcaattgttttttgtgctgggattatcctcttttatggttcacttttccattaatattcttttttaatatgctaatacttaataaacagtttaacgatggcccacacattccctccccccccccaatttgtcaactttttgccattgtcttttctacgccttcgcatttggcattaatatttgccttttccgcttcctcctattaattctataaatgaatgtgttccgctttctaacacttcaattttttttttggtttgtttttgcattatttaaaatgcaattgcaaatgcaatcaaatgaattcctttttttggcttatcatttatcttatctttatcattcattttctatggcatttctttccgcagttttatactgctgccttttatttcattttgattattgttagctcgtcactgttgccattacaaccgacgcgatgagatgagtgagtgcgtttatttttcgggccaattattaaataccatccctcccctccttttctcccctcccctccccctgagtttggtctcccccgcgctccctttgtcgtgtccgccgtccgccaccccattccgcttcatgcctc

SEQ ID NO: 26176 - DNA, 2188 bp, Heterodera glycines
  misc_feature (918)..(918): n is a, c, g, or t
aaatttaattatttttaccaattagcattactttttctcatgcaaaaattataaaaatgaaatattttttccaaataaattttttttttatcttttctcacaaggggtgaggattttttttagttttcatgtacttttttaatggttttgtttcacttataaatgcacaaaaaaacattatttttatcgcggaaacattcattttatgtcactattcgtaaccattttgaattttagaaattagaaacaaaaaattcaataaatcgaaaaatacctgacttgtatttctacaaaattaaaaaaatgattcctagagtcagaaatgttcaatttttaataaatttctattgcaaaattctataattgtcttttgaaaaactaatcctcactctttgtcactaatcaaccacttttctttttctcttcctcttgtccttcttcctttttctcttcctcttctccttcttcctttttctcttcctcttcttcttcttcctttttctcttccttgttctccttcttcctttttctcttcctcttctccttctccctttttctcttcctcttctacttcttcctttttctcttcatctgctccttcttcctttttctcttcctcttttccttcttccatttcatcatgtgcaccccttaattattttttaaacaaataaatcaaaaacatttggtctttttgttaatttttaatctgttcttaaacctgcaaaatttaaaaaaaaaatgaccaaaataactcaaaaactcaagtcaatcaaatttcacaactttttagttttaactttcttttgcccagccaaatttctgagtgaaattttgaaggatttctaaaaaaattaagagctaaagaaagacacccaaggaaatttggtttgattaggattttatcgaaaaaattgnaaaggaattgtgatcccttttccgagtaaaaaatttgtcaaaaatttttctcataattttcttaaaaaatgtaactcacgcaccagtcagacaactcgctttcatctggccttaaattgaaatgtttttttaaaaatattttaatattttctttatagatatgtgacttaccaattatagtcagtgatgaaatcgcttaatattgggattcattattataaaacatatacactaatataatatttattctatttattctttatttataatatatataatatttatatttactgacaaccaagggtctgcgtcaaatccactataaagttggaatataaatttacacacatttttaattttttatatacccacccattcgcaaattgctcgggttcgctttaaatataattgatcaataattacttaaattattaaaataaattacatattttttgcttttttcacaaggtggtgttcagcagaagagggtggacactgtcgtttttttgaaattagacttgactaaattggcagaagatcattttcacaaaataaaatgacaaaaaattgaccatttttccaagaattattatacgcgcaaagaaggagaaatatgaatgttttgaagagatgctaaaaggcgaaaaattaaaggatgataaaggacaagaagtattactttcggaatttttttcaattttaaaattataagaaaaggaataaaaataatgccattaaaatttagtttaaaaaattatccataatttaaatatttttgggtttcatatgcaaattcggatatttagtcatttttgttggcaatgtttcgagtttagcgtgacaaaagaagtaaaagaatataaacataggatttaagagtgatgtaattaatggctgatgtaaactacgaagtgttaatctcgggagaggggggggggcacgggaagcgaattgatccccaaaaaaatgactttttctagcttttttgcttgtaattaaacacattaaatatcaaaggaaaattgggaaaagaaataataaaaattaaaaaaaaaaacttatttatttaaaaagttatattaaattttgttcgactattaatcgtatcccaaagctttttgtgcgattttaatggataaatgcgttgattcactgcttattgtgatttactttctcttgcttttaccctttgctatttattgtcattttccaaacaattgcttagttttggccaaattcatttgccgaacaatggaaaaaaagagataca

SEQ ID NO: 26177 - DNA, 1608 bp, Heterodera glycines
tgcttaccttgccagccggacgggatggcgtgctttcaacgtggtatggtcgtaaacgaaaggaaagcaatgaaagtaatttaaataggcatattaaaagagcctatttttttgccttttcacaagagaatttattaaaaaaggcaaaattcgccttaaattaataaggtgaaagtttgaaaatgtttattaaaaaatttaaggatgaaatataattaaaataaatcaaaaagaaaaaaaatcaatttatttttctaaataaataaaaaacattgtcagaggcagtgcctgccgaaaaaaagacaaaaattttttcgaaaaaaagctaaaaaaattgaaaatttaaataaatttacaagtgaaaaaaggaaaaaagcttacaacaccttcgattcccaggacgtctccgttccaagtactaagaaggcccaacgttgcttaacttgccagacggacgggatggcgtgctttcaacgtggtatggtcgtaagcgaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttaaggatgaaatataattaaaataaattaaaaagaaaaaaaataaatttatttttctaaataaataaaaaacattgtcagaggcagtgcctgccgaaaaaaagacaaaaaatttttcgaaaaaaagctaaaaaaattgaaaatttaaataaatttaaaagtaaaaaaaggaaaaaagcttacaacaccttcgattcccaggacgtctccgttccaagtactaagaaggcccaacgttgcttaacttgccagacggacgggatggcgtgctttcaacgtggtatggtcgtaagcgaaaggaaagcaatgaaagtaatttaaataggcatatttaaaagagcctatttttttgccttttcacaagagaatttattaaaaaaggcaaaattcgccttaaattaataaggtgaaagtttgaaaatgtttattaaaaaatttcaggatgaaatataattaatataaatcaacaagaaaaaaatcatttatctttgtaaataaataaaacacactgtcagaggcagtgcctcctgaaaaaagtcaaaaaaatttttgaaaaaaggtaaaaaaagggataatttaaatatattttcaaaagaaacaggaaaacagaataccacactaaataaattcacaataaaatcaattacagataatccaatgttctttcgcaaatcccatccacattttgtatgcaacccccccccccccaattggtcccgatcaaaaaatgagtttttaatgttaaaactccccccccccctttctgaggaggttgaacaataatccccccggggtgataattagagataatacggtagtacggatgttactccccccccctttttgaaattctaaatatgcaataaaatgcatgaaataaaacgaagaatacgattccgaaggcaagacaaatatttcatgcatttgaactgcttttattgcgtatttagaaattgccgaaaatttaattttga

SEQ ID NO: 26178 - DNA, 1465 bp, Heterodera glycines
tttgtcttcccgaagggcattcaaaattcactattttatcatcctaatgggcattttcacagtcatccaaaagggcatcccggggcattcttcttttttttttttcatcccgaagggcatcctagggcatcccgaaagtcatttttatctatttatcatcctaaggggcatcccaaattttcaaaatttcatcctaatgggcattttcatccaaaagggcatcccaaagggtattcactgactttatcggggcattcttttttcactctcttcttttctcctttttaccgcctccggaggactttctttttattgccgaagcactcactgatggccatcatttccatgcttttccctcactaacattttcctatgggttgtcccttagccgcccaggccaaatgcctaaccatccggtgctaccaataacacacatgcccagtggaacgagctgaattaggctttgggatcccaaccctcagaattccaatcatttttatgagggggtcctggggtgatcagtcccacttccctccccaactccaactccattttaagaatggctttattcccggaaaagcatggaaaataaatataaataaataaaataattacataaaatggaatcaaatatttaaatacaatcaaataaaaacataaaatacaaaaattaactaaattaaataaaattacataaagttacataatcatgattaagtgaatatcaatggagagatcgcagcttaaatagacataaatggaaaggggaggagtgtcggatcgatcgctaacgggaaaataaataaattaaaatgaaaatgaaaagagagattaaaatgaatgtgaaatgtgcttaaatgcttcggcaatttatgttaattagcttatgtcttacacctcatacccctttttagaccgtccctggtctcagatttgaaaccagttaaaacaaagtttttgcataaattaattttgcgcaatttacttcaaaaattttcttagctttttgcataaaattatttcaaaatgtaaaatcaaaattaataaaaatgaattatgaacttttcacctatcactcccttccctaaaaggatcgtccctgatccatttaaaaaaattttttgccaaagcataaagtcgccatttccgccctttttatcattcctatttatttccattgccctttgccccttggttgaccacgtcctgctgattgtccatccgcgtaccaacaattctttgccaaatgcccaacacgtttgcatacaaagcaagcaccacgaggacccgctgattcacgacttcgcacaaaaacggcaccgctgtactgctcgaagcgctgttgtggcctccaagtctcatttcttcgtgcacttggaccttggtcgggctcatccgctcttctttttcgcgactcaaatgtggacgtgctgcttgaagtgctctgtctgttgcatcgttcgcc

SEQ ID NO: 26179 - DNA, 2304 bp, Heterodera glycines
acaaaaaatgcaaatggccatgagagcaaagccaaaagacgggtgcagcagaggacggcttttcagttcggcccaacgactaaatcagaagacaaagcaaaaaattaaaatgtgatcgacgagtggcaccattcgtcgaattcattcgcaatttttgcattatgatcagatgatcacttaaaagccaaaaaatggccaggggacgaatttaccaatttacttatccccgccccccattcgaatttccctttttttatttcaacggccatttatgttcataaaaacttggtattttcctattatgctataccccccttattttttcacaagtatttttgttttttgagtaattttatacgctgaacacgaattggcattatttcatcaatccaccgtcatttatgtggtgaggtgcatgaacttttatgtatgtgaaaagtaaaaatgatttttgatcacagaattaataagcctaatctctggtcttaattaccaccaagaaatgtgcattgtgcacattttgtaagagattaacagagactgtatttaaaagtgccattcattgcattttcaaaaggtgatcctccaatttcccatggcatacaatttaaattattatcgctaaaattctcaatgaaattgaagcagttaaattactagaacaacactacattgtgcatgcctcgcgaaatttctgattgtgggaattaaatgcgactagctactattaaagtttgatgaaaagatgcccattaatgccggattctccgtgttcagcgcataaaattctgtggggggggggggcggtaataatgggaaagcacccaacaccaaccctctaaaaattggtcttcttcgcgtgcctgtaaaaattgccgagtttggccccaatgttttcatataatgtcaaaaatcttttatttcctcctttggaaaacatcgctaattcggcatatcttttccgttttttttttgctagtgccaatggcttctcccccatccgcttgtccttcaattagtgtgcattaatgatgcataatcgtcccattagcgcttcttgccccccccccccccttccgtttgttcccctttctaatcacgcgatgagaataattctcgcttcattaatccgtgtttttctctttttttgaaaaaattgggggcttcaaaaaattgaaaataattttgttattgtttttatgtccttttttgccaaatttatttacattctctttgcgaattttgatttattctcaacaaataaatttatttaaaaaataatccaaaatttccttaccaatttcgccttccccttttattatgcaaatatttttcttctttcgggccttaatttgcgttcttttcttcaattcaacacatggaaaaaatgttttttttctccaaaaattcaaaaaattatgatcttattgtgaaaaaggatgaaaaatgatattttattgtctttttgaaaaaatgtgggtaaaaattaatttgaaaaataaatgaaatgcaaattttaattttataaattattcaaaacgaatttttctattttccctcgtggaaacgaaaaactaaagcaatgcaaaaaatattaaatgcgcaattagtttaattgaaactataaataaaccttttgattgaatccgcctttttcttagccaattttcaaaatcaaattttacgccaaatgtccagccgatttggcggtctgccggccgtttctcccttttgtggcacttctgttgacgacgaatccaccgaccccgaccctttggtggtggaagaagcttcggcacaacttccgccactccgccgacagtgcgacgacaacgtacgacgaaggccaagcattggcatgacaaatgaacacggaaagataaaaatggcagcggagggcgaagagcaaagagagggcgaatatcatcagacgacgccggagggggcgtgccacagtgagagagagggggcaattaggggaagaaattagcagagtgggggcaatgggcggcatttaaaaaaagagggcggggggtatttaagagagggcaaatggtcatttgttggtgaaatgtgaatgaatgaatgaatggcatttaatcacttgtatagacagatgtgagaattctgttttttttctcaatttcggcagaaaaattaaaaaatggaaaacagaatttgtgcttaaaatattatatatatcatacggtaattctcgcccttaagtccattttctcacgagagcgtttgttgacttcatctcgggaatggcacatattaattgaaatgttcgaatatgcaaaa

SEQ ID NO: 26180 - DNA, 1227 bp, Heterodera glycines
ataaaatgacaaaaagagagtatttcacttgccaaacattctagagttgttagatctgatgggggcaaagaaattttacacgtgcatggatttacagcaaggatttatgcaaattccggttgccgaggaagacattgaaaagacggcattcatttcacacttgggcatttttgaatttataacgatgccttttggtctaacagcggccccggacacgtttcagagagtcatgaactcgttgagacgacggttaacggcggcgatgttaatttatttggacgatataataattggcagcgaaaccgaagaaaatcatttaacggatattaagaattttcttttattactaaaaaaggttggacttaaattaaaattggaaaaatgccattggggaatgtccgagatacggtaccttggctttttgctaagtgaaaaaggtgttagaattgacccaaagcaggtcgaagcggtacaaaattttaaggcaccaaaaagcctaacagaattaaagtcattgttaggagcactaacatattttcggcgctttatacacaattttgcgcatattgctcgaccattacagacattgactcaagataaatttgaagggaaaattgaagaaaattggggcccagagcaagaacatgcatttcaaactctaaaacaaatgctcacgacagtaccagggttagagtcaccaagattcgcgagagcattcacaattgagtgtgatgcttcgaaaaaggctattggagcagttctccttcaggagaatggtccggttgcttacatttcaagagcattaaatcggcacgaaacaaattacccttcaattgaaagggaggctttggcattagtttatacagttaaggaattctcgccatatatcgttaggtctggggttaaaaaagtaataacggattgtagtgccttaacaggcatgatgaaagcgaaggagttaaaggggagacttgagaaatatcaagtaactctccaaagtttcgaattagaaattatttatcggcctggaaaaaagaataaagtggcagattttttgtctcgatataatataccgggaaaggaaaaggatcctgaaccaaaacaggaagaaaattcagatgagtttgaccttcagccaaaaattttaagtgcaaaaaatattaatgaaaatttaattgccgaaaatgatgaaatttttgaatgaaaatccgaaaataaccttaaaaa

SEQ ID NO: 26181 - DNA, 1554 bp, Heterodera glycines
gtcaaataatttgaatttgaccaaattaatccgacgcatcattaggagaggcaagggaaaaaaggaagaggggggatttctgagcagaggcaagggaaaatggagggaacagagatgaccataggcaaggaaaaatcgttttttttgtgaataatgaattaatgaagttaatcaattattactttttatgtttttatgtatttaaattttaaaatatatgtattttttgaaacctgaatccatatctcactacattaaacaaataataaataattatgttcctctattatttttttcaaaatttattttaacaacaacacaaaaatgaattttaatcaaaattcaatttatcattttccggcgctcctgcagttttcgcgcatctccccttttccgcttttttgcgctcttttcgctcttgccaccactgtcggctgcgccctaacactttttttcgctgcgttgccgacattgtggagaagccagtaatggccgagtcaattgacccggaccatatactgctccccatcacactctcgtttgcttcttcctcctccccctcctcctcctcttcttcttcttcctccccctcctcctgttcttcttcctcctcctcccatcttgcccagcggcctaaaattaacaaaaattgcaatttgataatttaaatttattaaaaataaatcgtttcaattattttaaaattatttttttataatcacctcctcccccgccgcaattaggtcatcattttctgccaaattttcaccccgcaactcggctataattccatccatagccaacggcgcatcgttttcgcccagcaaccgctccctctcgtaatacgccaacaattcattttggctctaccaattaaatattattttaattattatattttttacttactatttcactaatttctgcatatgtgcagcctgtcggattaaatccgaaaaaatataaaactattaaaaaaacaaaaccaaattaaaataataagaattttacctgaaaatacaaaataattaataaaaataaatccaaaataaaataaacatttcataaaattttttattaaaattaaataaataaatgaatataaaataaaagtaaactaaaataaataaataaaacaaaatgaattcataaaaaacgaagcgaatgcttctcgcaataaaaactaaaaaataatctaataaaacgccccaaataataaataaatttattccacaataaaacgattgaacgtaaaagcaattaaaattgtttatgaaaagttttcctttcttaaataaaaggggagaaaaaaaaaataaaacgataaaaaataatttagaaatgaaaaaaccataaaatgataatgtgtaaaatttgaatgctattaaataaccaagaatttttggtataaaagggggaagggttttcagtttagacatgcttcaaccaattcactctgctagcccatcggttctcttcactcaacaagccggacaacaactcgctctgaatacatcacaactcgggcattcgaagcatcgcggatatgatcaa

SEQ ID NO: 26182 - DNA, 1590 bp, Heterodera glycines
  misc_feature (74)..(74): n is a, c, g, or t
  misc_feature (142)..(142): n is a, c, g, or t
  misc_feature (153)..(153): n is a, c, g, or t
  misc_feature (204)..(204): n is a, c, g, or t
tttgcatgtttttggttatatttaaatttttgtattactgtattcacattaatttctataaattttcaaaagtntcattcttttttttgtttcctttatcttattcaatattcgattatttattattttttgatctagaganatatgaatgtntaatattatatgttttttaataaaaacactatttgtatattattttatttnaaatatataaatttattttggttacttttctatattttaaatttcattttgtatacgttataattaaattaattgcaatatttttcatgttgtggttcagattttaccttgtttttttcgttcgacactattctgtttttgaccttatattatcgttatttttgtttgttattgtttatatagtattgagaatttaaaccatttcatttttgtatttatttctcatgatgagctcggttgtaaatttcatcgttattcattcgcagcaatttaaataaatttactcttgttataataatttttttttaatttggaaagtttgtcaattctttgcatttttctattattgaaatcagttaattttctttatttgtaaaaatatttcagtaaaaaaataaatttttcaattttattttcaattttattattgattttgatgtttcttatttttaattaaattatttatagaaacatcagtaattgcatattcttataattacttattatgcatcttaaattttttaaagtttaaaaattaataattaaataaatctttaattgcataaaacaaaaaatctcattttattattttatttcttaatcgcattctatatttgattagttatcatttaatttcgaattaaataaacaataaaaataaaatcagaataaatagaactatgaataattattctttttaataatttttcttatatttcttttaattaatatttttaatttgattctataaaactaattttttaaaataaaaataaatagaattagttatttacaatttagcgatttttaatcactactaattaattattagcatagaatcgaattaatttgggaatatatttaatattttaatttaataaataaatttacttaaattcaaatcgagtattttttaattaaatgttgctttttgatgttattagataatattcaattcctataaaatatttgatttaattcattcacaattattattattcaataaaatattattatttaattttatttcatgctaaaattctgttgtgatccattcgcattcgttgccatctcttattaataaatgcattttatgtgttggtgtattattattttttgctaaattgtcctttaaattatttattttattaaaatgtgagacaaattgaatattaattacctatttttatttttaaataattatttatttattatttaattttggtattgtttcagctatttctttgcatttcgtttttacaaatcgctgaaaatgaaggtaaatttaattttacagcaattaaaattaacttttaaattacattttgtatattaggatttaattaatgaggttttaagaatttttttaaataattgatgaaaaat

SEQ ID NO: 26183 - DNA, 1623 bp, Heterodera glycines
aaaaaccccttttatgtctttccccgtcttgatcacggatcctgtaggaaggtggatcggtcagattcactttagaaattcgaaacagctcgtccgtaaaattcggaaaataacctttcgaaaaatcacccttttctttgctattcgcactatgtcgcccaccttaaattttggcgttttgggactcgactcgccttgtttatataggcgattccgtagaccagcggcatttttaaagttgacgtccattggccttactccggttgttcggttcgcggagctgttcaggttacgcacaatgctgtccagcacatcaacccaccgctttgtgttcttttcgctaaaatacttgtaaagtcgctccttcagcgtacggtttgcgcgttccacagctccagcatgcaaatgtgggctgtacatcacgtgcttgatgatctccttttgtttccagtagtcaatcattttctttgcctgaaactcaagcccagcgtcgctgtacagcttattgggcagcacacctgccttattgaaaatcttctcaaatgccgcaatcatgtgctcactttttttggactctacctctgcagtgaaaatcttccgacttaaaacatctatgcacactaggatgtagcgaaatccatcattatgctcttttagcgcgtccatgatacacaaatcgcattgccagtccgtgtgtagtccactgggcacagtttttagtctgcggaagcggtttttgcgcggtttaaacaacgtgtaggtgcgctgtttatgcaaaaaatggtcaacatcacgaagagtaatgctcggatttcgcttcttcgcttccttcaatactttttgaatacctgcgtaacttgccggcgacctaagatcgtaatacacttgttccagtaatttttgtactacagctttgcccatagaagcggtttaaagaatttacgttgcgtgttatttggttgctccattcggctgagtcctaccgtttttatagcgcttgctttaacaagaacgaattttttgcgcttgctccgcttactaccaccctctccccgttgggaatgaaaaaatttcatcatttgcgggtcgctgccaattttttgaacaaaaaatcgatgacctttcggcacatctgctctctgtcctgtcaagtacatcagtgagtcaatgtagttggacctaatcaccggctttttgaagtttgttagaatttcgccggacgacttatcgactccgtacttttcggggtttcgttcaatcatttcgtgcagcttatcataatgctctgggcctgttttaagctccaaaaatttttgttgtctctttttggttagccgcaaatcggtctcaggcgcagacgtatccgtttcttcaccaaagctggcaccattgggagttttaattctggaagctttcacagattttcgtcctatttttttatttatttttttgccatcctgcccgttcacttcttcaatccggttgagtgttggtttctgtatgcccatatacggggcaatgttttgtggtgctatgcctgtagcgttttccacaatcaccttttgtggtttgttctcaatcaagtccttgagctgatgcctctgtttgtacaaccacgagtgg

SEQ ID NO: 26184 - DNA, 1831 bp, Heterodera glycines
  misc_feature (1803)..(1803): n is a, c, g, or t
gtttattgcgttttttaaaatattttttttatagaaatataaaaataaattaccactcactttttctttgtatctttttccttggcgccagaaagcggcagaatttcttcacatgggctctccttgttcttcttcttttctaacattgacaataaatcttttttcttctcttcggacattgataatcgatcttttttctgcttatcggagtcttttttattcatttccgctggccattttaacttttggttaatttgtttcaaattttgtctaagctcttccaaaaggccattaacaatatgcaagaataatgtttgttcggaagctactacctttttctgcgaaatgaatgttatttaattatttataattaattctacaaaaattctgcataaagatatgaagcaaatctcacccaaatttcctcaatattcaaatgaaatataagcctaccattttataaatttatttatgttagtgccttttatattggcattttagtctgaaaatctgctttgcttctattaataatgtcactattcgtcttaaactcacattttggcttttttgacactaaaaataagccaaaattttggcgttttgcaactatttttacaaatattttaaaaatataaaaaaggaaaagaaaaatgtacacctggatagaacttttaaaaaaactattattaaaaacaattatttatttaatgacgaatttttattttcgaaatagaattaactgagagagtcatttcaaaggatcctttttcagttcgggagaatttttttgtgtttcattcaaaaaaggtcttatttaatttttcaattaatttttagaataataatctgctgttgaggcctttaataagctaagcataaaaataaaataaaaaattattaatctgttggagattcgtttttatgttttctatgtctacgtaaatgcgatgtcctctcaaaggagccacagacaaaggacccgcggacaaagggcccacaaagacatagggcccacagaaaaggacccacaatataataattcgaaatttaaaaaaaatttcaaaataggctgtgagtgaaatgcctgtgactaagtttattcaaaataggctgctatattgacaaaaacatctaatctgaataaattgtcctcctaaccttttaaaagggtcaaacccagacatatttggtatcattcgagagctcttaatgagcttggtctaaaaatcagagtaataaaccgaaacgatgcaatctgagtgtgggacaactgagtcccagtgaacaatggacacttcagtaccaaagaaataatagatgaataaaataataattaattgcaaaattacgaaaaacggagcatgcgaagacggagcaagtagtggggcgagaaggagggcggaggaagcagtctgacgacgccacccaaggccggcctgtggctctttataggattatgcaattaaataatgtcgcggagaaaaaggtgctgcagaaatatagctttaagaattaaaataacattgttaaactgtgaaaatcaaaaaatgatgaattttgacgaagattttacaatttgtgggaaacatttcttgtaagccgtttctgatgccattttctaatgatttaaagctccttttttgtcagattacgcaataaggactgcttctttccgttgtcttcattggtggagtaattccaggatctgctaaggctccaccacacccaattttaaatctgctataattatgcaatgattatgttcagatatgtttcatcgcattacttatcacaaaacgaccntcctaatgtttatattgacttctgacct

SEQ ID NO: 26185 - DNA, 1059 bp, Heterodera glycines
atgtcaatggacgacagtaataaatcaattttattgttttgtttattgctggaaaatttgtccattttcagctacattttattatatatttaaaacattttcatgacaatttttattttattttcttttttatagctaatttattattttttctaatttaagctttatttaataaatattgctttgataagatatattatacattggctttggaccatatgatgaatgcttacaaaattttgtttttctgactataatccgaatatagcttttgcataaatatcggggcctagagagcaaatgtctaataataagctaatttaattttagtttttaaattttttcctaatttattttatccaccattaaagcagcaaatgtgtgcgtaaacaaacaccaatggatttgttttcccgtttttacgaatgaatcactcattcataaaaagcatttgtgctttgctttttttctttgtttgttatcgtcatcccattaaattccacgtaaaatttaagcatttttaattatttcaaagaaaattaagagtttaaatggtaaacatatctattcctcttcattatttgaacaatatttttatataatttcataataaatttagaatgaatttcaatcaattatttatatttactattttattaccattgctttttctcataaattctgctaattttattcacgcaagatcagcaaaaatacaatcaaaagcaggtgaaatatttatttataaacaatataataatttaattgaagatttttttctaatttaaatttagtaaaaaaaaaatttttttccttacattattagatttaataattttgaaaattaacacaattcaggcaaaattccgaagattttatgcgattcggttgatgagtgtccgtacggaatgcgctgtaaagccggcatgtgcatgaactagaaaaagaggcgtgtaaaaatcttttgaaataatagatttatgtgtgattatagtttttaaaatataataataaatagaatattcgtttatttctgtataattcttataaaattcgaaa

SEQ ID NO: 26186 - DNA, 1342 bp, Heterodera glycines
actgttgtaccacttctaatcactgttgaacctcttctaatcactcttctaatcactgttgtaccacttctaatcactgttgaacctcttctaatcactcttctaatcactgttgtaccacttctaatcactttagtacctcttctaatcactggaagcggcctaaaaacccctaacaattttttaaaaattccaaatctccaaaaccagagctaatctaggtagcgaagctcccaaagcgcgaagcgctttaagcacccaagaaacatgtaagcacacacccgctagtactatatatgttatattgacaaggagtttcgtttgcaaaaacaaaatctcccggccgaaggccgggagcgccctgaaagtagtggaagggtcttacaactttttgaggagaatccgggaaaactatagaaaaaaatttagcgcggacgactgagtcccagggacggatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttcaatgagctggatttttccagtttttaaaatttcgaaaattttcaaaatttttcgagctaggcctaaaaaacggttttcgggtttttgaattttaggaatttttaacgaattttcccagagaaacgaagaccacttccaaaacatagtttttcgagctctatcgattggtaatttttttggaaaattttcgattttttcccggaaatagaaaaaaattttggcctgagcgggacatttgagtcccgggcctataactcgtcaggggttgattttagcgaaaaattgacttaggacatttttgtagagcattttaaatgctatcgaatggtgtgccatatagccggaaattttcaaaatttttcgagctaggccccctagaaattttcggaaattttttttcggacgaaaatgggggtgaaaaatatttttctggggtaaaataaggtgttgagtacgaatatgatgtctattttaagtttcataatttttggaattttttaaaaattctttattttttggcaattttttggccctcgggattttggcctaatatttgaaaattcataacaaatcgaagggtggatcaattatggtgcaattatattataaaaatagagaaaaatcaggagaa

SEQ ID NO: 26187 - DNA, 2564 bp, Heterodera glycines
  misc_feature (2534)..(2534): n is a, c, g, or t
  misc_feature (2557)..(2558): n is a, c, g, or t
agaaaagcgttgattcatcgcattggtgaagaaaaagggccaaaaattggaaaaaaagtataaataaatggacatcagcagcagagaaagggtatcatcatcaatcaggtcaatgtgatcatttgggttaatccaaaatgggaaatggtcatcgctttaaggagaaacagtaataaaagtcatttggacaaaagaaacagcaaaagatggggtaagtgatcactgatcagagaaagagaatgtcgtgccatcgtttatagcccccacacattcacatcgtggccaagacttttattggtcgaagaagctgaacaagtcgggctgccgcttcggctcacctccgtagtacatgcggtcgtcacccgcggagggagtgcgcccggcggaaagaattgaggacgcactgatgccagcagaggggccaccagcgccaaagacaaagacacggagacgcgaacgacgacggaccaaaatgggcggtgccctcttgctgctgctgcttccgccggtgtttccgacggccatttgtccgcgacagccatcagttcggcagaagaattgccagctctgtcaccagcaacaacagcatcagtgggactgctgaggaacgcgaaatgacacctgctggcaaccagggatgttattttacatggaaaatcaaacaggcatttgctaacccaatacggcctcactttctcgtcgacgaattaggcgctgttatctgtccgggcatgccggatgatgatgaaccgccaaaatgaccatgaaagcgatgcgtttgatgtgccatcggctgcaacaaagctgtgcacgacgacaccatcgacgatgaagcgtcttccgcgaccgctgtgccaacgtttgagatgctgttcaaactccgatttgagctcgcgcagtcgcaaaaaatgctaagaaatggaaggaggagtcatttttggcgaagtgtttactgaatttaatggacctcattaagctgttcgcatttttgaatggccgagtatactttctcttcaatgtgctctttcagcaaaatttgttcaccgttcaggcactcgttttgcaaggcgtagaaaaagctcagtttggccaacagattctgcaaaaatggactgttttcagacgatattatttcctaaaccatacattccacacggatattcaattttaaattatgaattattgtgtataaatgtttcctgttttttgccccctaattgattcacctcgcgcatcgtctcaaactgcttggcaatgtcgttttgcatgcctcgcgattcgtcgaccatccgttgagcatgattcagaatctcttcaatgcgcagtgcggccaactcgcggtcgcgctcactggccaaacagtccaatgtcaccacagtgtgctaaaaaaattggaaaattttggaaaaaatggaattttaaaaatgaaattgtcaaacaaacaatggttgacctgtttatgcgaacgaacaacacagagggcacagatgaactgctgaattattgttagtttttaccatttaaaacaccaatttttactgtttttaaatttaaataattcaatttccgtggtgttaattctatgagtaaaaatgcaaccaatcattcattttcgaaagtggtggtaagaatttgaggtcgaaataattggaactatttggcttccttcttgtgatcctccgcccacctttttggttggcttattgcagtctttgcaaatgaacagttcgctgtccggcactttcttggcacaggcgtggcaatgtctttgctgctctttcttcaccatttttgcggctcccaatcgcaagaatgaaggcgcgccatcgtccacaaattggacagtctcacggaatttgtcgaccatatctgaaaaggaccaattctaaacatggacagagttggaaggaggagggggaagccgaggaaaactgacaatgagtttgaaaactttaagcaattccctacaaaattcctaacggcatcgatggacctccatttttactatatttttaaaaaaggaaccccaaaattctaaaatttttttggcgaaaatgactacaaattccagcaaaaaacatttcctaattcgggactaaaaaagaaaaatacaccactacaaaacgaatcaagcccccccccccatccctgaagtcaagggtctggctacgccttgtgcaacacgaagttaaatttatatttttttcaagaaatatcttgaataaatttctacggagagagcgcgcagatatacaaagtatagtggaatgttagaaattgtcggcaacctttgatggcgtagttcgtgctcagtccgctgtccggcaccaggcacattttgcggcactgcgggcattgaacattgttttggacggactgcacaagtgtggagaggggaccgacgccaagagtgtcgaaagacaaacaaatgtataatttgaaaaaaacaatagttagaaaagcaacagaaataatcgtcgccgacaatacggtggacaatgttctgaaaagttttcccagtcccattcacacanattcagacccagtaggtggaccnntgcagg

SEQ ID NO: 26188 - DNA, 1907 bp, Heterodera glycines
  misc_feature (57)..(57): n is a, c, g, or t
  misc_feature (158)..(158): n is a, c, g, or t
  misc_feature (1870)..(1870): n is a, c, g, or t
cagtgccaaattatgagcacacaaacatttttttttgaggggtgggtggctgttatntaatagacaaaaagatttccaaaagagaaaaaaaactttttagaatatttaaaaaatgaaaattttggattttctttttaattatggaaactatatatttntaaagtaaattaataaatttgtaaaatttttatattgccatccaaaattttttgaaatataaagaaaagaaaagaaatgttgattaaaagtatttttattattttaacttagtaattaaaaattttatctctcttgtacctgacctggtactgaaaaacacgtacaactgagtccctaagtcccggtttgaccagttttgaccgggaccgggaaaagtccttggttttttcccggttttcccagccaaaaagtcccggtcccggttttgcccaaaattcccggtcccgtacaactctactctctacaaattggcttttatttttcgttattggcgaagaatttaaattaaaaatcattgattttaaaaataaacgaaatattttttaaaacattcataagttcaacagggaaaaaagccattctgaattgtagaagatttaatttcaaaaacttttgcggcgacatagcgcgggagattaaaggaacaaagtatgaaattgttaaaaacaaaccaaaaaaatcaatggacttgtaaaattattcgaataaataattttttggcattgccactttctccaaaagtacattaaatgaacagggtcgagagggcttgaaaagagtccattagcagataagaaaaaacacttaaaaatcggcatcaataaaaaaatgtgaaatattaaacaaaaataacattttagcgtaaaatttaacaacttagtatatattgtaattaatctttaaggtatgaaaaaattaggataacaaaatcgtgaaatatggcaataaatacggatcaaaaatagcgaaatattatggacataaatttttacaaatttgggagataaatatttttttctaaaaacgctttaaattaacatttatgcctgggggaaaaacttaaatatttaaatattcatttggattaataaaaacaaaactagtaagtttcgtcaaaagtgccgcggctcagcctattttttgaaaacaattctcatttgtcactgtcgtgcgtcgacaaaagtaatgaacgtatggagacgaaaatggataaatgaatgggaatgacattttcggcaacgccacgcaaaaaaaaaggttttcgaaaattaatttagctccggaactgctgtctgcagttgattgagacaaatagttaaaaaataaataaaaaaagtaaaattgaacgttatggctattataaagttcttttttttaaattttttaaaattgtacaaataataaaattaacaaaaataattaacttcggtaaataaaatgacaattttaattaggggtcattaaaaagaaaaaaaattatgttttctattgttagagagttctttttttaatttttcaaaattatacaaataataaaattttaaaaaataattaaatttataaaataaatattacaaatcaattaaggtcattaataaaaacgaagaaagattgtatttttgtgaagttgtcttgaaacaattgcactcgccgctaattggcccccatatttgttgggctaacaatttcaaacaattaatggaccccgtgacaataggtgaatgaatggatcgggcggctggccggctttatcacattcaattaaaaaagctgggcttccccatttaaatgtgcacaggatttgtccccatttcttccagccgactggcgccgcagcaggagcagcaacaagcaattcccattttattgnggccaattttcaaaaaacaaattaattgccacccatc

SEQ ID NO: 26189 - DNA, 1990 bp, Heterodera glycines
acaaaacctatgtccaattttataacagaaaatttttttttatttggctcaaatattgccttttcaaggccattcgctgtgcattttggcaagcctacaacagcatcgtgcaagtgatcgcttattgcgctgggcttgacgagcagttgaagcgctgctactgtggtccgctgttgtcgctgatcctccactttgacgtcgcaatggtcgcccgtcgtgccgaaactgtcgcaatcgtacggcgactgctcttccaattggccaagcaggcgaaccggcgacgcgtgcagcagcgcagacgactgaagcaacagcagcagccagaagatgatgacgaccaacaacagcaggatgatggcgttgctggaggcggagatgatgaacgtgttgaggaggaagaggagggggacaacgacggcggtgatcagcaggaggaggacaatgatgacgattttattgatgatgacgctgttgtttgttttcaatccgactaaaataaggtggtactccttcagttttcgtgtccccgtttttcggagcagtcaaaacctggttttaatttattttttctgttagaatttgggtctgtcctgtcacactgtttttatcgtgttacattgggattttttactccaccttctctagcctattttgaattagtcacttttccccacccgacagaaaatagtttgtgtgccagaagactgactcattttatttgtaaccgaagccaaaagatgacggggaaggggacatgctgaaagagtaccaaaaaatgtcagtactttgctgattcggaggactaatgacccctcagccaatcaatcaatcaaccaaaaccagcctcgatcaatcaaaaaactcctatttgcccgcccgcgcccattggtctctcgctctctttcagctcaccataaaaaacacatgtactcaagcaggattaaatcattatcatcaattcatcattattttattattatgtattacgttgttggttgtcacatacacatcattcaccgcccacaccattttcccattttctcgagatttgtatattgtgtgctttccgcgatgttcatttcattcattttttgtttttttctcgatcaatttccgtatttcgttgtgtatgatgtgttttgtgtggtgtgtcacactccgccacactctctcgctcttctctttttttgttcttctgttgtaacgtgcttaacaatattataccatataggacacacgagtttcatccatcacatcatcatcaatcccattcatttcttgttgctctgctggtgtgtgtgagattaaaaggcattaaatgaggaaggaagttgattgaatttagtgtaaatggggatgtactgggcaacagagtcattcgtttctattttttaaatggccaaagaatcgaattctatcacaatctaatttgttgtcttaatttcgtgtatacaatcatttgaatttgaaatggagttgtttcgttagcaggaaaggaaaagcattttcgaatttggcattcgtttttattatggccaaatgtttattgaaatggatttggagttagtggcttctgctgcttaaattaccggaatagaatttatataaatgctaaaataatcagtgtttttactcgctaactttggcgtaattacgttatcaaaatgtcaattttttgcaccaaaaaaaagtagttaaaggaaataccatttttagataaatttccgtaaaattgaatacatttccgatgatggaaccgaccatcgctgaactgtctatgccttacgactcatcagcagcaacgacgtcgcacatgacaaatgcatcgcagagtgagattcgggtggaggtcggtgaacaattggcaaatttagaattttgtatcttttttgtgtccaattttggtaaaaggaggaattgaggatcccttaatttacaataattgttgaaaggttcggatgagtttcttataagtgcatttatcactaat

SEQ ID NO: 26190 - DNA, 1331 bp, Heterodera glycines
taaaaaataaaaaaagaaaatttaattttctttatcccaaagaaatttccatttgtgaagaaattgttggaccgcgcgcgcacatctccgcttactaattttaaattaattacatcgttcatcatccatctcctcatcatttattcgccgttctcacaattttcgtttatgccaattcgaaagtcggcacaccacaatttgaataagtggccacaaaaattccaatcacacaaaaagaaatgggtttttttttggtaaaacaaaagttgccattattttcgggtaaaaaattaaatacatttttttaaattatcaggtaaggtgctggctgaatcgttacaaaaactagcaatttgaaaattttaacaaaaactgttttcggacgtttttggccataactttttttaaaaatacaacgattttttttggcatattccaggctacttagagaacactttgggctaccaaaagatataaagaattgaaaatttggttgcatgagcaaagttaaaacaccatttttgatgtcatgacataatatgtaaaacaaatatgtagatatatttttttctttttaaataaatttttggtgaattttttagagtaaaaataatttctcttttttgtttttaactttaccccaaaattaaatttaattaaatttctttgtttttcgaatgaaaaagagctctaaaagggtgggtggtcgacattttttttaatatatataaaatttgaatggtttaatatttttttattttaaatttattaaatattttaaatataaaacaattttaatattttaaaatgttgagtaattcatttttttttttgaattttatagttcaatggacaagttcaatgagcgaccctccacattgatgcgcttgtcgcgctcctttttccgcttccctgcctatttgcgcgaacgcgtcaaggacaccgcggcgagcagtcgaagttgtcccggctcacagtatgccattcaacactttgtttaatttaataataaattatttaaataatatatttttattttgaaatttttgaaaattcaagaccaagacctggaatgaattgggaaaagttttaggatgaacattgaggttttcgaactttttccaatgcattcttccccaaaaaaccgaccaaaaatcagtgccacgggaaaattatgggaaaatttaatttttgagttaaaaattgataacgaaatttctttaattcatttttggcttgcttttgttattaattaatattaaatgttatttagttactacaaaaatttgcggacattgaaaataaaattctgagtgtttttttttttttgc

SEQ ID NO: 26191 - DNA, 1395 bp, Heterodera glycines
  misc_feature (29)..(29): n is a, c, g, or t
atatagagagtgagtgagaaaatgaagancaaaaaaaatgcatgcgaagaatatagaaggggaatacatttgaggaaacataaaaagaaccaagcagagggagctaaacgaagctgagattggtgaaaaagtgcttgagtttgtgattctgacttgtagattaatcgggataaataattttgagttacggactatcccacgatcggatattttgggggaaaattcttctagttgtgttggtgttttatccatttcttcaccacctaataggtcattagtggtactacaactaaaaaaaatgaattttccctcagctgtcagtttggtgatctatcaaaatacaactcacagcaaaatttaaattttccccgcaaatgtcactttgaattcccgaaccccctcccaaaatttgaatttcccctcatctgtcactttatgacaaatcataattttccccatctgtcactggtgaccaatcaaaaatttccaatcaaaaaatttcccccctcccctcgtctgtcactttttaaatcaagcaaattttctgtcaaaaaagtacaagacaatttgaaaccgttcaataggttttggtttggttccccccccccccaattaactaattaattgtcacccctctcactgctgaccataccaattagcgcaccccggtcagtcaattagtgactaattggcaccccctttccaccacctgtcacttctaattagtgtcagctggcgaaggtggcgaaggtcacgggctgttaactactgaaattgtagaaaacttactagtttttaaaaaaaaaattaaaaaatttccgacttttcatcaaaaatttcggaagtcggaattccgaccccaaaaatgttggaaatcggaagtctttccgtgccatacctggtgcctatcgacatctgcgagaaattttatgaaatttaatgcgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagttaactttaattaaatttattgtttattcataaaaaataaaaaagtcatcagaagggcgagaaccacttactctgacgactatcagataaatgtcgtagagtaagtgacaaaatatatggatgatcacaggaataaaaaaaaaaatatatgtgaaaataaataataaataaattgaggtcaaagtcaaatgaggtcgaaataccaaatcacttagaaatttgttacattctaactttcccggtcttacagattaccctagtgaacttttaagttttattttaaattgatttaaagaa

SEQ ID NO: 26192 - DNA, 1689 bp, Heterodera glycines
ttttccaaaaaaaaccagtcgatagagctcgaaaaactacgttttggaagtggtctccgtttttccgggaaaattcgttaaaaattcctaaaattcaaaaacccgaaaaccgttttctaggcctagctcgaaaaattttgaaaattttcgaaattttaaaatctaggaaaaatcgggcttttaaagctctacaataagtccgccggccaccccgcgctcaggtcaaagcctaatgagttattcaacggggactgaactgggcaaagttggtactgaaaagttgccaatttctgcagcccttccaagtataggtagaggcctggaattttttttgaaaattagaaaacacttcaacttagtttcctaccagcaagcattttttgatcagagttttagaaaaaaagttatgggccatcaaacgcaagcaaaagtgagaaatcagccgccgggactcagttggccaccggagcggaaaacccttatttttcccagatgcgcctcaaaaagttgtaagacccatccactactttcagggcgctcccggccttcggccgggagattttgttttttaagacgaactgcaacgtttctctatagtagtataaactagcgtggggcgcagtagttgctcggtgtagacagtatgctttgcatagtaattgctcggtgtagacagtatacttttggtatatatgggcgggcgctgacatgagcgcttcgcgcaaaggacttcgttgctagtgcatgcgcggcttcctacgcgccttttttatatttaaggtttaattcggccgcttcttcggcctcaggacgcacactccacatttttcaaatttgccgggatttccaatgaacgccaaaactttgcgtaatttttaaaaattgtctcaaaaattttcacaccgaacctagcctcggctatcctgatcagctcgtccaccacttcttccggactccgtcgttcagtttgttcagcttgttgttgttgttgttgctttgattggatgatgccgttgctgttgttattgttgtcattttcagtctgctgttgttgttgttgttgttgttgttgttgttggtccgcaaccacaaacaaattgtctgttgccgatgctgtcgatggcatcatgttggtgctgtgcagcagcaaattgtcaacatgtgccgaagatgacgatgatgacgcactgccgtggttggaaaaggcattggcggcggatgacagtggttgtggtggcggcatcatttgttgctggttgttctcgtcgtcattaatgcttgcgagaattgagtcgtccattcttaaaaaaagaatgattttgggtggccgaatttggttcaggacaataattgaatgtctatgctttgatagctgctaaatggaaactgtttgtaattttgatgagacacaatttggaaaaatgaacctatgaaaaaaaaacaattactggcgcttaaatagttgctaattactagtagagaatccgttatcatcacgtttatagatcagccaaatcagacatagttttgacagggaaaacaaattgcatttttaatgtttttgtttggaaggtcgagaatgatacctctcccgagaatgcatcggaggggccagcggggaggggtggggggggggagaacaaattgaatgggggggagaagcaaaaaagagaaagagtggcgggagag

SEQ ID NO: 26193 - DNA, 1024 bp, Heterodera glycines
acccaactcatccatacccaactcatccatacccagctcatccatactcagctcatccatacccactccatccataacgctacgagtcatcgtcgtggcatggcattttctgcttatgtggtcatggcatggcattctctgcttatgtggtcttgaccgtggccatttttgattatgcgatctcggtcgtggcattttttggttgtacggtattagtcgtagcattttttgattgtccggtcttagtcgtagcattttttggttgtacggtcttagtcgtagtattttttgattgtacggtcttagtcgtagcattttttgattgtgcggtcttagtcgtagcattttttggttgtacggtcttagtcgtagtattttttggttgtacggtcttagtcgtagtattttttgattgtacggtcttagtcgtagtattttttggttgtgcggtcttagtcgtggcattatatgccacggcggtgtatggatggatcgtgtctatggatgagttgggtatggatgagttgggtatggatgagttgggtttggatgagttgggtttggatgagttgggtatggatgagttgggtatggatgagttgggtatggatgagttgggtatggatgagttgggtatggatgagttgggtttggatgagttgggtatggatgagttgggtttggatgagttgggtttggatgagttgggtatggatgagttgggtatggatgagttgggtatggatgagttgggtatggatgagttgggtatggatgagttgggtatggatgagttgggtatggatgagttgggtatggatgagttgggtatggatgagttgggtatggatgagttgggtttggatgagttgggtttggatgagttgggtatggatgagttgggtatggatgagttgggtatggatgagttgggtatggatgagttgggtcatggatgagttgggtatggatgagccccttaaagggatgagttgggtatggatgagttgggtatatggatgag

SEQ ID NO: 26194 - DNA, 1133 bp, Heterodera glycines
aagaagaagcaaaaaagaaattgaaaaataataggtacaacgccaaaaagaaattgggtgaaattgggaattaaaaaatgaaatttcttcgattaggattttgaattttttttctaggcgacttatcaagtcccaatttttaaaaaaaaatttttttctgaaaatattatagttttcaagtccttctggtttgtaattaaatcacaaaacacatttgtttttctcttattgttcgcccattagcgaaagtaatgccattttcctctgttcgtttctgcacttttgccataattggactttttgcatttccgcttttgcccgacattttgcacccactctcaactaatgacattcacacgccttcctttttacttctccccaaacacctcttcccatgctttgtcttctaattttataatgaatttttgcgggcggcttttggcattactttttgtatgatggaaaaattggcatatttacttgtcaaagcctatgccaaaatctaatagtggggcaattaacgcttttccaataaaaaattcccatgatttatcgaaaattagtagccaccaaaatgcgaaactttactactcgagcagcaacttgggacacatccaaggctttccaaaatgcgagagtttaaactagagtcgaaatgcgagattaagaccgaattcctcccccaacaaattcggtattaactcgagtcaaatcccgagattgagactaacccccccccacacctccgaactgctggaatttatccgagtcaaaactcgagactcaaaacattgagcagaaataccccaaaaatgctaaatattgaaagcgagattcgagtccagaaaatttgaaaagttttttggaaaagagtttcgggattcaaaaagctgcacacaaatgcttcgcaattgttccctttaatgagcatgttacgtttaatttcactattattgctcaaaaaatcgggtcgcatttgaaaatttaaaaataattttttgattgtggagtaatgcgatgccggattttcttgcaccgcttttgacaccttaaataatggcttattcaaccgagtgccatccttcacctacacatgttttgccgatggcaaatacagacgacacgacaccttt

SEQ ID NO: 26195 - DNA, 1371 bp, Heterodera glycines
taaaaaatccttgacaaaatcacaaatttcactataatttcaaccaaatgctggacaatctggttgccgaaacggcaaaaatactaatttattcaaaaaaagaaaaaaattcgctttttaaaggatgccctctcgctgctgcatcagatcagcaaaatttccactccgaccatcatttttgagcgcattgtgccctatttggtgaggaggaattttcagcaaaattaatggaattacatatggactcgagaaaaatgaaaatttcatagaaaataattgccacaattcggctcattttgcaacatttcaaacactaaggcttctttttacccacaattctgtagctttttttgaccgtcaataaaaaattatgtactttttgttatgttaagattttgttgcagtgccagaaaaggagagcccggtatttagaagccctttaaaaaaactcattttaatgtgaaattatatttcatgaaatttgtttcaatgcattactggttaagcagaaaatattttatgtattttaggcccatgccatcggtgaccatttcgcgcttgtccgtgccgaggccattctgctgctgtgcgacattctgtccgcctgtgccgacgccattccgccggacgagtgccgtctgctgatcgactttgtgttccccaaactgtgccccattctgatcggttccgcgtgtctgccgcgcattgcgttggccaccaatttgggccgtcttgcgcaaatttcagcgaggcatttcaccacaattttaaattttatttaaaaaaacattgcgttatttttgtcgcctatagacatttgcgccaatgccaaaatcagatttaaagcttatttaaacgatttaagttatccgggattgaaaaaatttaaggtttgaacctgattttggacattggcgcaaatgtccggggctcaaatgtcatgtaagcatatcttttatccagatttttcgaggccagcgtcgcccgaatgcgcagcgaatcgccgcccgtcccagcggcgcaaacggcggaccgaaacggcggcagcggcggtcgaagtccgtcggcggcaaccgttcagcaacaaatgtccagccgattggagaaatttttgtccgaggagaagcgactgttgttggagacggaaaggtgcaagcatttaaaaaaaccattttttgaaattttcaaaaaatataattaaacacagaaaagggaggtgaaaaggggagagaatgaccaacaaaaaataatctctaaagtgtacttactgcacttcaatcccccatttgtccctcgtggaaaaatgataagtttgaaaattcgcatttttaaaaaaaaaaattatagaaaatttttcttaagaaaattcaa

SEQ ID NO: 26196 - DNA, 1328 bp, Heterodera glycines
  misc_feature (67)..(67): n is a, c, g, or t
  misc_feature (1258)..(1258): n is a, c, g, or t
tcagtcgccgttttatttcgccaaaaaactgttcttaatagtaagatcaaaaatcgaaaattaatgnaatcagttcaagatttttatttttttaaattatttaatttgaatgaaaactttggttgttaaagtaataaaaaaagtaatatgaaaaaggcttcaaattgcattaattatataaaaaatgataaataatcgataaatatttgattttcttttaatttaatttttttttctttattttagagaaaaacctgaacttggcgacaacatatttattaattctcggctgattactctgcattttgatgtgtataaagctgagaaacgaactattgataaagcaatggccaaagaaaactgaaaaaaaactatcaattttttaatttacaatttttgaaaatttaataagcattctttaaaaaataattttgtaagattaaatttataaaaaattatatttatttttacatattaaaaaacaatttttatatatatgaaaaaataagaaaatatttattgtgtttttaccagtggaatgataagcaaagataattcagaaaaaagtatttgtttgttagcattgctttcagctgcgtcaaagcaaagccaaagcaaagttttaaagcacaaaattgagagaaagttcaagcagatcagtggaaatattttggtcagcaaaagaacggtcttcaaattttcgccaatttgaaaacgttggctaagcgaactaaaaaaaattgaaatattttttaaaaatttatattaaactcggtaaaattaataaaactttaatttttaaaatattaaatttaataaacctgtaataaaattcgatatattcttccttctttttgcgatttaactaaataacaaaaaagcttattatataattttaattttttttatggtctaccgtcaatataacatggagaacaccacaaaaaacactaaaaaattattataaaatgagaaaattaattaataaaatgttacatataacaaagaaatgcaaaaaatatgtgccaatgtgtcttcaacggatttacgcgatccaattgaatttggcattgaaaatatgatccatttggcattatgccaacaaacattccgccatcaacaaattgatatgctgaacaaaatgccaataaaatccacttaattcaaaaagagttatagtgaaaaacgcaaaaaagatctcaccattccaatgggaaaagcgtgtcaaaaatggttcaaatgattcattttcatactntacatatcgtaatgtggcgtacagtcgttcgacacaaatcagaaaccctgacccacaacaaatgcacaaa

SEQ ID NO: 26197 - DNA, 1194 bp, Heterodera glycines
tttttgaccaaaattcgttaacaaatcgcattaaaaattaaaacattttcccggtggcgcctatcggcaccgccggaccccctgtttccaaaaagtcttttggaataaccgccgcaaaaaaagtggaatgaaagcaacaaaaaaaaaatcgtcacccgtggggaggtaggaggtacccccctcccacccaagccgaaatcttgggaccgtccctggcctttatttgaacaaaatttattgttgtatacttttacaattgcaggcgcagaatgcggcggcccgtcaaagcgaacaacaacaacagccgaatggcggtaagttttgcattttcgtgtggtatgagtttggtttcaatttggggcccattctcaaataatgactttcatttgctatgagggtgtaggcaatgtggggaacggcggatatgcaatgaatatttatgctccaatgttcgccgcttgcccaatcgattccctcgctctcccccccccccccccccacttgtctctgtatgggtaagaggcaaacgctgcggcatttgtaaataccgtcactatcgattttttacacttaaatttaagacattccttttcaaaaaaagagggaaaaaacggattaggtaggtagatatatgggccactaaatttaattttaaaaaccattaaactgtatactaattttaattttttcgttgttcagcaggctctgttccggctccgcaacaacaacagaatcaggaaaatggcatggagagggccaacgttgaccaggcgctgaacgacgaggctttgggggcacaaaatggtgagtgattttccttttatgactagaaagagcaataaaatgaaatttttttttgcggaataaaaactttttcccccatagtgactggccaccccttcccatgaaaatttttcttggattctggattatctgctcatgctttattgggcgcaaaacattcccctcgcctcccattgaataaacttttataatcataaaattagaaaaagtggtggaaacatttttaaaaatgttttcttgaaatttaaaaaacaaaagattttccttgaaaattcgttaagatttcaaaaaaaaaatttcccagcaggaccaaccggcaccgccggacctctcattttaccttatttttaaattttaacaaaaaatgccaaaaatataccctttttgggg

SEQ ID NO: 26198 - DNA, 1290 bp, Heterodera glycines
ccaaatttgaatggatgcgcgagtaggtcaacagtgagcttcactgccgaaaaccttgagaaatttttgagttgcaattacaaaaacatcagataaaatactatgaggaataaaaaattttaattattttgcacccctaattttcaagtttttttttgtgcatatttggtgcatatcttgtgatttttgtgtatatttggcaattttatttgcatatttatgtgcatattttggttatttttcgtgcatattttttgcagccctgctaataatagaaatattagatagtacgccaaaaggagacacaaaattagagaaaaaaaagatattgtttttctctggcactctctatttattgatacacagcgtactcgtgaatgcagttgtctgagtcgatttctttggggatttgcagttggtcaaggtcggacagttgtcatcgattttttgaccattttcccttgaaattcggtaaaataatgattttttataatcatcaaaaattcaatgaagtataactttttatgtacaagtcatatcctaggaatttttttcaaaaattactccagttttcagtgtattttatggtgttcagacagatcaccatgaaggagtgatctgatcaagtaggtgtgaagtactttgttgttcagcctcaaaagttaagcaagcatgaattatttcagatttttaaaccaattttaagatgaatattactatggttataaattatatggaaattttttcaaaaattaaagggggggacaaaacacagtattacctaaaattttttgatttggtgaaggtttttagtccatataaatccatattttggtggttttcgggaataaatccatatttcgccattttggcctttttatcccatatttcggccatttttggcaaaatttcacaagaaaaatgacaaaaaaaaacgaaaaatacacccctaacgattgactttttggaaatttttaaaaattactcccccaaaaatacgaaaattttgagttttcgccggtcattttggcatttttaataaatattttcgcagttttttgcgaattttttttttttttaaatgaaaattcttttcgaaattttggcaaatttggaagtattttttatacaatgggagacgataaaaatttgcatttttaagtttttaaatccattttttggttgtttattgtatttcagtttatttaaacaaatattgaatatatacaccttttttggaatttttgagggttaaagcatatatttttggcagtttttagtccctatttt

SEQ ID NO: 26199 - DNA, 1657 bp, Heterodera glycines
agaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgcccacactatgggtcaaacccagtgttagacaaaattgctcataacgccaaataacgtaattggcgtaaatttttgcgcgctaattcaaaagttacactggtaaatgccttttttgtatttttaatttaattttatcgagcaaaccaaaggcacatagtgctcttatatggtgccaaaaacaaacaaataaaaatgatcaaataaaaaatacaaaatgaataccgtaataaaaatgaataaaaataaatcaaatgttaaaaattcacaggtgattaaaatatagtgtatatgtggcacagaaaatttcctactcagaactcattgcttttagtaaacccctgaattcctttgccttattaatttgcaccgctaccactggaaggttattccagtttcttactatcctatgaaaaaaattattttgtgttttggccgtgtggcgctttactcgcaaaagtaaaggcctcctgggcctttctgagaaaaagatcagcctctaggctggtgaaccctttaataattttaaaagctgttgtcaaatcattaatttttcttctttcttctaatttatgtaaacccgcgatttttagtctttccccatattttttgtacacaaaaccacattttctaagtgcttttcttgtaaaaaatttttgtacccgctcaattttgtctatatctttttttaaattagggttccaaacttcggtagcgtattctaattgaggtcgtacaaaagttttataagctgctgttagagtctttatttccctgcttttcaacactctcaaaatctgaaagcttctaagatatgcgtttcgtataattttgcttatgtgttctgaaaaattaagtttcgagtcaattataatgcccaagtcacgaacattatccgactcagaaatcttttttgagttaataaaatattcttttttcatattatttttccctaaatataaaacaaaacatttttcagttgaaatttctaacccatttatttttgaccatttttccaaagcctcaattgctttatccaactaatttgaatggtcatcgttttcatgtgtataatataatttaacatcatcggcatacatttttatgccaactgatgatgcttcatttgcaataaaggacggcagatcatttataaaaattaaaaagagtaatggccctaagacacttccctggggcactcctgaaaatattctgaaactttctgacaattcctcgccaattttaaccttaaaactccgattttttaaaaagttagttaaaaaattatgaatttttccttcaattccaatctttttgattttttgaagtaataaatcaattggaacagaatcaaacgccttgacaaaatcaatatagattatgtcaatttgttgattcttttgtatagaattatatatatcgtccatcattttaatattttgggttgtagtcgacctattttttaa

SEQ ID NO: 26200 - DNA, 1416 bp, Heterodera glycines
ccacgaccaatggcggcggcaaaatcattgaaagggtcgggaaagaagtatcgcttttacgacaaattgacccaactgtactaaaaattcagttcaaagccttctacggaatgtcttcggccactgcgatgctcaaacaccacggcactgtggcggagtaccgagccagcgaaggcaaaacggtcgaaatcccttaccggtggactgttttaatttcaaatgaacactaatgttaaataacaatttgaagaggtgatgttcgagagacggtgaagtcccttttgggcggagttcgctccgcgtgcacttacatcggcgctcaaaaactgaaggaaatgcctaaaagggccactttcattcgtgtccaaatgcaggccaacgaagtgtacagcgccttcgacgcataaataagcccagaaacttagggactgatcactttttgttatttattttccgttaagatgctaagatcttccgtttaattcattcactttggatttatttttgcattatttgttcctttttgtggcaattgaaactgcttctgatgtcctgacaataattatcgatgtcattgagccaattgcataaagattaaacttaatttcaaaattttaatcaaaaagtgaatgcatcttttgttattttggaaaatatcactgaaagaaaagtcaaaaggaccatggaaaggtggtcatgtctagtgatgctcgagagtctcgactcgagaaaagtctcgggtttttttggtctcgggttttcaagtctcgattttcgagactcgagaccgagacttttttacacccctaatgattgttggcctttggtaaacttctatttttataaattttaggttcttttttgttcaagttttttaatatatgcgtggtccagcgggttgtgttcttagttttgttacttatttttgcgttggatcagttcgcctccaagtattattttttcttctcatttttcaaaattaatgttttttcgatgggagttcaaacacaattttaacaattaaaatcgtaaaaatgtcatttttggactaaatctattaacaaagtgcactaaaaatttcaaaattttctccggcggcgcctatcggcaccgccggacccctgttcccgaaacatttttttgaaaaagagcaccacaaaaaatggtgtaaaaaagtcaatcatatgaaaaggaaaaatgtatggtagcttaaataaggaaaaaaacaaaaatttttgagaaaactcaaaagattgatttttttcgatttttaagtgtgtaagaaaaaatttttgaaaaaagtctcgggtttttttggtctcggtctcggggttttgggtctcggtctcgagtctcggggtcgagtctcggtctcggtctcgagtctcgggaaatttttggtctcgagcatcacta

SEQ ID NO: 26201 - DNA, 1106 bp, Heterodera glycines
gcattagtagcgcaataaaagttttttgttttgatttttcacaatttatttaaaaaagccaaaaaatcccggatccaattttaaaaacgaaaatagtgcacaaaaagtagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatagttagacgaaaagaggaatttttaggatgggacgcaccccatctgatattcacccttttctgctccataagaggtcagaggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaaggagccgcctcacggcggggcttaaaagcattgtacatcataattaaaagcgaaaataattttcgtatattttttcacaatttatttcaaaagacaacaaaaaattgataaaatgttgaaacgaaatagtgcacaaaaagggagggatggttagacgaaaagaggaatttttaggatgggacgcaccccatctgatattcacctttttctgctccataagaggtcagaggcgactgtgctcattgacacgtagttgtccaattaaggtacttggactttccacagtaaaatgtggtgcaaattttggaactgtcccgcctcacggcggggcttaaaagcatttgtagcgcaataaaagttttttgttttgaatttttcacaatttatttaaaaaagccaaaaaatccggatccaattttaaaaacgaaaatagtgcacaaaaagaagccgcctcacggcggggcttataagcattgtacatcataattataagcgagaataattttcgtatattttttcacaatttatatcaaaagacaacaaaaaattgatataat

SEQ ID NO: 26202 - DNA, 1661 bp, Heterodera glycines
ggggatggtagccatccccatagcaaacggtatgggcttggtgtccatcataggattcatcacttatacgcaggaattctgaggctttcccgaagagctaaacgaaatctgatttcagattcgtgatcagcgtcctaaataacctctaaagacatatttctaggaagtttttcggcgaaaaaatttccccactcgaaaaccatgtgcaccccctatggtcccgaattccaaaatcacttttatttttataactttttactaaaaaatgataaaaacatgaaataaaatttatattatagagcaaaaaattgcggatttttgggctatttttattttacaaaatatcttttcagaaccgagtagtgaatttttttctgaaaattcgaaaatttccagaatatctggaataactttttttaattcaaaatagaaataccaaataaagcgcaaaaatttctccgatttttactccattttttaagcctctatacattaaaatagacctgatctaaactgagttatgaattttcaaactttaacccaaaatcccgagggcaaaaaaagtgaccgattttcaaaaaaatttaaaaaattccaaaatttcccaaacaaaaaacaaacatcatattcgtgctcagcaccttattttaccccagaaaaatatttttcaccccacttctcgccctaaacaaattttttgaaaatttctagggggcctagctcgaaaatttttgaaaattttccgacacatggcacaccattcgatagagcttaaaaagctctacaattttgctctaaggcaattttttgctaaaaccgacccctgacgagttatgggcccgggactcaaatgtcccgcttaggccaaaaaaattttctatttccggaaaaaaaccgaaatttttccaaaaatcccaccaatcgatagagctcgaaaaacggttgcttgaaagtggtctccgttttccccggaaaaatcggcaaaaaatcataaaattcaaaaaccccaaaacctcttagggggcctagctcgagaaattttgaaaattttcgaattttttaaatttggaaaaatcgagctcattgagctctataataagttcgctggccaccccccgctcagatcaaaccctggcgagttattcgcctggtactgaactggacaatgttggtactgaatttctccgcgcacctacaggcttttctattataagtagaggcctggaattttttttgacttttagacaacacttcaacttaggttcctaccagcggaaactttttgacttctgttttagaaaaaaagttacgggccctcaaatgcacgaaaaaatgagaaatcagccgctggtactcagctgggcgtcgagaatttttttctatagttttcccggatgcgccgtctcgagctaccccttggtgcaaaatttcagcccggtgtgcccagccgttcccgagaaattggttttagcgatgaaacccctaaccattctaacatatatataactagcgggtgcgtgaaccgtcggctatttagctgggaaaaagcgcttcgcgcttttggagcttcgctacctagactgtgaagcgattcaaattgatcgatttggttggagagatttttttgaatttttaaaaaattattagaggctttaagtcca

SEQ ID NO: 26203 - DNA, 1059 bp, Heterodera glycines
  misc_feature (32)..(32): n is a, c, g, or t
  misc_feature (37)..(37): n is a, c, g, or t
taattaatttaaaatgcgtaattaatctagtnccccncaagggatccctctttgtcgggctcattaaatacctaattaattttaaaatgcgtaattaatcttaatcccccaaagggatccctctttgtcgggctcattaaatacctaattaattttaaaatgcgtaattaatcttagtccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaattaattttaaaatgcgtaattaatcttaatccccccaagggacccctctttgtcgggctcattaaatacctaattaattttaaaatgcgtaattaatcttaatccccccaagggatccctctttgtcgggctcattaaatacctaattaattttaaaatgcgtaattaatcttaatccccccaagggatccctctttgtcgggctcattaaatacctaatttaatttaaaatgcgtaattaatcttagtccccc

SEQ ID NO: 26204 - DNA, 1417 bp, Heterodera glycines
ttattttaattattagaattaatttgagtttcctctttaaaccgttcaattttttaaatagtattttcgattcttggatttctctacactcaaaaaagcattatgtaaatgaagactttcaatgtataattattattcaataggtattatctattagcctgcaaaatttcatgggttttcaaaaatttgactacttttttttgaatcataaagaattttttttttttgaattgtgcttaatggggagtaattagaaaatctaccaaatgctattatagtttttgtgcgtgcgccagaacaccgtttaatcttgcttgtcaaatgttaagcaattaattttaattcattgtaaatcccctttctcttttccttcctcctggccatttttggtgaattaccattcgttcattagtacagctaattaataagtgcagcacaaaaacaatagtgggccaaaaatgccataattttaaaaatgccaagcaggtgcatgccaaaacataacattaaacaaacaacaacaaaattaacaacataacaccttttttggtttcacctgtggaccacgcattggcaaaaaaacatcccattcacagaatgcagaaaacaaaatcaaaaacaatcatttaaaaataaatcccttggccaaatttggcaccgaaaacacgaaacgacaaaggcacatcaacaaaggttgaaggggaagggagcatttcgttacaaatttattggcattttattattacagaggaaaaagaaatggagttgaaaagggggggggggatggcatggccaattcgggacaattattaattgttaattagaatgggtattatgtttacaaatttaacaataaaacgttagaggtttattgttaaaattgatgatcaaataagggagagggaagaagtggaatgatataattagatggatactcttcactacaattaaggactcattgtcagatatgttttttggcgatttgatgagtgattaacataataaaagtgctagtgtaaaatatattattaattttcaattaaaaatcatttaccataattatggaattgtgagaagaatcagacattttggaaaatttaagattaaaatgaaattttacaaacgatatataacgggcgggaattggttatgataattaaaaagaggaggatggataaccggaacttcaatagaaaaatttagttgaaatatttaattcaaacaaacttaaaaagggttaattcctccttaaagtgtaatgtgtggcgtgctgtttaacacaaaaattaattaattaatgatgcccaacaaatggatgaaattgacggattgccatttttaatgactcattataatgatcaagcttttctgccgtgcaatcaaaaatcgtcatcggttgtaatggggttcagtttga

SEQ ID NO: 26205 - DNA, 583 bp, Heterodera glycines
  misc_feature (54)..(57): n is a, c, g, or t
  misc_feature (59)..(61): n is a, c, g, or t
  misc_feature (275)..(275): n is a, c, g, or t
tttttttttttttttgggggggggggggggggggggggaaaaaaaaaaaaaaannnncnnncccccccccccccccccccccccccccccggggggggggggggggggggggagaaaaaaaaaccccccccccccccccccccccaccccccccgggggggggggggggggggggggggggtttttttttgttttttttttatttttttctttcccccccccccaccacaaaaaaaaaagaaaagaaagaagaagggagagggggaggggagggngggggggcgccaccccttttcttttttttttttttttttttttttttttttttttttttttttcctcccccccccccccccccgcgcccgcggggggggggggggggggggggggggggggagagaagaaaaaaaaaaaaaaaaaaaaaaaaaaaaagaaaaaaaaaaaaaaaaaaaccaccgaaagcaagaagcccgcacccgctttttctttttttttttttttttgtttttttttttttttttttttttttttatttttttatttttttttgtgggggggggggggggggggggggggggggggg

SEQ ID NO: 26206 - DNA, 1978 bp, Heterodera glycines
tttttaattttaagggaaaggggtccacacccccaagttaaaaaaaattcccttaggggaattatttaaagggcaatttttggcaatttttcatcctttttggcccagtccaaaggccagggccacccccaaaaaaatggatgagaacatcatcggcgaattaaacgatgatgggcccattgaagaaaaggcggaaaatctccagtgcacatgacatcttcaattgcccgccttcaccaacaatgcgcctcaaattcaaccggaaatcggcacactcatccaaacccaaataagcgcaatgccgaaaaattggctgcgatcggcttttcagcaagggccaatgaatgaagcaacaaataaaaaaggaaatggcggacaaaaaatggggaaaaacctttttcccaatcaacggcagaatcaggcgaaagttggaggaaagttggaaaaactggcgcatcacaatggcagcgaacccatgagctgacaaccgtcgcagcagatgccgtcgaggctttggccgaacatcttcgcgactacaatgttgccgtgtccattctcctggtcacaattgccgccggacttgccgagatgaacaatcactacaagggaaacttcaaagggaacagaaagtgaattctcggccgccggagtgtcgctaatttcatccttagcgacgaaaatttaaaattttatgattcatctgtttaaaataattttacgccaaattcataacctttgtgattttaagcctttttattagtcagcattgtttacatttaaatttctgtcagcccgcctatgtaaaattgccgtatttaaaccattgcaaaatcaacatttcttatcgttcaaatcgttcattaataaatatatttgttcgatcaaaattcactaataaagtgtgaaatataattgaagtattgggaaatccaataaaattaatttaatttaaataaaataaatatttaaattaattcttattgactatctgaaaagagagtcaataaaaataatcaaaatttaaaataaaaaatattttttcttcaaaacataaaattgctaacattttttcctcggcatccgccggaaatgcaattttgtttccagccaaatagtgaagaagccaaatgtttactttcatttaatgaaatatttaatatataaagacaatcattttgtatattgaaaattattataatttttttaattgaaaaataaattacgtttttttttaaatttgttgctttttgagctgtataatgttgttcttgcaaattgcctttttgcttttgcttgcttcaattcaattggcaattggatcaccaattctaaaaagaagaggtgagaatttactgaaaatttttaaatttaattttttgtctcctttttgattaaaatttttaaaaacttttattgttatattaaagaacggttgttcttcataagaatattttatattcatctggattctaatgaaaaattttcagaaaaaaaacttcaaaaaaaaatcaatttttatccattattaattattttaccattaaaatttgtgccatttgagacgaaaaggatgccgcgcaatcgtcgcatacaatattgtagtgtcaaacattgataatgattctcaaattttgtcgcaacaaagcttggatgcccaacattgggccttgaccaacggacttgtcaaattacaatgttactccattaaggacaaaccctggccataatcaaattaattatacaataaatagtattatctattttcatgacactgttgtttcaaaataccctatttacagtacatacacaaaataacgagggacgttggcgcagcgatgatgaagacgtaacacttacaaaccaccaaaaaatttacactaaattcttaaaaatctcacaattttccaactgcggcacttcatatataatatatagggatgtgaaaaatatgtacaacatgtgctcagaatatgtacat

SEQ ID NO: 26207 - DNA, 1682 bp, Heterodera glycines
atgcacagtgctttgctaatgaaaagatttggaagcatatggaaaatttgtgtaaaaattttcttacattttcttaaaggtaaactctaatttgatttattcactccaaaaaatggaattgtaattaaaattgtttaacgaccaatgatcactcattgatgggggggggagtctttttagaaagattttttgatcattttttttaattttaaaaaatttgtgttaaaagcatttaattttttgagtgttaaaagcaaaagcagtgaaaaaatttaaaaaaaaaagaaaattctgtttaagaaatgttattttacctcaagtaaatacttgccaaatttaaatatgttcaaaaatgcagtacgccgcaaacaaacaaaaacccctcacaattccctcccctccattaacgtataaatttcgttgacgttttctgcggaccaaaaaagaaaaatgccaacgtcatgacaaacatggaacagcagcagaacacaaagcaacagcaagcactttgcaaaatttctttgggtaatttcataatttttatgcaatttgaaacaaattaaaaataaagtgaattaatgaaattgaactcaatacgccttaattaaattaaaaaggggtttctaaaaatgtgttcatcaatattttctaaaataaggacataataggtccaaatctacaaaatcaggctttctaagtattctttcgccaattttcaaaagccgggttcagtggccaaattgctaaagggatttttaggctaaaaaaccattcttttattttatcaccgaaaccgagaaaataaagaaaaataaagacaacgtgttcaaataatgacaaatcttagaaataaagacgaaaacgaatttacaattttctatatttttcaccattaaaattaaattctctcaaaattcgctccatgaaatccgtttctcctttctttctctttctctctctctcctttctttctctttctgtcttttctcttttcactcctctctccccctcctttcctctcctttctatctctctttctctcttctatctctccctctcattttatcccttcttctgtatcttttttttcaacgctcttttcttctcatccctcttctctctgctgatgatgatttggtgctctcgtttgaatgcttttcgtctccaccttcgccgccccattcaaccggtgccttcgcttttaagcttctttctgcaccgggcagaagagattttggcgcggatctgcgcagagtattcgataaatgaatcataattattttattgattccttcatccccggaggggatggatttattcgttgcacggggcgaccgatggtgcggggaatggtcattcatcggcggaataaacagcaaaattattcatcaattattcaatatgtaataaatttttattattttaaaatttatttttcaatacactaaaaacttgaaatttttttgttttttatagagaataaaaaatattttttattattcttttttaatttaaaattttttagtctgaattatggacacacaattcatgttgtttgttttttaatgtatatattaaaaaaacgaaatcttggaaaaataaaaaaaaatatatatataattagtctattctttagaatgggttaaaacgttaaaatggacaaatttacgactccgaaaata

SEQ ID NO: 26208 - DNA, 957 bp, Heterodera glycines
gtttctcagtcgtttacccgccggcggggctgcattacttttccagcttagctttagctttctttacataacatgccaagcatgtggcggcgatgcttatacaaagaagtgggaggagtgtctcaatcatcattttcctttttttaattaaatttactctttttgtgcaattaattgcccaacagctcgtaatgagtagaatacctttaattaatgtggaatcttcattttaattactaaatttaattttattttcatttactaaatggcactgtgcctcattaaatgtaattaatatatgtacgcaagccactgatttttacatttttaccatgatctttgggcgaggatttttattatgaaaaaccaccaaaaattaactaaatagtgatgaaaatggcaaaaaaaataatgaaaaagtatcgaaatttttttccttcaaggaaaattaaacaaaaatggtttaaacactggttggagatgaatttcaactcttttttaaataacgaaaaaaattattttattgcatcagaaagtcaatttttaaaagagattttttctttttattcacttttacaaatagaattatagaatttttgccataaaaatatttccaatttttttttagttttaagtagagtgccacgggaccgggacctggtagcggacaactgagtacaactgagtaccaaggtcccggttttgatcgggaccgggactagtcccggttttttccgggttttcccagccaaaaattcccgggttttcaacccaaaaaggtcccggtccagggtttgcccaaaattcccggtcccgtggcactctagttttaagtatcaaatttcaatattttactatatttctttttgttgcacttttgttagaaatttctcaaaaaatgcaaatagtgacgaacaccaaaataatgacgtaactattttagttactaaaagttca

SEQ ID NO: 26209 - DNA, 2285 bp, Heterodera glycines
ctgcgcgttattctgatctagttagtttgccccctcctcttcttcatcatcattcattatcgctgtcgtaatctgtgacttcggcttcagactcagttgaagaactctgggcctcttcttgaagaaagtcgatagctattttaattttcgtttttttacgaatcaaaattatatcatcatcagttggttaccattggaacaatgtgcagcctcccaatcacgaacctttttctcggagcgttcaaccatagaaaaaaataggctgatcggctcaacgtggtttatttttgctaagacttttttaatatggtgtccaaagagtcttcctcaaaatcgaccacgtccgaggcattgtcgtctacacccatttcttcctccagtttggagtacttttttttccagcacatccagcctattttttgttaggaggcgtgatgcaatgtgagtttcgctttaccattcggcacgtgattcgccttgtgccttgatcattagccccagcattgaggtagcggacccatcaaacgaatgacgtcgttttcggttatcagtattgctcgtcgaaggcggtagttcctttttttcttccttaggcgtttcgtttatcgtcatgccaagaaaaacaatttcttcttctcccttttccgctccgtgtcctttttcctccggtttcagaaccgtttctttatcacttttgcattgagggttgtccttgttgtcactgctcattttcttgtccttcaattgttctttaaaagttcttgattagtcattactgaaataaacattgccaaaaaaaactaaatcgaaaatggcattatgaaatgcttaaaattttatcgaaattagcgacaattaaatatattataataggatcaatatcgctcattcattgataaccaaaaggaagaacatcaagctcatcggtgattattcctttttggcataccggaaggtatcgcttgagctgctcacgcgttacaatctgactcgctcgggttggttgaattttgtcatagctgaacacggctggcatttctccttgtcgaccatagttcaaaactttatgacgaaaatgttcgaattgtagtgcttgactgttctgcacatcaaatgttatgccgcgtattttttgcacatatctaatttcgccagttcgctcatcaaccatttttaatgcgtattgctttgcgccttgtagtaaagcttcagtttaaaaaagatagcatagcaacgaagtcactcacctccacagacaaaacttttgatggaataaccggtgtattcctccgacatttgtccaaggaattcgccagtctgcagtggctcaactcctcgacgatgcttaacaattacgctgtctgtgtcctaaacatgatttaagttatgctgatgatttatcagttaaacaaaaaccgtataaagtaattcagctccctccgtgtcgtgcatccaggaaaataatcgtctcttggaggaagctgcggcaatcgaatggtataattttctcttaaaaatatagctgattgactacaattggtagaaccaaagcccgacctccgattgaagccataaggaaagaagggtttgtccgggcagtcaaggccaaatgtgcctttcagtccatccagccgtattggtaggagcaggcatgagtcacgccaaataagaagcgaattcccacgcgaatgttggaggcgaaattcaaaaatttttagcccattcattacaacatctggtctccttctggtctctccgagataacgaagaacgaaatggccatcaaatctggacgcgttgtgtgccttaaatggaaatacattggtgcctgttgctctattattacccaaatatatgtgttaaattcttcactccacgccctcattatccattctacaaagttggcaaccggatcatcgccttcagcttcgctcctttacaagcagtgtccaggataaaataaatcgcaacaaaaagaaagctgcccaatatttgctccgttccattaatccatcctcattcatacatatttcacattgctcaattgcacattgaacagaatcagcacaatcggagcaggtcacacgtgcggacaggaagttgactttatggatttgttgaccatcagccgtcatcggctctaggcgcgtttccgtgtcccaacagacgatacggtagcgctgtttttccaacggtatgcgcatttttttaatgaaacaaccggtatctttgccatgatacacctagaaaaggagggatggtttgctcaattaatgttcatgtga

SEQ ID NO: 26210 - DNA, 1680 bp, Heterodera glycines
aatttaatccataatatatatcaaaaaattttggctcaaagttttttttctctcccgtgaaaaacccaaaatgcacagaacccgggagagtttattataccctcaccagcacgctgaacctaataaaatataaacgttttttattataataaaaatagggataatattttatatattaaacagatatggttataaaatttcttttaaaaaataattaccaatcactatgataatgttttttttgctagtcacaagcttcgaaaaaatatacaaaaaaaaaatgttttagataccaaaaattactaaacactatgtgaaaatatatttttcttaaaatcttatctttattgataactcacagttcggatacatcggatcccattttcacggatgatattagggttcaccaaaattgacttattccgcaaatattccggatcatttgtgaattctttaacaaaaaaggttgagagcagatttttaaatttcaaaaaatctgccgccggaatcgaatacctgaaaatacattgtcataaaaagacccccccccccactaaaagtaccatatagttatgccaacattgtctgttccacttgaagggcacaataaattcacactataaaggtcagaattctcagtgtgggcggtaaaatatgagccggcttttcgtaaataaaaatagggcgacgtaattccctcaattggaacaccaagaccaccattatttgtcgataaaaactgtagttctaagatggagcccaaagatggctgccagtctttgtcacccttttgcataggcaattcttgggcatattcaaatattctttgttcttctgttacgccattccaaaaaacgctaaaattttacttctgtaaacattttctatatattttaagagttatgtcagtaaaaatgcagggtgccccaaaagttctgagagcctattaaaattgttaaaactttatactcatctgtctgtcagccaaaatttccggttgcaaactatctttttaactttttattatcctgtttaaatgctaacctatatagctggggttgtcagttaagcaaacaaaaaaaaggaattaaaaaactttttttttttcaaactccacaaaaaaaatgtccattgataatttcctgcttaaaattataagttaacaaatagaccacacttttcatattgatcgatttccagacatggccactgtgcattttgcttgtaatcagcaatcgttttgtactcctctgataaaacgttttgatgataaaatccagaagcgcgcttttttaattggcattgactttaaaaatataagaaattatttgatattaaaacaaatataagaaattatttggtaataaacaaacataaaaaaatatttgatatttttaagacaaaccgaacaagaacacggtttcggttagtaattctgcatataggaagttgaaatgattccggtatgcgaaaacgataacaccgataagtcgcgaccagacatttagcgatatgatgttatcaaaaaaaataatcaatatttgagcccaaatcatcagagctttggggggatcgttttggcgccgacaatagagtcgtaatcacacattttcgagaatctaagggaaaaaaaatacaaaaaaaaaaagcaaacaataaatttttaccaaacaaaaagga

SEQ ID NO: 26211 - DNA, 1689 bp, Heterodera glycines
ttgtcttttccttcttcggctgtgtttcttccagaattcttttttccttcttcggctgtgtttcttttcagaattgccttgtccttcttcggctgttgtttcttgcagaattgctttttccttcttcggttgtgttattcccagtaccattttggtctgttcccggttcggctgtgtttttcccagtgcccattttgtcttttccttcttcgcctgtgtttttctcaatgccaattttgtcttttccttcttcggttgcatttctcacagaattgccttttccttcttcgcctgtgtttttcccaatgccaattttgtcttttccctctccggctgcatttcttccggactcgccaccgaccgtatttcttccggattcgcctgttccatcttcaattgtatttcttccggatttgccatcgagcgtgttttttccagaattgccttttccttcttcgactgtgtttcttccgttgccaatttggtcttttcccggttcggctgtgttttttccaatgccaatttggtcttttcccggttcggctgtgtttttcgcagtggcaattttgtcttttctttcttcggttgtgtttcttctggtgccgattttgtcttttccttcttcagttgtatttcttccagtgccaattttgtattttccctctccggctgtgtttcttccagaattgctttttccttcttcggctgtgtttctttcagaattgccttttccttcttcggctgtgtttcttccagaattgctttttccttcttcggttgtgtttttcccagtgccattttggtcttttcccggttcggctgtgtttttcccagtgcccattttgtcttttccttcttcgcctgtgtttttctcaatgccaattttgtcttttccttcttcggttgcatttctcacagaattgccttttccttcttcggctgtgtttttcccagtgccaatttggtcttttcccggttcggctgtgtttttcccaatgccaattttgtcttttccttctacggctgtattcttttcagaattgtcttttccttcttcggctgtgtttctcccactgacaattttgtcttttccctctccggctgcatttcttgcggactcgacaccgaccgtatttcttccggattcgcctgtgccatcttctattgtatttcttccggttttgccaccgagcgtattttttccagaattgccttttccttcttcggctgtgtttcttccgttgccaattttgtcttttccttcttcggctgtgtttcttccggaatcgcctgttgaatttattccggatttctcaccgatcgtatttcttccagaattgttttttccttcttcggttgtgtttttaatgccaattttgtcttttccttcttcagttgtatttcttccagtgccaattttgtcttttccttctatggctgtattcttttcagaattgtcttttccttcttcggctgtgtttctcccactgacaattttgtcttttccttcttcggctgtatttcttccagaattgccttttgcttcaccgactgtgtttcgtccggttgcaattttttcttttctttcttcggctgtatttcttctggtgccaattttgtctttttcttcttcaattgtatttcttccagtgccaattttgtcttttctttcttcggctgtatttcttc

SEQ ID NO: 26212 - DNA, 1672 bp, Heterodera glycines
  misc_feature (138)..(138): n is a, c, g, or t
aaaaaagagtccgtaaaattcaaaaacaaaactttttatcaatgcttcattcagtataactccattctgcggccaccgatcagcaaaatgccggacagtttgggcaaaaagtcgatcaatgtggatgaagtaaaattntaaaaattaaaaaaaaaaaaaacaatttttagtggcgccaaattttggacgtcctttggagtgacccgaagcctcagaatggatgttggccaaatgcttttcgtggcggtggcagctattttgggccggatgtgacaaagaaatttttggaaaagtgaatttattttttatttaattggtttattttcagaatgtttatttaacttaaaaatttccctattttatttttttatatttaattatatttacagaaatggcttccgtctgttaattcgatctcacgagtgcaaatatgaaggtccgtccatcataaaagcattattgtataattgtttttttaatgtttatgcattttaaaattaaaaatttaaattcaaatatctaaaaattataaaattttaattgatcaactaattcttataatttttccttcttttttcgaaaaaagctaaaattgtatttgttcaacaaaaatttcatttaaacttaaaatgcttttcatacgaatgttctaacccaataaacattttaaaaatatttttttttgaaaattagggcaatttaaaaaattaaaaaataaattttaaatatttagcaaaaattaaacaatttaaattgatcaactcattttttaattccttttttctttccaaaataagctacctaaattgtttttttccgtttccataaaaaaacatttttaattcgtcaaaaaacaaaaaattcattttgaaatttaaatgtttaaaaaaaattttcaatccaataaattaaaaaaaaaattttttttttcaggttacgaatttatgcatgaaaatcgggtgctcacaatattctcggcctccaattactatgaaactggtagcaacagaggtgcctatgtgaaatttgttggcaaagacaaagcgccacattttgtggtaaatatttttttttctaaaaatttttaaaattttaaattttagcaatacatggccagcaaagtgcacaaaaagatcaccgttcgtgaacggtaattcagaaaaatcacataccaatatgaaaacataaaatttatttataataattttatacaaaaaaaatatgtttattagaattaattttaaataaaaaatacttttattgaatttattttttaattttttaagacttagcattgtcgaacaatctgccatcaaaaaactgagtgaaaaattggtgtccttcaacacggagttgcagaaagaatttggaaaaattgattcgaccggcacaggtgggcaattaatcaattcattaattaataactattttatttatttatttctttctttattatgaacaatgttctgaaattttcgaactcaaatcattttaactcttttgagtttttttaattctattttagttttaaattaaaaaaatatatttttataatttaatactgaccttaaaatacattattctgagttaattaatatattttttccaaaaaattcttttaaatgattttaaataaatttttataaataaataaaaatcaaccaatttaaaa

SEQ ID NO: 26213 - DNA, 1858 bp, Heterodera glycines
  misc_feature (20)..(20): n is a, c, g, or t
acgatcaagagtagggattntaaagataccggaggcttccaatgatttatgcgtccaatcacttaccatcctcagttacttaggccattacgttttctgatttggtcaatgcctacattctaagtatcaatcaaaagcatgaaatttttggttaaaaattattcaaaaaattattcttaacactcgaaaagagctgaatttcgttttttctcattgtatttttcctagtgttagtattatccccgagactaaacttttgcattgatcaaataagcaaaaacaaatggcctaagaaacttatgatagttaatgattaatagacgcataaactgtccataggctgtgaaatatttttagttaacccattttatttagatgtacaaccaaaacgactacaacagacgaccgattcaccagcggctcagtttcaagccaatgaggttttctgtccccaataactcgtgctcattgtcagtcgccatttttcccaggctttccggttacgattttctgcgtcgtcctctccatcgccatacgacgcaattcaaacggcctttttacaaccgcggaagtcatttcagtttcaacagatggcgcacgaacgattggaatcggaggggtgcgtcgatgccttttggacgccgtggccgttggggggacaacaaaaggatgaaaaagtctttggcggagatggaccgcgaacttgaagtttgactcattcgtcaatttattcatttttggcttttccaggaatatatgcgctcatcaaaacacccgcgagtgaaactgaccaaagcgacggactgattgaccattcggaccaaatcaaaagtgtttgtcgtcttccttttgtcgtcttaccaaagcctctctctcccctcacttggtcatttgctgctgatgaattttcgttgatatatttcccttttgtttgttctttattttataatggaacatttctctcgaccatttgttcattttggttgtcccgtatctcccgcttcccttccttccctttgctgtttttggaatcgttttctaaacaatgaagccacagaacctaattattgaaatatggaaagaatttgttacatgtcattgctcatttattcatttttgtgaataatgcatgctcaagcaataaaaattaatcagatcaaaggaaatggtctgttttccgccttctcttatgccgtctttccaatgtttttgtgcttcctcttcccgtctcttttgctcatctgcttttgttcgacccgtccgcgtgcgcttcgccccttcccccacgggggaacttcatttgggtcataatttcaaaacaatttccataaaactgccattattaaattagccatttgaccgtttattcaggctccgttcgcactgctttgttcaattttctgtgggcacgtaaatacaacgggaaatttgtgttgcgaatcgaagacaccgacagagagcgattggtggagggatcggagcaaagggtggtctgaaggaggaggccagaaccgactttcctcttcttcagattgagcagaccctctcccactttggacttacacccgacgaaagtccgttgcgtggtggccaatttggttcctattaccaatccgaacggttgcctctttaccgggaattggctgatcagttggttgacatcggccattcgtacaagtgcttctgcagtcaagaagtaatcatattatggcttcttggaattctggtgttgttcaactgtccatcccatcgtttagcgactcgactttttgcgtcgaaaagcgaactccgaacgcattccgttccgttacgatggcatttgtcgccagctttcgacagaagaaacgcgagctcggga

SEQ ID NO: 26214 - DNA, 1578 bp, Heterodera glycines
  misc_feature (1503)..(1503): n is a, c, g, or t
gtttccatcctcaaattccccaattttttttagcgcgggatgcaaattcacggcactgctcaaattcccggcttcgtacccgcattatccgccaacaatgaccttcctcaccgacattcttcatccgaacggtgggaaaagcggctggcgcaacaattcatcaaattccagcaaccccccccccccccccctttcagttgacatgagtggccaggtctgcatcagcattcttcacccgcccggcaatgatccgctcggctatgagcaggcgtccgagcgttggaatcgcaaccgtaccgtggagtccattttggtgtcggtccaactgctgctggcggagccgaacttcaacagtcctgccaatgtggatgctgccgtaagtgattgattcgtccgtcggcacatttttgattgaccatcatcataattttttgtgtccaaatttccagattttgttccgcaacgacccggcacaatacaggaaggaagtgcgacggcgcgtggagagggcatcagcatcgacaccgcgagcgaggtcgtcatcaacaccaccgccggtagcgcagccgccgggagaacagcagcagggtacgccgcaaccgccagcgacaccgccgcaagggcaagaagcgcagcagcagcaacaacaaacgggcgaatggtacctttgatgtgacgtgatgcctctgagtgatgatattattatatagttatgtatatgtattgtattgtatgcatgtgtctgtcgtccgatcatttcataaattaatggtctctctctgtgttcgtttgccctgcttttgttcgctgttgtacatattatgtgtattgtcatcatctaccaattattgtatatacatatgtgtacatatgatggtgtatcgagcaataaactttgaaattgccttgatcctttccaattatgtatggattttgggctaatactggagaattagtgtcccggcgaaatataaattaaaaatttaggtcatattcatcgtcagcgaccctgaaaaccccaaaatacatgttttcagttatccttacatgaaaatatattaggaaaatctcagggtgaccaagtttttttttcaaattcaggccacaaaacactaaattccagatttaaaccccaaaattcagattttattcatttaacatttcatttacatgtaatatttgagtttttaattttacatatttatttaatcacgaaatatttgagcgtatattttgcaataattcaaaaacaaatccagataaagttaattaattttcaagcgtttagggacagaatctaaaagttatctctcttcttttggtcccaagaaaacttttcaaatatttgtgcccttcaaaaaattaataagagagaatcaggcggtgccttggcgccacttggaaaattagcaaaatttgtaatgccaaaaagcggtgccagcgacacattaagtgaccgttatcgtgaatttacgcgcatctctaatagcttaaactaattanattaataagtatgtaaaggtgagaaaattttagaaatggataacccaaagtgctacttttttattgtatttttgg

SEQ ID NO: 26215 - DNA, 1555 bp, Heterodera glycines
actggtgtttttgctaagaaaataacaaggattttttgaaaattttctaattttgaatttttttgaaaccttcgggagtgggggaaacgtagtacaccctcccaacccctttttcttttggcagaacttacttcatctaccaactgtccaatgcacacaatgccctgcgggcgatagaggccgacacaggcgggcaaacgggcgcgcagcatggcgaggtcgtcgccaaattgatagccgagtttgatgatcgccttatcaaggaagagacggtcgatgaactgctggaaggacttgtccgcgtacagcgcgtccaggtccaacaggtacacggagttgaccagtgccagttggagcagactggccctggaggggaacatacattaaataagggcggggtgagaatggaaatatttgtttgacgaatatttcaaaaattttattgaatttaattactgcataaattagttttctttttctaattaggcacctatggtattataacattgggaccttctataaggaagttttccaattccgcgctggtacaaagtgtccatgaccattcaatcaaccgcttactgacctgctcctggccacgtacggattccactcggcgtcaacaccgaccaaaacccggtgcgtcttcttcagaaagtactcgtcaagttggcgttcaaaaacgcgaaacgcgtgcgcagtgtcaatttcgtacacggcgcaacgacgcggcaaagacaaaaactgagtctgttcatccttagagcatagattgaccatgtcgaaagcgctaaaattagaatttcttattttataaaacagaccaaaagcactggaacacatccagccaaacggtgccgagaagcgccaacgggaaaattttgaatatttttgtgagaatttgtctaaaaattcaaaccgaattttgcgatttaagccaattttctaatgacataagggttctttttgggtttggttcggaatttcaataattttcctctgacccgttcgccggtgaccccctttcccccctcgctgtgaaagggttgccaattttgggctcttgcatggccaattatcgcgtccccgggaagcccgcgctgactttgacattcgacagcgttccgtcgacacaaaattgcgccatttttcatgcgcccgtttgtcgtggtggtccttcagcagaacgttcagcagaaatgccttcagcgtgggctgttggacgagcactgtgtgcaccaagtcgttaaagtgttcctccttccacgtcctctccgtgtacagcttgcgagcggcggttttgatcagcgagtgggcccaccgcgggttgaccaggttgtcgtggtcagacatttctgaaaataatttgttgcacacaaaaacccaaatataaatgtcaattatgacgaataaatattaaaaggaacgtaatcaaatgatttttgttctactgactcaaaggctttaaaacgaggtaaaaatattttacactttgtttgaagtgttggcttaaatggatagatttttgcattttttaaggtttttgtcgttcttg

SEQ ID NO: 26216 - DNA, 2421 bp, Heterodera glycines
ttgaatttggcagacggatttttgatcggctttttgtcgtcaggcttcgtgtccgatgcagcggcggcaccaggcttcttgagcggaggctgatgagacggatcatgatgaacaggttgctgatgtggtccaggcttaaacatgtcaaaaatataaatttgttagacaaaatggtaattcgggaagccacaccttgtctgctatcttagccggattcttgagcggctttttgtcatcaggcttcttgtccgattcagcggcgccagacttcttgaatttggcaaacagcgactttttggcatcaggcttcttgtccgttccagcgtcaccagacttcttgaatttggcaaacggattcttgaacggctttttggcatcaggcttcttgtccgatccggcggcaccagacttcttgaatttggcaaacggattcatgaacggctttttggcatcaggcttcttgtccgatccggcggcaccagacttcttgaatttggcaaacggattcttgaacggctttttggcaccaggcttcttggacgacgacaaagcggctttcttctttgcaaaaaaggacttaatcttctttggcgatttcggacgaaagcgctgaaaagggacagaaagaattagacaggacaaaaaacaaatgatgctcaaaaaattgttcacctttttgctggacgcaggtgaaccaaatcgcttccctttcttccggccaagacacataataataataataataataggcaacaattgcagagaacaatgaatgaataaatgaaatgaactgatgtgagcaaaaaagggaattccctcgctatttataaagagggtaatgaaaaattaaaaaatgaaaaaaatgggggggggggatttttttttttttttgataaatttcttatctgtttaagaagattaactaacaagcaatcttcagaaagttttaactgattagtgatcacgaatatgacattcattttgtcagattccgtatacggggacctgaatttgtcgaacaaaaatcggcattcaaattttttttgacatttttgtttcatattcgtgatcagcgactaagctcgttgttggagaaatgggcattgcagaacaatacaattgttgaatgattaaatgctatatgcttatttgttagctttttgtcacgattcggtttttttgttaaaactgtcaaatacaaaatttcagggaaaatttttgtataaaaatggaaaattttacgcgttttcttcacttcatcaattccctattcgtattcaacaattatttgttcgtctccaagtctcgtccaacgtctgcatttattgttcatcaatccttcatcggttggcatccgcgcgcatttcaaaatggacgctctcaaaaagcttgcgagccgtgcacgacaggtaaaaaaaataagcgtattctgaggaatcaatttaaaaatgccatcccacattccagaggtcggcggagatcatgctgaacgcggagaagaccgaaattggtgaggaggccatttctggattccaaaaattaaaaaataacaatttttcccaaaatttcaggcgccgagcttgaagcgctgctgaccaagacagacaagacggaggaggacatgaagaagctggtgcataccatcgaggtgtacctgcagccgaaccctggtggacacttggaatttgcaattttttggaggaaaacactaatttttttcccccaattttcagcagtccgagctctggacggtcttggggaggcgttgaaggtgtggtttttggcacattcacaattagcaacatatttttaatgcgcaccaaaatttaagggagcagcatcgatagtggtgggagccgagtcgaccgtcggaagtgagagaattttaatcggaaaatgctcaatttcattagccccactaattgttgccttttctgttgtttttcagccactttgccacagacagagtcgaaaatggcaccagcagggcaaccccaacccatccaatcgatcaccacgcaaaccttggcaagcctccggcacctccaggagaacgaactacgcaccgtccaggcgtggatttgcttcttttttttactcaatttccgacaatttttaacccaaaatccctcccttatcatttgcagaaggagcgcagcgtgttgaacaagaaacggttggatttggacgtgacaaaaagccgttggaagcgcgcctcggacgacaaaaaacccgctgtacgtcgtgtgttcttcgccgccggggctccatttttcaataattgacaaatttcactgtttttttcaggttgaggcagagttgcgcactgcccaggccgaatttgacacccaactggtgaccatcatcactgcgttggaggctcttcaaacggctatggtgagaattcccaaccccaaaaaa

SEQ ID NO: 26217 - DNA, 2692 bp, Heterodera glycines
  misc_feature (2587)..(2587): n is a, c, g, or t
  misc_feature (2656)..(2656): n is a, c, g, or t
ggttttaggttctaaaaaggtgaaaataggtcccaaaaattcgggatttagggggggggaaaatcgaaaagtttttttacaaagcaaaaattttatgcccgatcgttaatgatataattattttataaaaaattctgtcgacaataaataaattttcgagatgagtttttgagaaatttgttaatttcttaggatgtattttataaaaattaaggtcgattcttagtggagtattttttttaattctaggtcggattctagggttgtatttttcatttttattgcatttttttgataatatctggcgcaaaacgccagcatagaatcaaataggtggtacaaaatttttttaagtttttagcctctaaaaataacaatctagaaaataaatgtcaataactggaaaatagcgtaacaacacccaaaaaagcttgtttatcgtgcgtgtcacaccatagaagctcagaaaaaaaaacagtcaccgggaaatttttataattttaatgcaaattctcaacaaattttgtccaaaaaataaccaattttagcgatttgaggcaaaaatttctcaataaaaataagattttagggtccggcggtgccgataggcgccgccgggaaatttttgaaaatttcagtgcaatttattaacaaaatttgtaaaaaattgttaattttttgaaaaaaaattcaaaaaaaatttccgaaaatttccgactttttatcaaaaatttcgaaaatcggaagtcggaatgccgacgtccaaaattttttcggaaatcggaattccgacccaaaaatgtcggaaatcggaattccgtgccatccctgatacagacccgtaaccgaatggcgaggggggcgggggaggaatccctctccaaagcaaatttttctaaattcttcaatttactaaaacacttcagctgctttgatttttttgaaaataaatttaaaaaaaatgagaaatgttttcgaattaacccatttcttttttgttacgggcctgattaccttgaacaatttttcactggaatttgcattactcaattcttaccatgttccgatgtcaaataattgtcctttcttttgtttttccaaattttagtgatttttatgcataagtcttctttctcttcgtttcatttcattttaaaatttctttggcgaataattttttttccctcttatgcaatttccagaggctgtcctccctaaagacaaacaccataaattgtttttatggtataaattagtgctttcaggcttaattggttgcttatagggactgtctctctcattggataattttcttttgtctgttttccatttcctttgtttatgtgctttttgcgtatttttgtttctattcatcagctttttgctttttctcgctgcttggtatttccgtcttatgaataaaaatgtgttttattttattacactgcaattggggctgttttatggtcgggattttctcgcgaaaaaaggtattttttaggacaataaaattgttccgagtcagcgtaactttctcaagtcggtaatcctttggaattgctgtcccaccggaaattgaaattgcttataaactgagagcccttgtgaaactaaatgcgcttcttcaagttcgactttcctagtcggttcaggttctcatatccggaaaattctcggcttttcatgatttagttcctactctcgaaaattcatataatatgggggtgtcatgagtcttgacaactcgaaaaaacttgcatctgctgtttgtagaattatttctaaaacatcaaaacagtggcatattaaaaaaattttttagtttggtgaattttcgatatttatcaagacttgcccaaaataccgaagtaagcaaataagatatgatggagggactgaaatttcatgaaaaattgtctcctacaaattctctccaatatcgagccgagaacatagagaagcaaagaaaaagagatagtgttagtgagcaggacagacaacgaaaggaagaaaaaaagagagaaagagccatcagcgggaaagagaaagcgaactcacactgctgaacacagagaaagagagagagagagagagagagcaaaaggaaaaagagacaacgcagaagagaaagcccctcgggggaacaaaagcgaacggccatttcttctgctcttgggacacacaacctacagcgtcttcttcccatgccaatcagctaattagccactaattaaccccaaataacaaaactgtcccctgcttctcccgacaatggcttccaaatgccttcctcccgaacttttgtacgaaattgtgcctttcgtccttgcgaaaatgctgccccaaattcgctctcgtcctgtcggctgcttcacaaacttttactgccacgtgtcatcaaatggcaaaaggtaagccgtgccatttttgggacaccaaggaattatgctcgaaatgcaatttgtcttgttcaacaaccaaagtatacataaatctctggatcctaatcaacagtaaacaaatttagatttgccaaaaaaacccaccaaacataaaacaaaacctaaaaaacaaaacagctcaatanatattgtaaaaatctctcaaatctcatttttatccgttgctacccgacatttgggaatttataacttgngacctcgacatcgacatttggggacctgacttttgt

SEQ ID NO: 26218 - DNA, 1176 bp, Heterodera glycines
caaaaagaaaagaactgaatgagtgaataccatcaaacaattaattgtttcattgaacgataatacatatttattgggcaacttatgcatccgtccttttttatatttttattcgtaaatttccccctcttttgccccttgcttgatatgtgccgttcccccacccctttccccttctttatccccccccctttctttgccatgtcctgcccctgccccatttccccctttgccacgtgccgttccccttcttttgctgccccttgatatgtgccgtccccccctctttccccgcttttccttcttattcgtccccccctccctccccttttttcgaagctttggatgctaataattctgagattatctccgccttccccctccaacatttagcatcgattttctccgttttctcaacgattccatgcgccgaatgcgcacatttccatccatcactcatttctcattcactcattgttcggcggacggatcgcattcatttgtaaagctccgaaaataaacccccaaaagtgtcctccgattaattcgcttcttttccctcccttccgctgattttggccttccaaatggccgacaaagaatcgtttcgtcaattcggaaaatatgaaaaattttgatgaatttccgagtcattttcatttgccccaaattattttcccattcccgttaatacgcagtaagcaaagaataaaaggagaaaggaactttaaatccgacaacataacataaaatgacatatttttaatgtcaattttgcatattcacaaatttgtgtgcgtacactttcaatcacatttttatatttgcactttattaccgataaagacatcagaatcgaaaaattttaatgcagaaatgcgttttttgagctcctttcttcaaaacaattgagcaaacaagttttttcactaaatttgcggccctatttattacataaaaacattaaagcgtttacttagcttgttgatttttattaaagcatgttggacatatgtatattacaaaaaagagcattatttagagaagggtcgaaaaagtcaaagtggggttcgaaaaccaaacgatggatccttttcaaggaacaaaaatgggtaggctaaatgccttcgagactgaaccttcgagtgggtaaaacgcataatgttcaacaaaatc

SEQ ID NO: 26219 - DNA, 1195 bp, Heterodera glycines
  misc_feature (1162)..(1162): n is a, c, g, or t
cactatgggtcaagcacactgtgcagagaaaagcctagtactatctcgtcgtttctctttttctttgtaatttctctcactttggcgtactatctcttcattttaattatgtaaaaaacaacatttacttttctatgtgtaactttttttctttatgttaaatccgtaccaaattttgcatagcgatagagaaaaaaattctgcatcgattaataaggaaatttaatacaaaaataaggctcactcaaaagttatttggtgaaaaattttgtgaatttctttttctctctttttggcgtactattttcacatctctaacacacaaaaaacatcaaattcgtaaatgctaataattttggttgtaaaggaacaaaatcactttgagcatttagaatcaatagaaaaaagaataaatttagcattttggttagaaagagctgcctaggacttgagttataacatgataaaagtttgaaattccgacaacttttttctgagatgacaaattacttaacattcgcttagaaaaagattctccttttcaaaatctttttttagataccaaatttgttcagtttgattgggtatgaagcgagttatggctgatcaaaataaacagtgcaaaaaaggcatttaccagtataaattttgaattagcgcgcaaaaatttacgccaaatgcgctatttggcgttatgagcaattttgtctaacactgggcttgacccatagtgtccccatctattctcttaaaaaataagcaaatcaatattttagaaaagtcaatatttttttctaaaaaatttttttaccgggctctagtgctgagattggtttttaactattcggcagtcaaaaaccggggttggctttcatggaataatgccctttcgggaaaactgctacttacaaatcggactcttgccatgaagtttcgcattgcaattaggcaaaaattcagctgctcgcatccaacagtcgacgactgtgaaaaacaaggacattcggaaattcctggacggcatttatgtgtccgagaaggtggccattgccgatgaatgagcacacaaagacaaaaaacccattgttaccccttttttgttggtcagaatggataaagaaattgtgttatttcgccgggtggtttcaacaatttgttttanaataatcagaaaaaaatatttgtgagttcaaag

SEQ ID NO: 26220 - DNA, 1042 bp, Heterodera glycines
tttggtaccattcgaaagctcttgacgagctaagtctaaaaatcattgtatgaagtcgaaccggtgccatctgagcacttggactactgagtcccagtgaaaagtgacatttcagtaccaaagaaataaaggatgaacaaaaagaatttgacgagctaactttcgcaaaagggagcattcgaagacggagcaagtagtggggcgagacggagggcggaggaagcagtgctctaggtccgctctacattttcaaatgtatcaacaaagggtctatctccactctctggcgagatatggcctgtcaaatcagagtgggtccttaaacatgaattttattaatcttaagcatttcttggaggagataatttttagacaacttttttatttctcaatgcatttttatcgcctttttgtctgtaaatggagggaattgccagtgaaaagatgttttggaaaatttttcagttttgtcttaaaaagtcattcgactcgctgtcacaaaacaacttttttttcactggcaatttcttccagaaagagtaaaaatggctataaaattgcatagagatataaaaaatgcgtctaaaaaaattatctcaacaattagtcgggaaagctgaaaaaatttctgttgcaatagcagtggggaggaatgagtattgtataattgtaaaaagaccaattagatatgattaaggcactctataaatgattagaaaataccaaatagtgattaaaaatttttttgttaactatttcggtacttatgtactttacagaccataaaaataattaattgtttttaaacttttctagggggttttcggggtcgctgatcacgaatctgacatccatttcgagcaatctgatacttcgtacttgaattcgaacaaaagtcgaaaactcatttttcatcaaaattcacatttattgcacaaaactattcatatatattgtatggaatagacaatagtgattcataaccatttcgttcagtgcgattgatttacgacaataaaggctgattttggtgaaaattaaa

SEQ ID NO: 26221 - DNA, 1760 bp, Heterodera glycines
ggaatggttgaagtgcttgccgttgctgggcccgccctgttgatgttgtggcgtcttaaaaacaaaatgatttttttttggaaaaaatagtgggccattcattttatttagaaaaaatggttcgccaaattgtataagaagtaaaactggaaaaaaataaaaaatactaattccagtacagtatctccatcgaaaattagcaatggtacggtagtcgaaatggaagcaaaaagatatttaaatgtaaagttacggcatcatacaataaacccaaaaaatccgtaagggcataaaaaggcctgatacggtaaagaaaaattgctttgcactcgcctgcattgagggcggcacaccgccggggcccgctggtgccatcatcggtggaggaccggcgccggccaccaacatttggggatggattggcaccatcacattgtttggcaacagcaccataggcagtccgccagggccacaaatctggcaaaaaaaaaaaatttaaaaatgccaaatatttcctagaataaagtgtccccaggggctttatttttttaagcctcctcagagggggggggggggggggttatatttttggaaataatggtaattgaatttgtttgattttggcacatatttttaaaaacccaccacgggcaccggaaggagcggcggttggccgggcaaatatttgaccgacgacaaaaggccggacggcaaattggcgggccgcaccggcatcatcatacagcgagggatttgggcgggctgtaaatggatgaactttaaagagagaaaattgggcatcaagaatgatatcaatcacggggtcggtgggtggacccatcgaataatttcaaaatcagaaatttcaaaaaacaataattatttttattggaaaatttcaagaaaaaagttttgaacaacattttttatgaattttttggaaaatttttgaaatcattttttaattagtccgtaatattttgaaaaaaaacgttaaatttttttcatttttttctattagaaaaacacctcttctatgtaacaataagaaattttaaaaattgttaattttattttttattattttcttgtcggcgggggggggggaggttccccacttattttcgaatggaaaaataaataaatttcaggttttttaaaaaattttcccatgaaaattcaaaaaatgataaaaaaaaattctttaaaaaattgtttgaagtactttttactagaaaaatttcaataattaataaaaaaaaatcgcttttaaaaatttccggggaggggggcacaaatagaaaggggacgggtggcacggtcgcgcaccataagtgcccgcggcggtggcattggcgcagtgcgaaagtatgtgttggagaatgtgccagccgggtacatggcctctaacctttggcggtgctggaaaaatttttcaaaaattattttttcaaatttaattttttttcggattttcggcaccagcatggtcatgtggaaggcgtattgaggcaacatgttggtgggcgtgccgttgccgggtgccggaatcagcggtcgttggtcaccgccaccattggccctcacctgctccatccaagtgcgacctacaaaaaaaaattttttttttttattttaaaaaaatttcggcattatttaaagagggggtcgcttcgaaaagccaatttcaaatgcccaagccgaagccgagtcgaagaagaaaacattggagattcaaatttttgattttatggactttt

SEQ ID NO: 26222 - DNA, 1469 bp, Heterodera glycines
ggaaaaagacgaggaaaataaaatgaaaaaagcggaaaaacggataaaagagttggaaatgacaacggaagagctgaaaagggagaacaacgaattgaaaaaggaaatgagtaattacgacgaagcgaaaaaagagttagagaggacaagggaggaggtgaaagaagcgaatgagagagtgggaagggcaagggaggaaatggaggaaaagaagagggagtggggcgagagagagtcggtcgaacagctaaaaaagtgagtgaaaagaaataaatgtattacaaaaagaaatgaaattcaacagagaagagacggagaagacattggaattggacaaagagaagtaaatgttggcatattcaaatgagaaatggcaaaagtggacagacttttgaaattggaaaaaaaaagaaaaaaagccatttcattgcagttgtaagactgatcagtgatcactattaacccaaattgaaatgaaattaacaagcgaaattaaaaacaactaactaaaagccctctttttgatgctgaacgcccaagcagcaaaagtctgtgtcaccaatacatacatatgtaaaagtgtgtagaaagaagcaccgattcaacgtttctttaagaattttggaaatggaaaaaaaagtgattgaaatgaattcaaagttggaaagagagcgcgaagaatggaaagagaaagagagaaagctgacggaagagagacaggcgacagagaaggaaatggcaaaacaaagcgaacggtgccgacggaaagaattaattaccatttgaatgaatgtttcagagcattcaaattggcagaggaagtgcagaaatgtgagcagaaactgtcaaaaatggaagagaaagaaagggaatggacagaaaaagtgagagaatgccattgggagggatggaaagcgcaatttgcgactcattgtcaggtgggccgagtggaggacgaaaaagccgaattggcagcggaactgttagccgagagacgacgagtggaaaaaagcgaaacggaatttgaaatggccaaacgattgttggaggagaaggaagagagaatacgggaaaaggagagagcacaaaacgcacaacaattccccggcacagcggaagaaacgcatttcgaactgcaggagcaacagcagacgaaagtgccaatggcaaaggcacgaaaagaaagggacggaaacgatggggacgaaatttgccggatgagcgcggagttggaaaagtgagaagaagcgggccaatcaatgcacggcacggctcccttctgtctgattttggattgagagcatttttgcccttgagatttttaattctgattttttacagcgttggctgccaaactcagtcccagggccaggggaccaatcttaaaagaggataaagggagggcaggggtggtaggtgccgtgtcacttcgtaaaaagcattgtacgaattggcattgactcgggagg

SEQ ID NO: 26223 - DNA, 1165 bp, Heterodera glycines
tatagtacggtactaaagggtgtctgttcccgatacgcacattgttcgttggtaccgtatcactagggttattaagcattgttagggttgggacccaattgtccggtacccattttgaccctttgctttgcttgtatttccctcttcccttcattatgtcacgcccctttttccgcccataaatacccgcgatgttgaccctccccgttcacttctttcttttatgttatttccttcttttattatttgaatattcctcccaatttatttgtgtcttcttttccctgctccaaataaatattgattatttgtttgccatcggccggcataacaattggcgacgcccgtgctgacttttattgcactgtgggcatatttatttgaattgtggacgcagcatttggattttgttgatttgcttgaagcaatcaacaaactttttccaagtttgactctttattggagggagaggtcaacagcaatcgaatttgctgaatcatcgctgaggactgcaattgtttattatctaggcgataataaacaacatttttgttggacctgctaacagtttggcactgttagtagtggaaaattttgcgctgctgattttgtgtctaggcgacacttctcagttcatccacgcgcacccactctgttaacaagctaggcgctgttagcaatagagtggtgaacgacaaaaatgggagacgcagccattcaacgattgacggatattttgcagcaattgttggctgcgcaacagcaaaacgcgccaccggcacagaacgcctcccaattgccaacactcccggacgtggaatgttttgatgctagtcagcatcgtggctgcgaaattgaggattggctcaagcgatttaagttcgtctggactgtgcagcgccgaacctccaggatgagctgaaggtgaagctgttgatgacgaaattgtgtggaccgacgttcagcgaatattgtaagtctgtcttaccgagagaagtgaccgacttcgactttgtggagacttcggagaagctgaaggcattgttcagccgacctcaatcagtttggattgaccggtatgaatgtctccgctcggtgaaagacgacgacgaggattttggcaccttcatcaaccggcagaagaaacttctacgggatttcaact

SEQ ID NO: 26224 - DNA, 1131 bp, Heterodera glycines
tggaaaattttgaaaatctaagtgacattacgccataaaattacaaattttctgaagaattttaagaaataagaacaatagcccgaaataaggacaaatcttacaaataaggacattttattttgtaagatttggaccctccaaataaggacaaatcttataaataaggacagatccgagccctgattttaactgactaagaaaaaagtttcaaaattggcggcgctgaaacagtccgcgccgattaagtctttcgattctgaacaaccttcacctgtcttcaaatgtctcctcaatttcctctctcctttgtttcttttcgcctcttttcgccccttcctctctttctttttccccctcctcttcttcattcctctcctccccctcttccttatttctttttttccctcctcacttcctttcctaagggcgcgttagtttcaccgctcggctgaaccgagcggctactcacagccacacaccggaccgggtcgactgggccccgccgactgggccctaccaactgggccccggattaactgggccccgccaactgggccccaagggccggtcacattttccatttcatactgtcaaaaattatttgatctctcaaaaatttattcataaaattctaagcatccatctgataatttacagataaaaacatttttaagccattttcccttggattcctgtactttttggatgctcggttttcgacctttcatttctccatgtagaaaagtcgtagagacatggaatcttttgcttttgtaacaaattttgcgcccttctatctgtcatattttcctttcatgaaaaatttttccaaccccctaggatggtttcaagccattttacggttttcaggtcacctcgaatgagtgatctgatcacgttggtgcaatggacttttttttgataaaaatcaaaagttatacttacatgaattttccagattttttcttgccctataaaaagttacatgttttcaattgttgaacgtataattttggaacacactgtataactaacagtgaaatgatacatttgctgaagaaatatataaatatgtatttacataaagagacagccttaattatcataattgtcgagtatttgacaatt

SEQ ID NO: 26225 - DNA, 1233 bp, Heterodera glycines
tgatcatatacggccccgtctgcttctaatctctgatcacttttattctgatccttttttgtcttttgattacatgcgctttcccatatgcagatgacatgtacggctcgtcacgcattccccgtccggctgatttggcatccaacaattcatcccgtccggccagccgtgcatcagatatgggctccgactttggcaccaatggtggcgtcaccagcgcgacaccctcacgcattccggcaccgcgtgcccagcagcagaagggggtacgattcgcgagcggaacggggtatgttttcggattgagaaaattgcagatttatttatttttaatttttgtttattccctctaatttttgaaaattcctatctaaaattgaaatttcccattcaaaacaaatacataattaggcgtcatgcctcattaaaacgttgatacatctacttcaactaaaaattatatttttacaggggcagcagtgacgggagtggccgtaatacgccttcggtcctctaatgaatgcgtgtgcggaatgatctggcggtgtcggaatgtttcacccgctaatgaccgcatcaattaacaaaaataaaaaataaatcaaataaaccaaattgtgtcatttgcgtgtcttaatcattattgtctaacactttctttttcaattactttttattccaatttgttcatgcctatcatcatttgttgtcactattattacattttattcatcgtttcatcaaattgaggccagcagagatcgaccggaaagtgtattataagaataaaacattaattcatgtgtattcccccggggtataataatttgccttcattttaaaatatttattttcttttttaatttcttcacaattttgttgccttggttttaaattcattattttttgtcatcattcatttttgagcaaaataaatttatttttttaacattttatcttgtacatttctagccagaattggttattggcatggattaaacgtgaaggcctttgcagtccgcagcaaaaaaaaaattgaataaattttcctgtttatttaaattatttttgatacgaattattacgaaacaaattttttttgtttctgtattgcgatttaacttttcagaatgtgttgattttgcaggaaaatacatttaattttattctttgacatgagaaaatgcaaaacaaaaagagtaattagaaggcattataaaatcagatagataa

SEQ ID NO: 26226 - DNA, 1407 bp, Heterodera glycines
  misc_feature (35)..(35): n is a, c, g, or t
  misc_feature (49)..(49): n is a, c, g, or t
tgagtcgatccaaaaaactcaaatgatgataaatntaaataaataaatntaattattcgattcacaaaatcacggtgccgtagacttaaccctaatgtacggcggaacgcaagtcatttaaaattttttaatatcattcgatagccaaaagagttctctattagccaaaaaaaaataccaaaaatgtttaggttgaacaaagttatgaccaaaagaactcaatgaaccatgttttcagacatttttggtcataacttttttgaaacttagcccaaaatttttgaaattttataggctcatagagaactcttagggctatcgaatgatatcatgaattataaattaggttgattttgagcaaaattatgggtactttttttgaaaattttcatttgatgattattatattatgacatagcaccattcacgagatttttatgtattcgtaagaattggggggtgcgggtttgagagaaaaggttttttaaaattgggagaaaaggaaaaattttgagaagaaatatttcatctatactttatgcaactataaacaataatgcctagtcgctaaaccttcatctttatttgatttctgccttggttcgatactcacacaaaaaaaaattatttcaaaatgaggacagactttttctaagcattgtccaattgtttggaaacctcaaaaattatgttaatggcactgatgcctaaacggattaaagaaaataattccgccatgttttgatacagcctatatttaacaaataaattattaaaaaataaaattcaattaatttaaaattaaaaaaaatttattaatttaatattgaaaaaatcaatatgatttctctacgaaataacttgaaaattcaaaaagttatttttatttatcaattatactcaaataaaatatgtattatccataatattatgaaaagaaaaaataaattaaaaaaaaagtctctattaaaaagaactaaaaaataataaataaaagcactgataaaaaaataagtttgatgaaagaattttgttttccaaataaaactaaaaatattttatcaaattgaaaggaatttggaaaagtaccaagtgacccttcaagttatgatatggaaatactatacaggcccgggaagaagaacaaggtgacagaccttctttcgatataaaaaatatcggaaattgaaaatcaagaggaaaaaattaaaataattcgaaatttaaaaaatcgtaaaaatgttatgtttggacaacaacaaaaaatcgaacgtaacaacattttacattcaaaaagttataaaaaagtaaaattttcaaaataaaccgaggaatgaaggaaagaaatacgttttaaatatttaaacgtacagaaatgatttattaaatctggatgctttttttcaa

SEQ ID NO: 26227 - DNA, 1256 bp, Heterodera glycines
  misc_feature (1167)..(1167): n is a, c, g, or t
  misc_feature (1228)..(1228): n is a, c, g, or t
  misc_feature (1245)..(1245): n is a, c, g, or t
aaaaaatactaattaatttaactattatttatttttttattattatattcaaaaaataggaattataaaagcattattatattagaaatattaaaacaattgccttaaatagtcagaaactattaaataaatctaaaatatttattacctatggaacataaaaagaaaaatagctaacaaataagctataacaatgagaaagaccaacaacaatgttaacaaactaacccagtgtcattgccatgatatttaaatttataaacgaaataacaaaataaatttctgaaaaatgaatttatataagaaaattaaattaatttttattaagaaaatttgggcaaaaatccagatttattcatcaaacattaacaaataatttccaacaaataaattcttattcatttttttgtgaataatattaataatactttttaaaattttgaaaataaattttaattttgccttttaaacaaagattaataataaaaaaattcataaaaaaaaattcacgaaggagacaatgagaaacaccttaactttaaaccaataaaaaaattatggttgcaacctcggccgcgccccgaccccgaacaccgccatttttggcaattttcggggctatccccgaccccgacgcattcaatcccgacaaacactgactccgaacttgctgactccgaaaaaaccgattcccgacttttccaatcccaacggtcggggttgcaaccctgaaataaatcctttaaataaattttgatttcccccatgggggattatttttcaacctcctcgtagactgggcgataattggagactgggggattaagatagagggattatttttcaaaccgtctcctagactgggggataattggagaatgggggattaatggaaattgggggataattagagcaaatacggtaggttatttctatagttgttttggttcaaaagaatattagcgattgacggatcagaggaatcgaacatgaaataaataaaaaacataaaattaaaataaatcctaaattatataaaaaataataaattgccaacaaaacacaacagaaggatgtgatacgtaaggaaccaggtgaatctaataaatatacaacaaattaatttttacaaatcgaatttgatttgtatatatttattaatcttanatataaaaagagatattaattaatcagagctcgtcaataaaatagtaaatcaaattgatanaaatattttcgaacaanccgcaaaagat

SEQ ID NO: 26228 - DNA, 1473 bp, Heterodera glycines
ttcaggtcatgaactcttccgggagtcggcccttccgttggagcatcagcagcatctcctgatgagtcaaccaaatgcgcttgccaaaattgcgaagagacttatctatgagacccgcatgtgtaaagagttaaaagaaattggactgcaaccgcatcatcagcatagactcgaagaagcgcaacagaagtttgctaaaggagagtgtctgacacaatgtgaacttactctactgtttatggaacaacaagagcgcttgcggcagaagcgcttccggcagcagcagcaactgcagcagcaaccaccgcagcagcagcaaccgcagcagcagcagcaaccaccgcaaaattggattttaagtgatttgttaataattttcacaaaattgtctattttatgtgcatgacttaaggttttttgtgaatttgaatgggccccagcggcgcaggtagtcgccgccggaaaacaaattttttagagcgatttagttgtaaatcattcccaaaatttaaatttttgttggttttagtgcttaaaattaaattttggaagataaaaaataactcgcaaaacatagtcaagtttcgttaaaaaaaacgaagtccaatttcgtaaaattacatactcaaaaaaagaaagtcaaatttcgtaaaaaaaaactacgaatttaaaacgaagcacaattttgtaaaagtaacgaaattgataaaaagacaaaggaagaagtcgaaaagcgaagcctgatttcgtaaaagtttcccgaaaattgatcaaaaaattattaaataattaggatttttttttgatttttacgaagtctcctatctttttcccgttcgtcccgaatttttctcacattcattcacattttcatcccaaccaatacgaagtcgaccccccccccccccctttttgtcgattgcgtaaatcccaaaaacacctaaaaacatatttgaattggattgtcaaaattaaaaaattatacatctttgtgagagaaatacagtgccccaaaaaagtcctgactcaaacctgaaaaactatcttatagttcatttaaaaacttgaaataattcatgcttgcataacttttggtgctgatcaaaaaagtaattttcgatatccctaggggctggaaaattttttctagaaatggacaagcccactggaagagcacagaatttgctatcgaattgcttttggaacggtgcatctacgatttgtatagttatacatggttgaataattgatcaccataaaaatgatcaattttggtcagtgccataactttttgtagaagcatccaaatttacaatcttggtatcttttgatagctctaagtgtcctctatttacctggtaaatttcaaaaaattttttattgtgctttcaaaaaagtgtgtcttgtaattttcataaatttatttggtaaactttttaatcacaacttctttgaaacttaacgaattttttt

SEQ ID NO: 26229 - DNA, 1219 bp, Heterodera glycines
aattctttcgccgttcggcttagggggtgatgaactttctgcccacaaaatttggtgtcaatcggacaaggtttgcgcgagttttgctgcgcaagtctcgggggtgcgcgagggggcggggcgtcgggaatgtactgctcgaaatggtgtcagagatgaaattctttcgtcgttcagcttagaggctgctggattgacgacctgtgaaatttgaagtcaatcggaaaaggggtgcgcgagttttgctgcgcaagtctcgggggtgcgcgagggggcggggcgtcgggaatgtactgctcgaaatggtgtcagagatgaaattctttcgtcgttcagcttagaggctgctggattgacgacctgtgaaatttgaagtcaatcggacaagggttgcgcgagttttgctgcgcaagtcttggggtgcgcgaggggcggggcgtcaggaatgtaccgctcaaaatggtgctagagatgaaattctttcgccgttcagcttaggggctgctggattgacgacctgtgaaatttgaagtcaatcggacaaggggtgcgcgagttttgctgcgcaagtctcgggggtgcgcgagggggcggggcgtcgggaatgtactgctcgaaatggtgtcagagatgaaattctttcgtcgttcagcttagaggctgctggattgacgacctgtgaaatttgaagtcaatcggacaaggtttgcgcgagttttgctgcgcaagtcttggggtgcgcgaggggcggggcgtcgggaagtactgctcaaaatggtgccagaggcgaaatttttttgccgttcagcttaggggtggtggaatgatggcctgtgaaatttgaagtcaatcggacaaggggtgcgcgagttttgctgcgcaagtctcgggggtgcgcgagggggcggggcgtcgggaaagtactgcttgaaatggtgctagagatgaaattctttcgtcgttcagcttagggggtgttgcaatgacggcctataaaatcccatctgaacttcaaaaaattcaatgtttacccccctccccactgttgtcacttaattgtgcacagcgatgcggacccctcccattccctagattcttatcttatcacccatctgcaaaggcccggttctccccccacccatcattttcttttcatttcttccgtttatatggattgcggacttttatttatttgttccggccaatattttttatattt

SEQ ID NO: 26230 - DNA, 1907 bp, Heterodera glycines
  misc_feature (1893)..(1893): n is a, c, g, or t
ttgtccgatttgcgccccctgagcgatgacttcgtccattgctgccacggcgcgttttccacgttgttgcaattcctcagccatgctcaaatgattgtctcgctcgcggtcgattcgtgcaccgatttcgctgagtccattcagcacggcatttgtctccattggcacttggagaccaggtcgggctgccgccttccgttccgccactctgatggctgccgccttgggtttttccattgcggccatcaattcttggcgcgctctttccttcgatgcgcgaaatgcgccctcagctgatgcgcgtccaccggcgaccattgaggcagcaacgcctccagctctggccgcacgtgcctgtccaccacctttgactggcagtggaatgatcggaggcgccgagcattccatagttgcttccgcgcgtttggcaaatgctgccgccttctttcgatccatctccgctttgaccagggcattggtctttgggcagcgagcctcgtcgccagacaaatggccaagcaatccgcatttgttgcagcgcgatttctgcgcattcagcgggcctcctatgcgcgctcgcttcacgaatggtccctcagctgccgccactcgtttggtcttcggtgcctccataggtccctgaattcgaggctttttggtctcttggacaaccggcgatggtgcggcactggccaccgctgcttcgagtgctgccaccgcttcttcctcatcgtcgtcgtcctcctcctccgactcactctccgaaatgtcgattcgaagcgcttcgtcgtcactttcttcatcaatttttacgaaacggacgacttgttgtttttgctgttgttgatggtgttgctgttgctgctgaacgaattcttcgctttcatccaataactttgaaatgtccatggtcggttggagttccggtggttgaagggggaggaataaggaaaggcaagtgactttttgctcctttccctcctccttatatagctgccgccagagggcagaggacacaattttgtgtccctgattcatgccataggcgcacaaaaacggatgactcatgtttgttcccttcattcggaaggaagcatctccatcaacagcgctcatcggccgatgattcaccgcctcttcttcgcttcccgggtgcacatctccgccgaagccgtgcagaaagatctgattcatcggcgcttctcgcattttcaatgaagaaggaccgcgggaaggcgaatgaatcagcgccgatggcaattgttttgcgccgaccgagtgaatcataataaatgcggacagcacaagcaaaattattttgcatttaagcggcccgatcaattcaatcttcgaattcgccggaacattcatcacaattgatcgttcctccgatctcggtggatctccgcgcatttccaccggatttcccgtcggactctcagagtcaatttcttggataatcaccgagtggttatccggtgagatcccttccattggattacccgcccccgactgtggagtgccatgatattccacagtaatggaactccccttgctgcttatggataaccgtttcggggatttttctccctctaggggtcccatgttgacagtttctggattgtcatcccatggcattcgggttccaaagtcaaacgggggatcgcgatcgaacgtttctcgtacttcgatcagttccaatgggtagtagctcacatggtttcgccctcctttctcacacagacatggagcctccgggaacatcaaattccggttgtgccgagtccgaaagtattggatgacaatcgggcctcgtccattgaaggcacccaattcatcggcaccgagtgccgtaatggtcgtgccgaagagaatcatgtttgcattctccgngtttcaaatgcgtg

SEQ ID NO: 26231 - DNA, 1803 bp, Heterodera glycines
taaaagaaaaatgagttcagattgaaattccaataaaaatcaaaatcccctccattaccagccacctcttctaaggttgcacatcgtattgttgtaaaaagttccacccccattccatgttcctctctgtagtgaagcgccacgccactaaaagtcagtccgtcaattatgaagctccgcattttaattgtcccacgacctgttgggtttggccagggattggccgttggtaggggtgaaaagcggcgaatggttggcaatggggagcagcagcagagaagagttcctgttgaaagtccaagttctcattgttaccttccaattgattggacgggaatagtataaaaccaaccctagcagcgcaaaagaaacattaaacagggtaaaaacattacttccctttgcatttttaattttattcgcataaggggggggggcagtgcacctcgcctagacaacgtcgccgcaaaaaaacatccaaataattgtttaaaaaattataaaagtttcttgcggtgcttttaacccggcgactttagctggcaatgttacgcggcgaccctttgttctgctccaaggggaagggggaggtaaagcccttattgctgccctctggctacgccctctgtgcctcctgttttgaaccgacctgtctttggttttgagaccacgtgttgacagcatcgacgggctgctgcctttgctgctgctgtgtgtgcccgtggctgctccctcgcgccccccttcgtcccctccaattaaaattacctcttctcatcccgccctgattttttcgttgccattttggacgttcttcatttaaaatagcggatgatagaaatagcaattaatggtcaaatttaatggattttccccttccccgcccttgaataaccgctgcttttattaagaaaatgcaaagaaacaaaaaatcttcggcgacgtttcgaccggcgcttgttttttcagtgacgttttagggtgtacagaccagccacccattttggtatggttcggcatcatcccaatgtccctccccccgctgaccattcattgtctgttctctttcgctgtttcgcttctgcagatgtttctgttcctcctcgcatattaatggcaattccaactcgtcaaattctgtgtgtctgctgagcacaactacaaaacatggatggccattgacctaaaagcaaataaaaattgaattaaatacgcaatccaaacaaccctttgaaataaaatgaacatctactccttccttaacccgaacggaaaatgagtataaattggttccattggatagagagcatagtctattctatcgcaatttttaatattacgcctccatatcaagaaaccaaatagttatggtgcataaaaaatccaaaattggtgcctgattttgtgtggccattccatttccaattttgttctttttaatgattccccaacatttccaattgattgtttttgtattttcgaggctcataactttttaatttatgatattgggggcgtgtatattaaaatttaataggattgatcacgtacccaatgattccaaaattatacccattctacagttcccttgtcagttggatcgcttgttagctttatgcgtacaatggatgactcacgtgtctgtttcgcaaattatccaaaatagtccgattcgggtcaacaacataataccttagaaatgaataattagttataaaacctattagtttttatgaacctcaaatcttctgattgttcatagttacagtttattttcaatttcatcgcttagagaaacctcca

SEQ ID NO: 26232 - DNA, 2228 bp, Heterodera glycines
  misc_feature (116)..(116): n is a, c, g, or t
cgatttgacaaaagttgactttgatttgacgattctgattcgaagcgggttaacctggaaaagaaaaaaaaatttttttttacgaattttaccagatagaataaaattaaattatntaaaaaatagtattttaaatttttcgtcagcgaattgtattttatttttcttggctttcaaaaaattttttgagtaatagcacaatttttttatgtcggtaaaaaataaaatattttataaaggttttaaaaatatacaataggcctagtattagccggaaaattttaaatttttttttattaaaacaagattaggaacccaaagaaaaagttaaaaattttcaagttaatacaacattattagagcaatagagaatgataatgattgtaaaaattagaaaaaacaaaaacacaaaatttttaactcaaatcaaatcataaaatatcaaaaagataaatttgttggatagaaaatattttttataaaacttttatatcagggctgcaattgaaaaaactcgctttccaaggacggatatactgcttttcaaggacataaggggcgcaaaaaattcgtgaaatccagggacgcgtaaaaagtttttatcatatgcatgaaaaattatgatttattatttttttttaaatggtttgttttttcgccggcattaattttgcgagagaaaaaatattaagattttaagaatttttcagctttaaataatatatttatatttcgagttgggaaagtttctttcttgaattttcaatttataaaaataattttatttgaaaaaaggaccaattttactctcgaacactgcgaaatgaatttgatttgcaattgtgtgggcgaaaatgataaagaatgagatttttctgggatttatgcgaaaaacccttgggttttccaatttttaatacatattttagcatgtatttgttggctttttttaatttagcacagtttcaggctttttgcacataaaaatcccagttctactcatattacaataaatcattttctatatttttaatttttattcagtaacaaaatgggttttccatagaaatgttttgaatttttcgaatgggatttgctgattttttttccaaaaattcaaaaatccaccattgcttgatgagcttgaacttgatgaacttgacttgcctggggccatttgggtgaaaaataggaacaattgccatgaaaaacccgcccgattccgcattattttgttcttttcaatgaacccccatgccttgattctttggtcccaacccttaccaggggatttttgggtgggcattaaggcccaaaaaaaaaaaaaaaactaaaatttttggcttttccccccaccccgggggggttaaccccatttttttttccaaaaaaataattggaaaaaaggggcttattttttttcaaaatttggccccctttttttaaaaaaaaaaaaaaaaaaagggggccaaaatttttttttaaaaaaaaaccgcggttattttggggggcccccccaccccccccggggggggggagaaacccccccccccaattttttttttttttttttttttttaaaaaaaaaagggggggggcgccttttttttttttttttttttttttttttcaaaacccccccaaaaaaaaaaaaatttatttttttttttttaaaaaaaaaaaaaaaaaaaaaaaaaaaaaaaattttccccccccccccccccccccccccgagggcggggggggggttttttttttttttttttttttttttttttttttttttggggggggggggggggggggggggggaaaaaaaaaaaaaaaaaaaaaaaagggggggcgcccccccccccccccccaaaaataatattttgtgggcgccccccccccccccaaataatatttatttttttttgttggagggggggggccccccccccccccccccccttctttttttataaaacaaaaaaattttagtattttatttttttttttttataaaaaacaacggggggggggcgccccgccccccttccctgtttgggtgtttttatatctgggggggggggggggggggtttttttttttttttttttttttttttttttttttttaaaggggggggggggggggggggggcgccccccgcccccccttttcttttagaattttttttttttttatttttttttttttttttttataaaaaaaaaaaaattttt

SEQ ID NO: 26233 - DNA, 1258 bp, Heterodera glycines
ttctatgaattgttaaagtttttacaaatttttttaaggtgcaaaagtggtggtgtctgcaaaacattttctccggggtttagacaatctaggaaaattagtaagcatttgtagtgttccgatacgtatccctgcacaatttggtgagcccctgatcaattccaaattatttatggacgatcaaatttttagaaattattatttatttttgcataattaattcataaatatttttttcagaaaattctttgaaacgcacccaatattatttacatgctagtctaggcactcggatgctttttctatcaaaaagggagatgaataaattttcggggggggggcgaaggcccaccacgaggccgcgaagaggccgagtgagtaccttcggtgcaggaaaattattaaattttaaaaattttttagttgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcacccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttt

SEQ ID NO: 26234 - DNA, 1520 bp, Heterodera glycines
agttatctcagaaatagtacttattttcatacaactttttctgagcttgaccaaattttttaaaattttgcaggctaatagagaaaagctgggctatcgaatggtaccaagaatgtaaaattttattgcctttaagcaaagttatgccatgttttatttttaaaaaatcgctaaaatggcggattttaccaaacgacgattacaaaatgaatatttttgaatttattagacaaattgccagggacttttgtggtccctgactacgaatctcacaccaattcttatccctaacccaaactcgaacaaaaattcctaaaattttaatttttcaaccttcggctttttgttcgaattcagggttagggacaggatttgattaaaattgtgtcagattcgtgatccagacaccccaaaaaccccgggtaacaaattttcatggttttttgttcatgttcattctttggtcacaccttgtgcatgaagtatttcaggatcatgctgatcagctcgttgcaacaatttctgcaatataattaatcggatgggatttatatttaaaatgtttttttttaattttacaataaataaattgtacgacaaaattttgaaatttcgatttttggacatttaagaaaaaatttcttgtaagatattttaaaatttagaaataaatatacacgaaaaaatgccaaatacaatgcaaatttcttatttttcttaaatatttgcttaatatttcagattttttacaaaattttgatcattatttcggcgatttttcgtaaatatggaatttatgtttattattattttattttttttttggttaaatttttagtaaaaaatcgcacggtaaatttttgaagtttcaggtttttgggctggtcaatattcgggttttttttttacaatattttgataattatttcggcattttttcgtaaatatttgtttttaaatacttcacaatttctcataattataaatccctgccccaaaattaataatcgccataaaaaggaccatttttaatttttggatttataaaaaaacaacaacaaacatctaattccactgtaagatgaactatttttttcgcatttgtaaaaaatttttgcatttggccaattttgagtcccattaacatgcataaatattttaaggcatcattatgagttgggtcaattgcaagcgcctcattagcgaaaccaatacctaaagagagcaatttatgtgtaaaatcacaaaatgttgcgcataaaattatattaaaaattgaatatgtaaaaaaaaagtgttaattatgcaacaaaaattttcaaaatggaggacaaaattttccaaaatttctttgaattcattaatctaaaaataaaatctttaaaattgctcaatttggcatgaaaaatcatttttgaagaaaaaaaaaactaaataaagtagtaaaaatttttggattttgaataaaattgagtaagaatgaaaaatttttcagttttcaactttttttgacataaatt

SEQ ID NO: 26235 - DNA, 1508 bp, Heterodera glycines
tgaggtctaaacaatgacaaaagtaaaatctgattacgtattcatgatcagcggcccaaataacccctaaatacatatttttggaagatttttgtgagaaaaatttttccactcaaaaaccatgtgctcccccctttggtcccgaatcccaaaatcacttttatttttgtatctttttttaaaaaaatgataaaaacttgaaataaaatttatcctatagagaaaaaaattgcggatttttgtagtattttacttttcacgagtgacttttcagaaccgagttctgattttttttctgaaatttcgaatttttccagatattctggaatatcttttttatttttagagatagaaattccaaataaatcctataaaattctcctgaattttctctatttttaaagcattattatagttaaatcgatgaaaccatcactgagttatgaattttccaatattatacaaaattccagagggccaaaaaattggaaaatatttttgaatttttaaaaaattccaaaaattccgaaacaaaaaacaaaggtcatattcgtgctcagcacctcaaaataccccagaaaaatatttttcacccgcattttcgtccgaaaaaaaatttccgaaaatttctagggggcctggctcgaaaatttttgaaattttctcgacctatcctacaccattcgatagcattttgaaagctctacaattttgctctaaggcaatttttcgctaaaaccaacccccgacgagttatgggcccgggactcaaatgtcccgctcaggccaaaaattttttctatttccggaaaaaaatcgaaaattttctaaaaatgttgccaatcgatagagctcgaaaaacggttgcttgaaagtggtctccgtttttccgggaaaattcgttaaaaaatcataaaattcaaaaaccgaaaaaccgaattttaggcctaactcgaaaattttggaaattttcgaaatttttaaacatggttcgatagccctttgaaagctctacaaaaagtccgctggcgactacccgctctgagcaaaccctggtgcggcattcagctggtactgaagtgtccaaaaaaagtagttcttacgttgccatttttccaggccaggcctttggtctgatcaaaaaacttttgctggcaaagttgtagagcacagttggggggtgtgccttttggggtccgctaagctctgaaagcaaaagcaaaaaatttcgtaacagtgagactgtcggcaaagttggtttttgagccgctggtactcagttggcccttggaccggaaaacctatagttttcccagatgccccgtctcgagttaccccttggtgcaaaatttcagcccggtgtgcttagccgttcccgagattttgtttttacaaacgaaaccccttaccattctaacatatatataactagcgggtgcgtgaaccgtcggctatttagctgggataaagcgcttcgcgcttcttgagcttcgctacctagattagct

SEQ ID NO: 26236 - DNA, 697 bp, Heterodera glycines
agagagagagtgagagagagagagagagagagagagagattagagaggagagagagagagagaaaggagagagagagaaagagagaggagagagagagagagattagagaggagagagagagagagaaaggagagagagagaaagagagaggagagagagagagagagagaggagagagagagagagattagagaggagagagagaaaggagagagagagaaagcagtgatagcaaagagggagagagagagagagtttacgcacccgctattaattattagtaagtataaattgtatggatttctttacaaattttttaaagtgaattttttcaaaaatgagctagttttgcgtcaaattaaaaaattctagataaaataagcctttttggtctaaaattcaatttatgaagaattttaagaaattaagaaaataattaagtatatcaaatccaaaatcaaagatgtgaacatatataaagcccctgattaaatgtttcgtagcaccgaggaaattttttgacaatttgttgggttttgttaacatattttgcccaaaataattttatttgagcgaatattttggagaaaatacataatgagttttaattattttaagttttaagaatgaattttaaaatggcagcttcgaaataaataaaaaaagaaagaggaaatgggccggcggtgaaaattt

SEQ ID NO: 26237 - DNA, 922 bp, Heterodera glycines
catacaaaatgagattttaaatgtggcaaatttttggcatttgttcgcttccgaaaattttcgctcaaaacagaatatgattattccaattgaagctagaattgagaaaattgacattttttaaggtttgaatccatttatattttggtatagtttatatttatgtcgatttttggtgtttcttagtccatctaatttataatcctaattattaggtattatgcatataacgtattcacagtaaagcaactttatctttaaaaacatccgataggaaagatggaatataataaaaaaagaagatagaatcgaaaacagaacaaacaataaaaagaagaaaaaatcccagccagcccaaaagatcactgcccaaatgatcagtcggctaacgtatgacgacgattacgatcgtttgcaagcacaaaagcaaaacaaaacggcaagaatcagcacaaaaaacaaaacgattccaatcacgataatttcagtgagaacttttgtcgtatggtaatgaccatatttacgataatgaatatcaatgttgccctccttcgagtatataacggaataattaatcaaaaagccagtgcatataatggaaacaattgttgcagaaatacagccacccattgtgctgccatcagcacgctttgttcttcttatgttcaaccggcgattgtttttttggtgtgaaaatggatggttttttgctgaaaaaacaaaaattattcgatgaataagctttagctgttcaacattaaatccatcaagaaatggtgagaaaaataaacattttttctacaaattgttgctgtttttgggttaattcacaaaaaggcagaatttaaaaaatctgattgatcgtcattaaatttgtttaaatttcagtttatgctgcatattatgatttgtaaattttgag

SEQ ID NO: 26238 - DNA, 1067 bp, Heterodera glycines
ccgcagagcctcttcaaattttttccattaccgcaagagctgcggaaattgtgaattaattctcagaaaaatggctatctcgttttaggacaattttctatctcgtaaccccgatgctaatctgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatctgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagctgcggaaattgtgaattaattctcagaaaaatggctatctctttttaggacaatattctatctcgtaaccccgatgctaatccgttccgcagagcctcttcaaaattttttccattaccgtaagagctgcggaaattgtgaattaattctcagaaaaatggccatctctttttaggacaattttctatctcgtaaccccgatgctaatccgttccgcagagcctcttcaaaattttttccattaccgcaagagctgcggaaattg

SEQ ID NO: 26239 - DNA, 1586 bp, Heterodera glycines
attcgaatttggcacttttcctcggcattattggcgttttgcctttctcctcccttcggcttacccattcatgtacaaatttcgctgaaatgcgctctcgagaatgttcagctggtcaggggcgaaccaagttctgactcggcgtggtggagaagcatcggaggattggcgagaccgtcctgctgaaaaagttttaaatttattatttcgattttaaaattaaatataattcaccgtaattttgctgtttttggtcggcatttgccccttcttcccccaatatcactgaaatgctatgctttaaatggccttccgccgggtgtcgcttttttctttgtgtgtctttcaccctatattttaaaatatttatttgtttatttcatttattgcctttttatagaaaatttcttcgccgccggcagcgaatgattaggcgaagaagctgccccgggagaaactgagcctgaaagcttaattttataaggccttaaataccaatttgctaatgcggcattgcctgtttcagcaaatctgcacagaattttggacacgcatccgtgggaaacctaaggcaaatttgggactggcatatgaatgtgtgaccaaattaatgaaaataatcacctttaattgccgactaatttggcacggcctaaaagaacggaaaataaaggaagagatgccgaaccaatgaagggaaactcgtttgatttttgcaaatggccaacttccgtttcccttccccccccccccactcacttcactccttccattgcccatttggatgatgtgaagccgagtttggtggggcagcggacgaccgttgatgaaaatgccacccaattggttgactctgcccttttaagaggcacggagaagtatttatcaaatgctaattaattcgttttgaattgtaatggtggcacccctcccctcccccccccctccccaaatttcgtcacttttgtttgcatttaattacacttctctccgtgacgacatttgccaaacattgaactgattgaggaaacacgaagacgaaacaaaacaatcatttgcaaattaatttcacaaaaccccaacccaaaaactaattaaaatatgaaatgccaattagaggcataaaaatggttgatttttcattaattttgtcacctgtcctattaatgaagagaactgaaataattgctttgtcgttgaaattggctgctgatcaatgggatttgcggagggaaaatggccaatcatttaggaaaaagcgcggcgtaattaagtgaactaattggctaaatgtggcaattatcttttaattaggcctttttgcgctgatcatttgttgtgaatggattctgtcgggaaaaggtcatttcgatgtttattttatgtctgttgtagtgcttcttctgcccacactttgccatcttttgctcctttaaaggcgcccttttggtgacagccgaccgaccgccgatcattcagccgttttttcataagacaaacaaacactccgcccattctgcccaattttgcgcgtcgctttgtgcctgccattttcccgccccttctccgattgccccccccccccc

SEQ ID NO: 26240 - DNA, 1586 bp, Heterodera glycines
  misc_feature (34)..(34): n is a, c, g, or t
atgtaaataaaattttttaaatggtgattttttntggggaataattctttctaaagggtgaaataggcacaaattgtcataaaatgacctaaatagacttagaatcatcttttagtatttaaaaaattaatttttgatatcccatttcaaaaaaaaaaatttttttggagcacattttcacaaaaaattctataaattctcaaaatttttgaaaaaattgcgaaattttggatatttttggggacatttaataaaaaaaattccttaaaaattctcaaaaaaaatctcaaaatatgtaaataaaagtcgcgatttttgttcgcaaacacaaaaaagaaagtgtttttcctactaattaggctatggagaatccaggaaaaaacatgtatttgcataaaaaaagaagccctgaaaatgaaacattataaaaattattgcatcatgaaaaatttcaaaattttcaatttaaaaaatattttttagtgaattattaaaatgtaaaattgttcattcaaaaaaaattaatttgaaaaaatattaaaaacattgcgaaatcactaaggattacaaataaagcttgaatatttgttacagatttttcatcgttccttcatcatgaaatgccatgcagatgactttcgctgggaagccaatgtcaaaaatagcaaaattttaaaacaaataaatacctgataaggatttttggcatgtactaagaacaatttaattatttattttatttctttgtaaatgaataaaataaattaatttatttaggtagttgcttgcctgtcgccaatgggtcagcgaattccgattggtggacgaacccaagatcggcatggaaaatggaaatgcattcaggaagccaatgcagttaaacttgtccaggaactttgaaaagcacagcaaaatatgaacaatttacacgaatgaacggcttaaaaagatgattaattaataaactcaatttattttagtgtttttttaaaataaaattcgtgtgactgaaagatcactggtgatcaggcccggcggttcgtttcgacagggcggagtcgttatttaaaaacatcataaggggcgttatttaaaaaacaactaatatgaaattttttgggctatgactttttttaaagttaacaaaattttttgaaaatttgcaagctaatagtgaacacttagagctatcgaatgttatcaaggattagcaattggttgcattagagtaaagttataggcaaaattatttattttgttggttttttaaataacgcacataatggtgatatttaaaatacatgtaataaaagttacatacttaagttctttaaaataaatatttttattgctataaaatctatttaaggttgacatataataattatatttatttcaaatcatctcaaaaaaaattctaaacaatccggcaaatggaatggaatcagaggaaagggcatgaagcataagaaagtgtacatggttaggtgcaagacatgaatctcacagagatttatgcgactcgcaacaatcgacaacccttttattatttgccagcaatatcccatcgaatgacgcaccaattt

SEQ ID NO: 26241 - DNA, 1449 bp, Heterodera glycines
  misc_feature (14)..(15): n is a, c, g, or t
  misc_feature (1307)..(1307): n is a, c, g, or t
attttatgtcaatnntatttttagggttcatcacagaacaatgatttccatggccaccaaaatggtgaactttgacacaattggaaggaatattcaaaagttatttcaatattttacttttgtcaccagtagaagccgagagacggaatgagacgacggccaaaagcacaatcagaaggattttgaaaatgtttggcattttttcggatcttttaatattttattactgtgccgcgttgatttggatgattttcagttaacatatggacagtatttatatacatttgctctcttttgcttgtctcgttggaaaacaaattggtttccgatttgttgatgttattattaattttcatatatttttctgatttcctccgacataatcgacaaaactgttgttgaattaataatttagatataatttttctactttcgtgtaattgttttgccacttttaatttttttatatttattaaaaattctgaaaaataatttaaaagtggcggattaaaccgctgggttgctcttcacttccttgttccaaattaccaccatacgactttaactcatttttaccaggctccaccgcctcgttctagtggtcaaaatatatacatgaatatgtaaaaaaaatcatgaaatatgtacaaaaactcaaaatatgtaaataaaattattgtaagagagtctggatttgtaagagatttggattattcgtttaactgccgaagcgctaggatttaacatttacacatttaatttatctcacatttaatttcctttttgcttaatgtaccgccccttcccgacgataattgatcaatcacatttcactttcatttgtatttaatgttcgccatttttctctgtaatcactccagtcactccggaataatgccacttatcccagtaagtgtttccatcaaaggcgggatgggatccctgctgggcttgatcaccccatggggcctttccttcgggagtttatgagtgtcctatccctccccaatttggaaaccccagtgtcccaatgccagcacgccccaccgcgcacggacgcgctcctttattttaaagggttatattttaatatgtataaaaactaccaaatatgtaaaaaaaaggttgtcttcgaagtttaatgaaacagttataaatttatggaaataaatttttaaaaaaaacataaaaaaaaatacaatataagcaagattattgcgaccccttttattgtttcgacaattctaaggaaattattcattaggtacaaatcgatttctatttaattacaaaaaattcccatttcnccatgattcaaaaatttagaaacggatagctagagcgctgaaagtttgcagtcgggcctaacttttggtgtgcatctcctgaattggaaatacatcgaaaatcccaatttcgatttaaactttttggttcaaaatcggttta

SEQ ID NO: 26242 - DNA, 1480 bp, Heterodera glycines
  misc_feature (30)..(30): n is a, c, g, or t
  misc_feature (68)..(68): n is a, c, g, or t
aaatttaaggcaattactaaaaattaaaanttagaaactctggaccccaaaaggtgtccacattttgntgagtgccaaaatagacttacgattaaggattcatccaacgcttctcaaccgatgctcaccgttttgtcaatcgccggtccaaacactttaggtatgttgatcactttttttgtatgataaatggcacatccctaccataggcttacattggctgcttccccaatatgttttggcggcattgtccgaaattcttctctcaatcaccgctttggaattttgctaccttcaggtcatttttctggttttgatcagaaacaactttgctatataataaaaaactgacaaaatatgccactgggatttttttaaattataaaagaccaaaaattttcacgacaatactcaaccacgagaaaacaagaataaaaatttagttttttcttgtgccaattttgggtatcctttttcagtggcacttttgtatgatcaaatagtgcatttttaggcaccaatttcgctgaaggcgacaatgattaggtaaatggaaggatgcatttgctgttgtatcgtatttcgatttttccactgaccgattcagctattggtttctgatgatctatatcggttggtccctggtgccactgtttgcgcgtttacaatggtcagccgatccggtcggtggtctacggcattttggaaaatttcatttttaatatcgtttatatattttttttcctttttattgcacccttccacgccagctttacatccctccctattaatttctcaggctctatttgaaagctttattaaaaaattagcatcattttttgtatctcacaaattttcacggcgctccaccagttgccaaattcttaattcttaaaaaatctacccaataatttcaggtcccgggatcacccatctttagactggctctctattttgggagggttcattcttctttttttaatctcaaccttatttatcagacctcactataaattaaatactaacctaatcgctgttcgcaaaatttaccacatcaatagatggtgcagcttgtggttgctgcttgcgccatgcttacagccggcgccgtgttcgccgggttggcgcactttcgctacacgtacaaagaccgcctgccgttatacgatggtggcggtggcacgacggtgggcggtgcgccaaatcggaaggcagccgcacaaactagtgccgtcaccggtggcgcactgacagaaatgatcagcggactgcgtgccagcgtggcgcggctgaccaagcgcagggtgatcagactatgaaggaatggaaatggtcaaaatatgaaggaaagaaattgatcggaatatttaaaaaataatgaacattggtttaagaagtgatggtttgagtggaattttaaataaatttgataaaaaaataaaaggctgccatcgtccaaggtcggcttccaaggacgggt

SEQ ID NO: 26243 - DNA, 1369 bp, Heterodera glycines
tccgtcctaagaaacagatgatgttcagcagaaatttcatatatttgccagaaaatgccaacccaattgatcagagagacttaacacatggcactttgaatgccaatttaaaagcacagttattccgttcgctgcttacgtggcggccgggtcaaagtcggcccacacgcggatgaactcgtcaagatgatgaggcccaagaatggacgaatcccttgtcagatagtcaaagttgtccatgatcacagccacgaacaaatttaacatctcaaaaaataagggtttgaaaaaaaagtgtggcgcaattgaaaataatgattttttgaaaatttttacaagccaaaggagagaccattttacttgtaaatttatttatttttggtcatagaaaaacgagaaaagtgttctcgtaggggtttagaggttcactataatcacggtgaccaattccgaagaaaactcgaacaagtcgaaatttgcaaggtttggggttagtaattagcttccaaactcaggaaatcccgcgggatttgaaaaaataatatttttttaaggcaccaaaattttacacaaaattgttttaaaaaaaataaaatattgaaattgtagaaaaaagttagttcgaaatttcaaacattgaaaaaattattttgagaaagaatcaaccaataaatttaaaattttcccaccaaaaatgaggagaggaacacaaaagtgacaaagtatgcgtagctcatgttggtgccgcatggttgtggaccaacgccggacgatttgtccaacatttggagtgccatcgacgcattcgttttggcacaaggctttccagctaaaaattaattgaaatgtatcaatttagatttttctcaaaatgtactatttatttttggattaattactcgagatctatggcctcggttctcgagtctaaaaattttccttggtttttgggtttggtcccgagtctattttcggtctcgacatcggttctcgagtctcagaaatttcgattctcgagcaaccctactgattaaacatcatttttaggtagaattttatttgattgcccttaaaatgtttttgatttaattgcatgaaattaacaaaaaattcatggacatattataaaatatcaaatttttaaaatgattttatcaccagttgagctcaacataatttcttgccacgcctcgcccgttgcacaccttaaaaaaacaaaaataaacatgaggtataattttcaaaaaatatattaccgaaataaaaggataacagcattgaaaaatgaaagaaaattgttgtgccgattaatttcactggatggatccaaaaataatcatttttgtctgatttttttttttgtcttttg

SEQ ID NO: 26244 - DNA, 1177 bp, Heterodera glycines
  misc_feature (1047)..(1047): n is a, c, g, or t
  misc_feature (1063)..(1064): n is a, c, g, or t
  misc_feature (1155)..(1155): n is a, c, g, or t
ttatatttagaatacatataaaatatcttattcttaactttttaggactttaaaagaattattatcaatatttgaacaaaaattcatacaataaaaaggtagaattacggcaaattaccataaaaattataatttttaacaaataagaaatgttaattaaaaaaaccataaagcaataatagaatttttgaaaaaaaaactttaaaatataataaaatattcctgcacatgtaaaatccgcaaacgagagtagcgcaatcaaagcgatgtcttcgattataataataagttttgttttaataataatatttttaaatttctaattaataaaaaaataaattgcagtgtgccaagaaaagctgggaattctatcagatattgttaaaaaattacatttttgtatatttttttatatgcaaatcaataatcttattaaaaatgttttttttatttgttgtaacattaaaaaaaattagttttacttagaaatttaattaaaattaaataaaccaacttaaatctcaattttaaagcatggatatagcaataaaaaaataatatgaaagcaatgtcttatttgtgaagtaatgttacctaagtaaaatttgattatatggaataaaaaattagaatattataaagaaattaagcgtattgtctctttggcacaaacaccgaacggtattgtgattgccatggccgtacgattcgtgatttatgccataaattcaagaaatttataaccaaaaatgaaaaatattataaacaaaattaaagtcaattttaagtaatttaatagctgaatttgaagtaaataaattataaaataaaaaactaattaatcaataaaaaatgtttgtataacttatgctaacctaattaaaaatataaaacctaaaaaaaataataaatcattactttatatagttataaaattattatatatataaacattggacgaaatcaatttattttcaataaaacgcatattaataaattcattattttgtaaaaaaaaataacaaaaatcttattgaatgaaataanaattaatgctattaanntagatacgaattgtttcactttttatgaaggtaccaatcactaaataaggagatgattcaattttaagtagggttaagccccgagccttgngggagcaaaagtcgggggccgg

SEQ ID NO: 26245 - DNA, 808 bp, Heterodera glycines
tgtgggcttcaagtttgaaaattaaaattttcgtcggatttaatttttttttttttttggatcgggagtgagaaagtttttattttaatttatttttttaaataattgtctagttaaaatttattatttttcgtgaccgaattaaattgtataattaaatttaaatatttttattgacatgaggattattttcggttcgcccctactgagacatttcggttcggcccccccggaggctatttttttcggttctctcaccacgtgaaccgattgtatttaaattagagcgaagcgggaccgggaattcattaaataaaacatatcactatttaaattattaataagaagaattcattgacttgtgatatgcgactctctcaaactaatgaagagagctttctttcccctaaagttgggattgaaagaagtgcaaagggcgccctgtgtagctcagtggttagagcattccacggaaaggaagggacgtgggttcgaatcccaccgcaggctgatcttttgcacttacgccatccgccaataataccacatggcgctcctgggtggattatcgcgtctgtgttcgcataaatggaaactaaaggcctaaattaactggcatgcgacactctccactcttacgtgccggcgtacgacggcatataaaagagaccggggaccggtcttctcaagggccggagatgtgatatgcgactctctcaaactaatgaagagagctttctttcccctaaagttgggattgaaaggagtgcaaagggcgccctgtgtagctcagtggttagagcattcc

SEQ ID NO: 26246 - DNA, 1459 bp, Heterodera glycines
tgtgtggaaatcagtatgaaaatgatttccgtgatatcaatcacacgacattgtccgaacgcggagcgttacgcgaagcaatgcgatgtttgtaatttatccgcaataaatagtccaatatttttaaaaacaatttattttcaattattgaagaaatatttgtccagcattaatttcgcacttccgtaccctgaaaaaattgttagttgtctatgatcaaaatgaccgttgcgtggaaaatttttctggaaatctttttttaatccaatctaaaaatttaaagccttgcgggaattatttatgcacattattattgagtataattaattaaatacatatataaaataataaatttaaggcttaaaatgtgcggatgcgccatgtcagaagagttgtccaactcaactggacgtaaaagcatttatcacaagcattgcgaataaagtaaaactgatcatatgattactataaaataatttttttaatttttatttttagaattattatggcgctgctcgacaaatattttcggacaaccctttagggtaatttaattgaaatgctgtaaaaatgagtttccgctgaaggttttcggtgtgctgaccatgatttatcgaacatctatttcaaccacttccaaatcccaagacgaatgcgaagttcggaattagaaaaaataaataaactttgatttttgtttcgaatttggaatcggaattggccaaaataggtgtgtgatttttgattgcaaacccttaactctacagtccctttgtttagaattaatttcaaaatttactgcaccgaaaacataaataaattttaaaattgtaataactaaaaaaatatttcctatttaaaaaatttattgcatataattagtataatattttattgtaggcttacttgtggtatggtgtgtccaacttctgacctctgtgttggctcatgtaatttgtatgccacggaagaaggtgccataaacattggtggacttcaacaatttgccactgaagtaaaaaaacaaacaaataaatttccctaaatgataaaaaacaataaaagttaggatttaataaaaaattaaatacattttaaatatcattttcattatattatatgtcccttattctaagataggaatagaaacttatgcaaagagcttttaattatatcaaatatttaaattttggtttgagtttttcctttttttatagttagccaaaagaaggacataaaagtaaagattttgaagagttttcatgattaataaaaaaaataaatttttaaataaatttaaattaggttttcatgaaaatgaacatccatcaaattgtgtgccgtgagattgagcagggccgaaactctgctcacagtcagccggtggcactgtttggctgtggacctgccagtatttaatgggccacttttcttgcacgacttggctatacggacatta

SEQ ID NO: 26247 - DNA, 1668 bp, Heterodera glycines
  misc_feature (1478)..(1478): n is a, c, g, or t
  misc_feature (1568)..(1568): n is a, c, g, or t
  misc_feature (1604)..(1605): n is a, c, g, or t
aaatttttaatttgctttttaaacatgccaaaaagtttaggcttaaataaaaaaattttcttcggctctagctcttcaataagcaataaaatcgtaccaaattttataggcatactccccggtacaggactaacttaacctgaaaaaatgacaattgtaattgattttaaatttttttagaaattctgagtttttaactgtttatttatttttttacaaaattaattcataagtatttttacagaaactgctctgaaacgcaccaaattttatttacatgctagtttaggcactctgatgctttttctatcaaaaagggagatgaataaaatttttaaaaatttttaattcctttttaaacaggccaaaaagtttaggcttaactttttttcagaaactgatcagaagcgcagcaaactttgcagggatactgaaaggaagagaaataacctattttaaatattatctagtcagttcatttaaataatttttattcaaaaaaatttttttttgggttttcggggcagtccccctgaaccgatgttaggcttaactttttttcagaaactgatcagaagcgcagcaaactttcagggatactgaaaggaagagaaataacctattttaaatattatctagtcagtttatttaaataatttttatctaaaaaatttttttttgggttttcggcagtccccccgaaccgatgcgcccagatttttttcagaaaatgctctgaaacgcaccaaattttatgtacaagttaaataaagctctctgatgcttttactatcaaaaagggagatgaataaaatttttaattgctttttaaacatgccaaaaagtttaggcttaaattaaaaaaattttcttcggttctagctctttcaataagcaataaaatcgtaccaaattttataggcatactccccggtaaaggactaacttaacctgaaaaaatgacaattgtaattggttttaaatttttttagaaattctgagtttttaactgtttattattttttgcaaaattaattcataaatattttttcagaaaatgctctgaaacgcatcaaattttatttacatgctagtttaggcactctgatgcttttactatcaaaaagggagatgaataaaatttttaatttgctttttaaacatgccaaaaagtttaggcttaaattaaaaaaattttcttcggctctagctctttcaataagcaataaaatcgtaccaaattttataagcatactccccggtacaggactaacttaacctgaaaaaatgacaattgtaattgattttaaatttttttagaaattctgagtttttaactgtttatttatttttttacaaaattaattcataagtatttttacagaaactgctctgaaacgcaccaaattttatttacatgctagtttaggcactctgatgctttttctatcaaaaagggagatgaataaaatttttanaaatttttaattcctttttaaacaggccaaaaagtttaggcttaactttttttcagaaactgatcagaagcgcacaaaactttgcagggnatactgaaaggaagagaaataaccctatttaatatnnatctagtcagtcatttaataattttattcaaaaaatttttttttgggtttttcggggcagtcc

SEQ ID NO: 26248 - DNA, 1775 bp, Heterodera glycines
  misc_feature (94)..(94): n is a, c, g, or t
  misc_feature (145)..(145): n is a, c, g, or t
  misc_feature (155)..(155): n is a, c, g, or t
  misc_feature (168)..(169): n is a, c, g, or t
  misc_feature (206)..(206): n is a, c, g, or t
  misc_feature (260)..(260): n is a, c, g, or t
aaatagatgtcagaatcgtgttcaccatccaactgtttctaccactcgtgtgcgttctcgcctcggccgcgtcgctgtcgatttgcagtgtcgntcatgttcgttcacgaagtgtcgtcgtcacagatgagcaaggggaggcgancaccagtcancagaagcagattnngtaagtgaagaaaataatgatggattactgcaaattnttgcctatttatacacttagacagcgttcaaaaaacgagagatgaccaataagnggagatgccagagaaaaaaaataccctctcattttgatgttctctttctttgtctctctgttaatagagaaaaactaaattattgtgggcacattttgacgttaaaaaaatattcgaaattcgtcggttggaccttgaatttcgcgttttggcacaaaaattgggctaataaaacgaattgaccaaaaacgaaacatccttcgtccgcctatataaagggaacggttcgaacaaaatgctctcattttgcgtccgtcagtattttcatcattgttttctatttgccagttgtgtcaaagcatcgttctgctccttcatcgatcacagcaaacggaagaagtcgtcacacgtggtggcatcatggagaaaatcgtctacttaaagctgatgcaaattgtgctcactttggcattcatttggcaactcctttcacttcaccaattctgcggcacttttgccgacccaaaggtgcttctgtttttgttgccaattcatttaacaatgatatgcttttcaggccttcatccatgacatctcagttggccgttgcaaacgctttacgctcattggaaaggactcaaaaagcggcgaatttggcgctgtgttcgaccaggacaaatggcacaaccaactgtcgatgatcagcaccaatggtcgaccaatcgaagaacagcaacaccaattcatggacgaattagccgcgaaattgccatccgctgaacgccattgcattccgataacggtccgccagcaaaacgaataataacgataaattaattttcatttgttttttcagatttcgctttttgacgggattggcaaagacatgaaccccctcaacaatggcactttgcgtcgtttttccctcctattgtgggccgcattttggtcgcttcttccccttggcattgccaccatcatagtgctacactctgtggaacaatataaaggagtgagcgcagtttgtggccacagcaaattcaacccgacaaaatcgcgtccaaaattgcttttcagtcgaaattcgatggatttttttttgaacaaattaaaattaatttttgtcgtttgcatttctgtgttcgcaaagtgtcaaagcatttaccattgtgtcgattaatttgttttgtttttaagttccccttctatttcaatgccttcgcttctatcttcttctggtgtgtctctgctgcgttctcaaccaatttgctgctttattggacgagcttctggacttgcgtcaacttccaagcggaccacacaaatgtgccgttggtcactttggtgtgtttgttttttggcatttattttgcgcatttttcaactttgaggtgctcagcatcgtcatgatgtgttcgtccgtctccgagattttcttcatatattcgctgcgccagaagaagaagaacggaagtgccgtcatcatgtgaacaataaggccagagacgaatggaaagatgctggtgccaacaaacataaccaatgcggcaatgaaacgacgatgttatgaataaa

SEQ ID NO: 26249 - DNA, 1510 bp, Heterodera glycines
cgtcctgaggccgcgaagcggccgaatatcccacaaaaaattaaaaaagggcgcgaagcgcccgacctgaggccgcgaagcggccgaatatcccccaaaaaattaaaaaacgggcgcgaagcgcccgtcctgaggccgcgaagcggccgaatgtccctaaaaaattaaaaaacgggcgcaaagcgcccgtcctgaggccgcgaagcggccgaatgtcccccaaaaaattaaaaaacgggcgcgaagcgcccgtcctgaggccgcgaagcggccgaatgttcccaacaaaattaaagaacgggcgcgaagcgcccgtcctgaggccgcgaagcggccgaatgtcccccaaaaaattaaaaaacgggcgcgaagcgcctgtcctgaggccgcgaagcggccgaatgtcccccaaaaaattaaaaaacgggcgcgaagtgcccgtcctgaggccgcgaagcggccgaatgtcccccaaaaaattaaaaaacgggcgcgaagcgcccgaatatcccccaaaaaattaaaaaacggacgcgaagggcccgtcctgaggccgcgaagcgggcgaattccccccaaaaaattaaaaaacgggcgcgaagcgcccgtcctgaggctgcgatgaattgctaaattacatcaatttctagcgacgcggcgaaaacgcatccctgatcgcgaagcgctttctcacagcaccaaaaacaaaactgttcacaccattgccaactgtgcaccctagtttctactctatatagaataatctcaggactcgtctctaaaaccaaaatctcgggaacgggcgccgggaggggctcgggagtgtgacatcacttaaccaacttttgacggcgcatctgggaaaaatacgggttttccggtccggcggccagttcagcgccagcggcgctgaaacggcccaaaaatttttttgtccgtttttgctggcctgtatctttgcgggaagaagcgggagcgaaaaacgcttggtgggaggattttaagttggagtgtttgggaaaacttggcgtttatttggcaggcctacctgcaaaagcctggcctgtacacgttggcaaaatttgaaaaccatttttggcgtttttcgattttcgcgaataactcgctgggggttaagcggagcgggttgacgccgcttgagcatttgtgtagtttttaaagctgcatccgatggcgctttcagattttgaaaattttgaaaatttttcgagctaggccccctcgaaaatttttcgtttttgaattttattattttttgccgatttttcccaggaaaacggagaccactttcaagcaaccgtttttcgagctctatcgattggtggcatttttaatttcaaaattttccggaaatagaaaaattttccggaattgagctccccatttccgtttgaggcttataactcgtcaggcgttgattttagcggaaatttgtcttagagcatttttgtagagaattttaagctctatctaatgtgctttatctcat

SEQ ID NO: 26250 - DNA, 1224 bp, Heterodera glycines
aattggcaatgctttcgccccgtttcgatgctcttgtggacatccatttcgatggcaaaacggaattgacactttggagaccaatcgcaattcgcaacagtgtcgcagcagtgccagaattacatgtgtttttcgacggtgccaacaaatccgtgccatttccattgcccgacgcccattcgccgccgatgccaaacaacattcgttttaaggaccttcgaattaagtaattggaaaatgaaaaacacttaataaacaaaaagcattcactctttttcagttgcattgaccattccgtgatcacatttcttcgtgccaatcaactcattttccaaaagggcaccaatttgcgtctgtcggttccttttggtccattcaacattgatgatgtccagtcaatttgggatgattttgcgcgtcaaatttggcccatttttgcaccaaccattcgacactttggctttcccgattgccatattttggacacattgcttcgtctcgtttcgccgacaattttcacggatgatcagatcaacattcattcaatcaattccggtcgtcagtttcccgaagcgattggtgatgatcattttgaggggccaacaacagcaacattagatcgatcaactacaaattatgatggatcaattgcaacttctgctgctgctggtcaagcattgtcaaaatggttgcacatttcgagaaaagatgggcagccgaagcaattgcgattccgcaattttgccaatccgccaaacatggaatggcaaaacaatttcaaagaggtgtgacaatatttgttgactctactgcagtttacgcgtccaatcgacttttatgagtccaatcttcaactttttttggccataacttacgttcttacttggtcaatgaccacattcttggcatccaacaaaagattgaagtctgtagaatattttttttatacctaaatttcgaataacaaaaaagtatggccaaaaaaactgaagattggactcataaaagtcgattggaaacttaaactgtaatagagccaaatattgagccaaatatttttgtttagcgactgctgtttttatttgccctttatttcatttccatttttgtttagaaatttctgcgtgccatcacttccgccagctacaaaatttatttcaaaacggacgcttcatttgaaccatttgaattggtgaacgaacgaacgcaagaaaagctgacatt

SEQ ID NO: 26251 - DNA, 1541 bp, Heterodera glycines
  misc_feature (63)..(63): n is a, c, g, or t
  misc_feature (66)..(66): n is a, c, g, or t
  misc_feature (85)..(85): n is a, c, g, or t
aaagttacggatactggctggcccccaatgtccctatcacactgtgttaatgttatttatatntgntctattacatcgaccccancgtagagtgtccatctttgtaaaatatctgtacaagcgctcctttattgtccgattgcccctttcaacgactccgggcgtgaggtcaggactatacatcacatttttgataataaatttttcctcaaaatattttttcatttttccagcctgaaactcgagtccgctgtcgctatatattttcatcgggataattttcgacttttcgaacacccgatcaaaagcctcaatcatgtcctcactcttctttgacttggccggtgcactgaagatcattcgactcagcacgtcgatgcataccaacagatatttgtaaccgtcgttatgctttttcaactggtcaaatatgcacaaatcgcactgccaatcggtatggaagccgctcggtaccgtctttagtctcgggaattttttcctgatgggcttgtgaatcgtgtatgttctctgcttttctaggaatttattaacgtcatcggtcgtaatttccgagtcaatctttttggcctcatttaaaattttttgaatccaagcaaaacttgccggagattttaaattaaaataaatttttgataaaattttctctacagtcttgcccatattagtggtttgaatggtttcttctctcgtgctatgccgtgtgtttttatagattttattgcctttttacttccacgtccccacatgaccttcgatttatcaaccatgtcttttactgttggatccttcagtaaccgatctttaagaaattttgcaccgcgcggtgtttcatctttcttccccgcgagatacaacaaaacatccctataattactgttttcaatcggcaaattcatgttcgactgtacctttccggccgccgtaattttaaataaatctttgttttccttcacgtacctaaaaagaccgtttaaaagggtcgggtgtataatagttttgattggaacgggtgttttgtgtgtggatgttgtttggggttccggagttaactcctcaagggtatcattatttgattcaggatcaggagttcgctctttaagtcttttcctaggaataattattttccgtggttcttcggtctcctgtggtttggattggttattgaggcccagatatggtgcaacatttggaccgggtacatgattctcaatcacgaccttctgtggcctattttcaagtatcccctttaccgtacgtctttctttatagagccaatcatgtctcttcgccttgaggtactcgcttatgccggggtcttgtaaattctgagaaatttttgcgtctaaactcgctttttcattttggagataatcaccactattcatcgcactccgtagagccaaatattccgcctcgggaatcattaacattttctttgcaaatttcatgatgttattttttctaataaatgttgagctcaaacacccagtaccgggaccaagacagctcccagggctata

SEQ ID NO: 26252 - DNA, 783 bp, Heterodera glycines
aaagtacagcgctatatgggaagctattcccgaaggattctggtttccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaatcgattttttcagtgtccgtttggggact

SEQ ID NO: 26253 - DNA, 2049 bp, Heterodera glycines
  misc_feature (304)..(304): n is a, c, g, or t
atcgaattataataatagaaaaaaagttggggtcggagttcgggaatcggaaacggctttaaatttgtcaattttctatttttacttaaacgatgagcctttatgcgaattaatgaagtaatttgtccgtccgcgtttcgccattatttgttctcgagatttgctctcgggtttatggtcgggaaaagatgcaaaaaaaaatgcgaggaggagaaatgtcgttgtctgggacaactgaaccgagctcaccgcttaacataataaccataacaataataaaataaacaataagctttgctaccgntgccagacggcccccccccccgccccccacagagcaattaattaatgatggttaatgaggctaattaattagtagttaatcgtcccaccctgaccggggcgaggcaatttgctgtgcatcatatgaatgagcagcagcttcacaccagaggccagcatggggcggctgtcaggaaaagtttgggcagctggcaccaattgaggggcgggaggcggcgatggtttggcgaaacgtctcggaaaattataccaaccaccaaccaattagcaaatttggcgaagcatttcactatgtatataaaggggacgataattaggatttcacaattttcattggaagcatttcgtcgattaaaatgtgggccatggggtaccgaatttttggagtttttggccagccatatgacacattcatattggtgctcattgccggtctcggcacaattttcctatccacttcaaatcccgataacataataatttttgccacgagaatgacaatacgcaaagaaaattaggaattcaaaattaggcattccgcaagaatgccgaaaaaagttgttacacattacgtatttgccctggatgagtaatttaaaaaaacattttatttttgggcaatcattctcatcagattcgttttaaaaaaaaatccatcaaaaatataaaaaaaattatggcatatcccagcgaaaaacccggaaaaattcaattatatatatttttaaatttcttgccataatttttttttataccctgaactttcggaaattgtttatatttttggatttttgtggctttcttctaacgcataagtacgcattgaattttaaaattttacctaaaaaattaatttttgccaattttggcaggtggttgaaattgtggcacaacgacaacagcaacaaagtgtgccgcaacaacggcatcattttgcaaaaatgggccaacaaaagtggccaatgatgccaccaaagccgacgacaaaatttacaacaatggcacaacaacaaaacgaacggcgcaaaagtcattttagcacaaaggtggaaaaatgtggaaaataaattaattaaattggaaattttaaaaaatagattaaaagttagaatatttattcactttaaacatttgaaaaaataacaacacaaaaatattcttttacatacaaaaagttatttaaaaaaattcatactcaaaacattaattttaattggaaaatcaatcttttgtcattcattagtaagcattttatgaaatctgagcacaattgatcaaaagttgcatcagcggaataaaaaatactgatttgtgaggtggagagggaattggaatttttaggtatttaatggggattttacaaaaaaagcaattcgtttccacgataaattaaatattaaattaacgactttttgtaaacctttttttttttttgctataaaacacaatttttctggatttaaaaatattatgatatttaaaaaaaaaattgccacaaaaaattgaaatttactcctttctgctgctcaaaagttccaaaagtgaaaagtgccaaaatttggtgatttccggcacaaaatagattttccgccactaaactcactgatctccccactccaaacagtgaattagacagaccgtctgagacgattaaactgttgtggataatcgcataagctttgcaagattggacggacggcttaaaaacaccggaaaaaattaaaattaaaaaaaaggtctcatggt

SEQ ID NO: 26254 - DNA, 1424 bp, Heterodera glycines
ttttaaggtatcacatttcaaggattatagaaaagtacttgaaaatagatgttccttttttaaaataatattttttgttatgaaatactttttaagggttctgctttccaatcgtttaaatattatgaaagtcggcgaacggaaatccgtcaaattttccggattggacaagacctctgtaaaactgttgacgaatacaaaaaagaattgtttgggttggtttttaattggactttgggaaaatatctgtttgagggtccaaaaccgaaaccctcaaaactgatcggaattgaaatgtccaatttgaacagcgattgaaccgtccgacctttaataacccataaaaacggtcttaaagctcgttttttctaattaatgcccttctttatgggttttgtgtttgtgtctcaagcgatatttaccgaaatttaattttgattttaatttaaaaaatttaagagatgatcaatcacataaattttgtgtgtatactcgtaaaggagattttaacaaatttactgaaacaaaaaaagacttcactgagcagggcattgaatttggatttaaatatttaatggtaattaaatcatttaaatattaatggtaattaaatcatttaagtattaatggtaattaaatcaatttatgttttcaatatttttatttctaattaaggaatcatttaacaacatttctgtcgttttattgggagaagacaagcaatttttgaaggatttaaaaatcaatcgacatgtaaaatattgggtttactaatataataaattctaattttacagttaattgccaacgtttatttgccaaaagtaatgccgagaatgaatgacatggcttttgccataaaaacatgcgattccttgctgatcactgcacagagttcaacgtttggctggtggatcgcttatttaatgccggacaatgccaccattttttataattcaaaattcggcaaaggtcggacatttttttatgaaaatgagttgcgattttttgtgctaattacttcaatttaggcgttcctcatactcggttaaactttttggctgaatgggtaccgatacaattaatcaaaggaaagatgactcttgattaaattacacattttgatctcctttatctgtttgaatcaatttaaagacttatttatctttttaattacatttttaattaaagcgttaaatcatccatccccttcttgctgattgtgaaaggagctacggacaaaggacccacaaattaaatataaaaaacataaaaaatcaaattagtcttaacaaaaattatggaccaattaacaaatgaagcccctccgggaaactcctataaaatggaagaatttatttaagaatgagttatggaaaaaaaagtttatttacagagttgggagaagaaaaattcattatttt

SEQ ID NO: 26255 - DNA, 1973 bp, Heterodera glycines
  misc_feature (1520)..(1520): n is a, c, g, or t
cccccccccccccccccctgcgtttatccccatccgaatgtttttttaatcacttcaatttagaattcgagttgctatacatggatgaatttgtcgacaatttgttaagagaagaccattattgtgatatacagctgcctcgtctacaggttttaaaaattttttgccgattgtgtctttcggcaccgttctttgggggattttcttcaaactttacataagtctacaactttggaaggggtgagaagtatcctgttttgaatttgtctgatttctatttttgtcttttttatggacaattaatccgaatttcggggttcatactttttcttatggcttaaattctcaaaattggccattttggtgaaaatctgttatcaaaaattacacccaaaactaaatttaaaaaaattgacaaatagcgcaaaaatgtttgagatcattataaaccatggaaaatttctttttatctttgccaaaaatgagcagtgctggggggaatggattggctgcaaattttcctagaaatatttctttccgtttgaattttcacgaaatgaataaaacaaagcaattttgcataatcacaattttaagaaacggcaagcactcgaagaaaaggaccaactcgagttgtacgcttccgccttggacgaagacttagagcgtctttccaccgactccgaagatgagcaggagacgcggaaagcacggccaaatgtgagaatcgagagcctttttttgggacgataattgttagggatgcgatttttagttaaatacctaaaattttgcgcatttaatacgcacagataagcacgaaaaaagcattttccacttggttttgggtgtctacgttgagatttttttttacctatttaagtacctattctgggatttttttacctaaaaatcgcatccctaataattgtaactaaatgacagatcgtttctcggcgccgaagtcgctcgcgcagccgtggccgaagtcggagcaaatcgagagaacggagacgccgatcactttccacggatggtatcaaatcaaccctaaggacaaattgccagttggatttagaccgtcggggaggacgaagtgccgcgaaagacaccgaaagagaaattgaggagaataacgcactgagaaagaaattgggattggcaccattggagcgttaaattgtttatttattcaatcatcaaaaatttgattataaatattaaattaatcctaaattttgtcataatatatgcgattttaatcaacgctaaaaagtcaggctactagctgaaatttggtcttccgctggtaatcaccgactattctgctcattgccagtatttcgttgtcggattagaaacatgcggatttcagctttagaatacttattcttaagtgtttggttgatattatacttttacaaattgttggagaatggttaacaattaaggtcctttgcatactattaaagcgaagaagggctttttgaacaaattccggcgatctttggctggcgatntaagccgtgccccccccccccaatgacttagaaggacgttcagataagttcgtgcaagaatgggcgatgacgaattccatgatgatgttggcggaccaatgagcgcgcaaggctgcactgcggaagaataaagtggccctttgggggacgaggaccgagaggacatgatgctgctggactagacggacatgtgaggaggaggaaacggacgaggacgatacgtcggacaccgtcgacgaggacgaactgctgttatttgaaggggcctagaaataccgacaaaactgcactcattatgactattttttattcaacaataagtaaaaaataactcacattattcgatgccgagtttacctcatcattttaatcactcccgattagtgtccatataagtctcaccggaataaacagcagacatcttcgtcagcttgaatacatgtgaaaaatcct

SEQ ID NO: 26256 - DNA, 975 bp, Heterodera glycines
cggtaatgaggggtggggggggagagtgatcggcgatcaattctttggccgccaaagatctgccggctcgtcaagtcatcagcttcacgtacgaattgtaattggacacgtcgcgcttgagaatctcacgcaccggacccatcacgcgctctgaaggcaattaattggccaatgtgaaatggtggaaaatgccaaacaaactgaccaaatcgtgcccggtccaatttcagacatttcagcagagttttggccacgacggtggcggcacgagggcgatcgagaaggagggcgatttcccctttaatgagccggtaattaatgcagcggaggagtgagtgccaaaaccgaccgaaatagtcagagggtcccaattttccgaccacttcgaagggcgcgtcgtcgttcggtctctgcagcacctcagcttcgccctccacaatgatgaagaattcgtccccaggatgtccttaaatggtcgctaattgccctccgtctgtcttccccttcgctcttttaccctgctccaccacgtgggtgcccgaggggaattggcactgttccaacgcatccgccacattggccctttcccatttgtctaagtcggctgtaaaagagagaagaatgaatggggcagaatggcattatattaccaagaatctgaactttgctcaggaattcgtcgtacattttccgctttcgcatcgtcgaccccataagaatggcgcggtaagtgatgcggtcgatggcccacagtttgaccgtgttcgtcttcgcgactacggtggctgcgcgcggagtgccataaatcagtgccaactcgccaaatgaacctccctccttcaaaaaaacagtttaaagcatttgcggctgcctttccgtcacaccttaatgctcaacacgaactcgccattgacgaacacatcgacctcgccactgtcaatcacataaaaattgtcgccctcttcaccctgaatt

SEQ ID NO: 26257 - DNA, 1110 bp, Heterodera glycines
  misc_feature (20)..(20): n is a, c, g, or t
ttggagacttttttaattcntcggttggccacaaacttctaaccttccgatttagctgagctggaaaatctcaaattcaaatttttgaaaacaaaaagccaaaatttcgaatggagtcgccgcacaattgccgcagctgtcacgccagtgttgaactgagttcggcatccgccacgatgatgggcgcactgaccgacgtggaaatccaacagctgaaggagcagaaccagcggagggtgaagcgggtggtggcactggtggcggtggccattacggtgagccaaaaaaggagatcacttttttggcactttgtccgtctaattggccccaaatttacgcaaaatcaaagtaccgagcccacaaaattggctcggaattcgagaccgggactgggtccgaaattgaaacagtccgatccggtgagtcggcacaaaattccactacttaaaaaaggccgagactcaagaccctagaagatccccactaccatcggcataatttcatgtaccttttttcctcttgcagacgattgccgtgattttggtggccctttctctgtcgttgggcccaaaaattgatcagctcggtgagtctgatcagaaatctcaaaactgatgtgaaattggctaatgtttaagtcagcgaatcgttggagtccagccagctgagctccgctgaacttctgttggggggaccgaaacggacaacggccgaatggcaccacccgcggcggcagcaggagaagacgaagcgggacatgaggacaaatggggacggcacatggtaagagaggggagggaacagtaccgccaatttatcatagccttcaaaaaattatgaatttcttggctgggaactgatgcaatgccgagacccactctcgatccattataccgtgaaacgcggacgaaaccttccgtaccaagtaatccgtgcgggatacggtactgtaatggtatgtaccgtatcggtaccatgcaaagggtccacctcgtttgggcgccaacccgtttttggactataacgtttttctttgtcaaccaaatccaacattcttggtatcattcgatagccctatatgtcctctattagcctgcagaatttagaaaa

SEQ ID NO: 26258 - DNA, 2031 bp, Heterodera glycines
cggctcccgaagcatcggttaaaagaaaagctgttcataaaacattcacatgcctttattaggtgattattttttttctacatcagcttatcagcaattctctctttggcacttattccgccagtttaattaggcacgtatttacaaccattgtcaacgcagcaccgcttggcgttgaaggagggctggcatattttggcaaaacctaccattggcactactaaattcgtggctgatcggggacgaaggccatgctggtgtcggacacttctctctgcgtcgcacacaaaccactaatcgaattaaaatattttattcataaacaattttattttcacataattttggaggaaaaggcgtggatgcgcttggcattttggcattgcacgcccggcggaagtcaagtcatatgatctttccccgaagccttttcgccctttcctttaaaatattgggcggatggtatttttatttttatgttgaaagaaaataaataataaagaaaattttttttttagtgagcaaagtatgattatttctattcacacatttgaaattcatgtgaaaaaggcattgaaaattttcgcttaaaaggccttagaattcgcttaattctgacttcatttcacctttcttcgaccattcattccaatctttaataaaaaaaaatatgcaattattctttttattcgccgttttcattgctgccaatgcttttgactctgcccaaagtgtcggcaaaacgtccgctgaggacgaagttcgagcggtaacggaaggggcggcaccgcagcggcaaacgccgacgcggaaatcgttgaaaatgttcggccacggcctacgccatcacacgggcatggatttgctgatgaaactcggccagcaacaggcggaggagcccaaggtggtcaaattttgaaaacattttacgtcattatttttgaagttcaatttttttcaacaaatattgaagaattttgaaacattttgtttaaataaaaaaagaagttgcaaccaaataatttgatgcatttggcatattaatttcaaaatttaaattaataatttgctctttcctcctccatttcagtcattctcctcaatggacattcttcgcctttttgatgggcttgaccaccagttttaccacgatttggagaaagtgagaatgaaatttattttcactgaaagataattgcaattcgtttctttattttaggcacaatcgctttttgaagaaaatgccaaagttgtgaaaagtcttgaaaatcgtgttgtcaaacttgagagtgcaatggcaaaggcagcggagcattgcgaacccggcaaagtccaattggtctcggctcattacgacacggttggtcattaaaattccactaattattattattattatttaattttttattattattcaattttctgttaggccattgttctgttggctttgctgattgttcttctcctgtgcctttcgttgctgttcgccaatttgatgctcgccaacttcaaacgcaaaggcgtcgtgcaaatgccgttggcaatgatgcggggagagagcgagagtctgtaaattatcggtatacggtaattaagcaataattaagcaaaaaaaaaattgaaaaatatgagagaaaataaattttaggcttctaagatattccaacatttttgcagtaacttttttttttgttggtgctctgttttatgttagtcctccattcctaatataccgtagaatattacctcataatcatagtaattgaaaattgtatcatatattttttgctaatctttatcatacatcatccacccgtatttatgaatcatcttcatattttttttgttttttcgaaaataaaataataatatttcgttttgttgtgtgttcttgctagagtctacgagcggagcataattcaaagaaagaaatactgtaagcctattgatatgccaaaaaatatcagtgagccatcccatctggaagagagagtaaagggtgattgtgtgttatctgtggacagattt

SEQ ID NO: 26259 - DNA, 1096 bp, Heterodera glycines
  misc_feature (1022)..(1022): n is a, c, g, or t
cccccgcggggacgggggcgggggttttgctttgaattaggtccaaaaatctcacaaaaaaatattttttaagaatgatttctttggctccacattcctttatttgttgatcgcctcgatactatttcttttgacataaattgcacagatttcgactaaaaagtagccaaaatttagggatttttgggtaattttttttaagaaaaaaaaatttttttttgcgggggggggggcgtgccgataggggcgaattttaaatttatttctaacagatattcaccaaaaaaattaagactttttcgataaattttcgttttttaactatattaaattatcgtgatttactcaaaattggaactcagattttttaaattttttttcttgcggcacatttttcaaaaaaaaacttgatgaatgtgcgaggggagagttccggcggtgccgataggcgccgccgggaaaattttttgaaaatttgaatgcaatttgttaacaaattttttacaaaaaatgagcaaaattcgcgagcttgggattatttttaagaaaaaatataggaattttgggggccggcggtgccgataggtgccaccggggaaaattttaagaatttatatgaattttgttagaacttagccaaatttttcagaaattttcttcttttagatgaaaataaggcattacccccaaatcagaacatttcttagaaacaagaacataaagaaaccctgtattaatcagaaaaaataaataaattaaaggaaaacgttagccggaatcgaaatcatgacaaaagtactgttagtattgaagcactatccaccaatccacaaataaaataaaaaacaagtaaaatttattttatttcataaaaatttctcgatagttaaaaaaaattcaaaattgtcaaaattttttgccttatttcccacgaatatgccattcttaggggtgtattttcacccccgtgcccccgcgggggtgaaggtcgcgggggcgggggtcagagtcacgggggcggnggcgggggtgagccgaaaaaacctgtcccgcccacgcccccgggggcgagggcggggctcgaaccctaatttaa

SEQ ID NO: 26260 - DNA, 1407 bp, Heterodera glycines
  misc_feature (23)..(23): n is a, c, g, or t
  misc_feature (103)..(103): n is a, c, g, or t
ttatgtaattgtaaataatatgnaaatgtattattattattattattaatagtttattccttttttattagccgtatgcaattcaataaatgacttaattatntataattaattaatgaattaattggttcgcgtaagaattaaaatatttttttttgtatacaattcttaaccaaagtttataataatgccatttgatgagttagcagaatgcctgcctgttcagcaagagcttttcaacatccttaaaatctcactttttgttagcactaaaacgcccaaaaattcaaaaaattttcagaaaatcccatctgatcagatttgtgatcaagaaacttcatacatttgcttctttattcagcaccgatcaatcacaaattatacattttttagtggaatgagcggaatgtctgatcactcatttgattaatagtgatcatttgtcctgttttgatcaatttttgttttccaattcaattactcttttttttaaattattcccattttaaaaattctttttccctttttattaccaaattgtattacatacatatgaatgcatttatttctttactagtcaaattagtcaatctgttctgtccaccgccgcttttaatgggctgtttttggtgcttcgattaaaaaagtcgcgcatcccccgggggaatttctaaaattggattttcggaatttttggagggtcaaatggcggtcaaataagagcaggatttctttatttgtttaaccatccattctcagcccaaaatggaggttatttggccttacggatttggatcaaaaagccgcaaaaaataacgaaaatattttttgaaatataaattttaaattttagtccgaattttaaatatatgaaatttaagttcggttttcggacaaaaatcttcccgagactttccatttccgatctcggttttttggaccttgaaatcaatgagttggctcgattaaatttacctaaaattcaattccccgttcaaatttttaaattttaaacatttaattttaaaattatactcgaaataattctctttccaatttgttacttttttatagctttcctcatttactaatgactaattattaactaattacctaaatacgcgaattacgacttccaattttctctcccgccgttctccaatttttttttctgcgtcgtttcactcccaagaaaatgaaaattcaatttttctccgttccaattttccctggcgtttcgtttttttttaaatttcagtccctttggcgctctgttttgtgtgcctgcctcccgcccgtgcgccctcatggggcttatttttgcccattatgtgctggtggtgggggtgggtgttgtgcttcgtaacgaaaaaatggcgggtaattacgccccgtccccctcccccc

SEQ ID NO: 26261 - DNA, 1552 bp, Heterodera glycines
  misc_feature (17)..(17): n is a, c, g, or t
atatgtcatcgcccgtntaaggataagaaatattataatgaggaaaaaatgatctggtgaggaattgggccagaatagaatctttaaatcctgtccttaagaaaataaaatttattaaaccgattaaattttataatatttttgcaaaaaatttatttaatatgctaagtgaaagataaaaaaattaaaatgtacaagatagaaaaatctatgagcaatggaatcatttgcattatgacaaataaataaataattgaaccaatttaataactcatataatttatatttgaatgtttaaattaataattaaaacaagttcttagttgtattcaacattaaaaggaaaaaaatttaaaaaggaaatgaaggaacattccagaaaaagggatttggtagaactggacgaaatatgtaactgctgctttaactattaagaaaatataattttttattcgttaagcagataaatattttttctgagttcttacaattaaataaccgatataaaagtcataaatagggacgtgaattttagtgaataaaagtttgaattttgctcaagttgatttttgtaattcggttcagcgttctcagaatagcttgaaattttgcatgaaaatacgttggcatgagacctagcactatggtaaatttcagaatttttaatattgttaaaacttttttacaaaaaaccgcctgttttcaaaacttgaccacaaagttggcgtacaggctggaaaaagcggattttcttaaaaatctctgagtgcataaaaaattctaaaatttggcaaggtgctagaccttataccaaagtattttaatgcaaaatttcaaactcttctgaaaacaatgagctgagttagaaaattccgcttggcgatttgtgcaagtttttcttcactaaaattcacgtccctactgatcaccatcctcaagctgttcgctgctgctgatgctggtcggtccatgtgggctcgtcgttccatccattcgttgatgcaccagtgctccgctgaacgccaagacttgctgcttgaggacgccgtcaagcggccatcgttcatgcaccaacagcagttgggcagcatatcgccgtaagtattctttctctatgcagatcactgattgatcagctgattgttgttgtttttttaattaaaattaaatgcctttggagagagtatttatatgtaaactcatggcgctcgatttcatgggatatgtttggggatgggatggcaattttttttaaattcttcatttcatacgagggcgaatataaaaaaaacaattttttaacgaatttttttggattttattatttttatggagcatgtgtaaagtttgtagaatttttttttaattattaaaaatcattatttcattttatttatttttatattaaatagtggaacaaatttcaaccgaatttggcgccatttgaccgcgtccgccgcaattgttggtcaataccagcagcaacaaaagcagaagcatggcactaacaacaacagcaacaacaacagcaacaacaatagtattaagggca

SEQ ID NO: 26262 - DNA, 958 bp, Heterodera glycines
agaaaaattgaagaatttttatgggccctaaactgcatacctaagagccgtattcgtcgctgatcagtgatcactaatcacgaatatgacattcaaccaatttctaccctcagacccaaattctaacaaaactcatttttcatcaaacattttaaaagccgcaaattccgatttggttggccgaaaaattccacaaaattcgatttggtgcatcatttctatcgttttgaagcgccacttcgagtcggtcatttggggtcttcgagtgccccttcgctctcctccgtgacttccaatttgtacagggcctaagaaaacataaaaatgctttctagcaattttaaatttggaatactcacaatcagattaatattttaaccattttattttaatttcgtgcctattttaggtgtctaaacaagcggcaatgtttatcaagtcgcattccgaggcgagcactttcctcattaaggttgttgtttagaattggaaagtaaataaaagctaactaattcagatggaggaagaaatgacagagaatgggacggggggaagctgtggcaggacgaagttggagacggacgacacggcactgtgctaccgacgccatttcttaggaagagtcagtccattgggggaggggggggggggggagaggacaaaataacagtggccaatgccgagtttgtaatgaccattaattttaaatatttgggagagtgtcaatactcccgagaagcaaataaataaataaatgaatgttcccataggaacaccacaacttttatgggaatgacccgctgattggtccgctggtgctgagtgttcgcacggagacaatttcctgccaaaatcacttccgcatcattctgcgaactagtcacgtgttcaattcatttgcgcgtgtatatcaattccaaagtgtaaggtccatgaggttgtcccagcctcggcattg

SEQ ID NO: 26263 - DNA, 1616 bp, Heterodera glycines
aaaaattttgaaatttttttgtaaatggcaataaaagtctattttttttttctctaacttggcgctgcggtcggtttaacgtttttttttgccaagaaaatttcgatttttcaaaaaataataaataaaaataatttgtaaggaaacaaatgacgaaagccatcggaaattatcaagcaaattaaaaacattcgatgatgaacaaaaattgacgataattaacgaattcgaagcaaaagctgatgaaatcaaacagcaaaatgagcaaaattataaaagaaaccgaacgcaaattcaaaaggaaattgcacaggaattgggcatttgccgttcatacatttggttttggaaaaaggaattaggtgaaacagtgagaaattaaataatcagtagggtcgcgacttttagtgacgaaaaatcccgaaatagttaactaaaatagtgacgaaaaagtgccaaaataatgaagaaatagtgaaaaaagtccgaaatagtgtcgaatagtgacgtaattttcagccaaaaattaagcaaaaataatttttattcactgattgcagttgcaaatgagctacatttcctttataaaattctcttagtaaatattgacattttttaaatcaaaaattttgtcaagaaaaaaaatttgggggaagaatttttgaaaaaattttccaattcttagtggtgtatttaaaaaaaattttttggtcgattcttagggggtgtattttttgaaaaaattttttggtcgattcttaggggtgtattttttgaaaaaatttttaggtcgattcttaggggtgtattttttgaaaaaatttttaggtcgattcttatgggtgtattttttgaaaaaatttttaggtcgattcttatgggtgtattttttgaaaaatttttaggtcgattcttaggggtgtattttttgaaaaaattttttggtcgattcttaggggtgtattttttgaaaaaattttttggtcgattcttaggggtgtattttttggttttattgcatttttgttaaagaattttccaaaaaatgtcgaaatagtgacaaaatagtgacaaaacgccaaaataggttttttgagctcctttcttcaaaacaatgagcaaaaaaaagttttttcactagaaatcccgaccctaataatcagtgaggttcaaatttgggtgcttggtactccgaccctacaaattttcgaaatttattttaaaatttcatccgtcgacgccgcatcggcgcctcaaaaaaaaatttaaaaaaaaataaaaatcaaaaaaaaaaaataaaaatttttatttttattttgtcaataatttctttttaatattcctaaattaacaaatcatagaataaatctttaattataaagttttttttgtttattttttagattttttcagtttttgacttttatttttttttgtttcggtgatttttaaaatatacaatgaatttaaacaatttatttgtttaaaaaaaaatacattgaaaatggaggttcttcctgctcaacacaaaacatatgtttcctcccatttgttttgctaaaattctcctatttcgaaaagaaagttgcttatttttaagtcgtccaggcggccca

SEQ ID NO: 26264 - DNA, 1767 bp, Heterodera glycines
  misc_feature (177)..(177): n is a, c, g, or t
aataaaatttatatatagagcaaaaattgcgatttttgtagtatttatttttataaaatacttttcagaaagggagttctgaatttttttctgaaaaatcgaatttttccaggaattctggaataacttttttattttggaagatagaaattccaaataattcacataaaattctcncaatttttctctatttttaaagctttattccactaaatttgaccaaacacgaagagatttatgaattttcgaaatttcactggattttccgtggctcaaattttgacgatttttcaaaaaattttaaccaccttccaaaaagtctgaaacacaaaataaagcgtatattcgtgttcagcacctcaaattatgccataaaaatgcattttggctaatttaggagtaaaaaattttttcatgaaatgcaaaaccatggggtcccccctatggttttgagtttcaaaatcacaattaattttataactttttttaaactcatggtaaaaacataagataaagcacattagatagagcttaaaattctctacaaaaatgctctaagacaaattttcgctaaaatcaacgcctgacgagttataagccttgaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcacgaaaaacggaaaatgccgaaattgggtgccaaattttgccattttctgcagcattggcatttacagatagccccgccaaataagcgccaagttttcccaaacattccaacttaaaatcctcccaccaagcattttccgctaccgcttcttcccgcaaagttacaggccaccaaagacggacaaaaaaaatttcacgccgtttcagcgccgctggcgctgaaccgtccaccggatcggaatgccgatagttttcctgaatgcgcctcaaaaagttgtaagacccttccaccactttcagacccctcccgacagccgttcgactcaaattagtttttaagacgaactgcaacgtttctctatagtagtataaactagggtgaccagttggctatggtgtgcatgcgtggcttggtaatatatggccctcatttgttattttaaaacattaattgcattagtgtgatgttttaaagcgctatcgcgctatgggacgcggcttcgccgcgtcgctagaaagtgatgtaatttagaaattcatcgcagcctcaggacgggcgcttcgcgcccctttttaattttgcgagagacatttgaccgcttcgcggcctcatgacgggcgcttcgcgcccgttttttaattttgtggggaacgttcggccgcttcgcggcctcaggacgggcgcttcgcgcccgttttttatttttttgggggacattcggccgcttcgcggcctcgacgggcgcttcgcgcccgttttttaattttttggggggcgttcggccgcttcgcggcctcaggacgggcgcttcgcgcccgtcttttaattttgttgagaacattcggccgcttcgcggcctcag

SEQ ID NO: 26265 - DNA, 732 bp, Heterodera glycines
tcgggggggagctcaaatgtcggggaccccgatcgggtagtgatcaactaaattttttaacaaaaaaaaaaccattttttctttttaaatgctcgaaatcttccttttttcactttaaatctcagggccctgtccggtagggcaaccgagaccgggaaaaacaagcactggtaagaatggtggtcggagtgtaaaattagtgatgaaaattggaattaaaggaaaaattaaaaaataataattaatatatactttaaaagtaacgcacacaattataaaaatggtctagaggctagtcttcttgattttctacttctttcccattgttcaatccctctatagaaattaaaatattttgaattttcttttgtatattcattggtttcctatcgacaaaatattattcttaatttttttaattgtattttatcattttttaagaaaacccatacaaattgagcatagtaatctcacttttttgttttgcctttcacttcctcttcctcttgaattccctcggaaattcccaaaatttcccctctttggtcggaaattctcaaatctccccgtattatttccaaaattcccattccaagtccgaagctcagctatttgttgtttcaattgatccattaatcttcctctcggggaagcttcttcttctctatatcaaggctattgagcatccaggaaaaaaacatgtatttacataaaaaaggaagccctataaat

SEQ ID NO: 26266 - DNA, 1092 bp, Heterodera glycines
  misc_feature (992)..(992): n is a, c, g, or t
  misc_feature (1067)..(1067): n is a, c, g, or t
tttttagaggaggtgatgcgcgaaaattggacattggcaatttggacaccagaaaatttgaaactaaacagaaatttcgacaccgccgtgaatattggaccccaacgcttaatttgtcgcccaattttatttattttaaaaattaaaaaattaaagaattaagagaggatttgcttattagggatgcgcgacaaatattggtaccgagcctagaaaattctaatttttagctaatcggtgcggcatcgattatatttgattattgagtgagaagaaatttactataatcaccttctggtctttggcataatttattataattatgaatttttttaatctactattttccaatgtctatttttccaatgcccaattttttagatgccatttttacaatgtccaattttccgggagccccggcggggagtaatccaattatgtatacatatagcggctcactcggtggctccgtcgttgttggcgtcggcggcgatgttggcttaggcggtggaagcgtcataattggcttatcattagccatgtctttgccctgttcaccaatttcgcatttgcaatggacacttttgtacttctgactcatatttttcgccgtcttttcggcacaatatgtttcatcgttgtgaaaagcgcattgccatccgctgaatacaaagcccggactgtcatctgtgtgtggtttaacaaaaattagatcaataattacggatttcgtgaaatccattatatacagccatgcgggatggaaacagggccctggggccattttggccagaaacctagattttgacaaaatttccagaaaagccggaatttatggtgctttaaaaatggaaaaaatgggctatttttgggcataattttccgcacaacccttcattcttcaattacaatttggtttttaaggccttctgaaatatgagaaaaaaaataaaattttggtcatggtttcccccattagagatggggtttanggtcaaaagtctaagccaaggggtacgaaaaattaaaaaaatttttttgtcaaaactttcaagaaatcttgaacnccgaatagtttgaccttgaaattaa

SEQ ID NO: 26267 - DNA, 1216 bp, Heterodera glycines
aaaatttgtcagaaatcggacaaaattgtgactttgctcagaatggccaccaaatccttcagcaaacccttgggaatgtctttggccgagagagaacggaacacgcggtaaataaacaaatccgtctgtgatttctgactcggattttgtttggagatcaaaactcaaaattctgggaagtttttcattctcaataacattttgttctttgaaggtatgatataagtagcgagaatattaaccttgctaagcgtttgatgaccttgaaatatcgactggctccatcaaatcccagggatcaacttcattttcacaagcgttttgttgagtgacgcattcatcactctgctgattggaggacgaaaaatcattggcctataaccatgtttaaaagatttacatagttaaaacccaagaaccgaactctaacaagtcagtgttttggttgcatgtaaaatcgctaaaagtccattgttaaaaccttgacgtgcgggtccgggaagcgaatggtgcgcgcgtcgtgcgtgacaatgtacggcacttgcttgtcaccgaccgcctgcttcttcaccttgcacagtttgtactgcccttcacgactttggattcgatggatgacaaaccgttgtttgcgtatttgatgcaattgcgcaagaggataagcggcaacgacttaggttttagtttaaaagagtgaaaatttttgaaatagtataaaaattagagaaggtctaatgccataaacaaacaaaaaaaataagaatttcggatcctattactttaacgaacaaaaaacaaacaaacaacggagatcaacaacaaaaaaacatggagatcgaccacaaaaaaaaaacatggagattccgaactgtcttggcacatcagacgagttcgccaccaggcggcggcacacgaatgagaatgagaattgcaccatggtggacatgactccccacgatcaccagatcgttcggcaattgttgatctaaaatgaaaaaattatgactttcttctatgacaaattgactacttgaaaaaaaagacgctgctggattggaggcacaccctcgaaaacggcgacacgcactttcaacattgaaatagtttcatattcagcgagttcataggggcgcaaattccctgcgtaactgatacgcacaataaaaggttccattttttaatttgcttgtttgaaaaacgttaaaaatcatttatt

SEQ ID NO: 26268 - DNA, 962 bp, Heterodera glycines
cttctattatcttagtgaaattgtttttgtttttgttaggtactttgcaaaggccctgtttttgtacaaagtcactatttggacgtgttaactgaacgcgaagaattgggtcactcccacaaatttgttcaatttacaactgttaaggtgagcaattttatgctttttcaaaaattgtgctgcgaatgatttattatttgtcttttctccaattgatttttttaaaagattttcgacctgttcaaatgctacgagtgttggaaggccacacatttggagcgaattatgtcccgtcgaatggacagagaaacgcgttctcgtcgagttcgtttggataatcacagcactcaaaggacaacggcatcaaaaacagtggaagttggggcagaaggctcaacgaccaaccaaagcagaataaaagctgagggcggcgagcacagtgacgatgaggtgaaaaaacaacaaacgaataattacgaaagagaaattatgttttttattaaataaaatgacaaactcggtgcatattctttaggaaagtacgcttccatgggctgggttaaccaagcaattaatttatgccttttcagactgtcgccgatgacccgggcgtggacgattatcgcactttgtgcactgtgcgcatttccttcttcaagggctttggtctcagctacccaaaacggacaattcaggtactgtttatgaattatgagctgttcgctttagccatcccactgttccccatttgttttacgcttccattaattcccaggaaacgccttgttgggttgagctgcacctgaaaagggctctccaattgctggacgaggtgatgaacactcccctgatcgaccatttgacttagcctttcccctcatttttaacatctcaactcaaatttccctttcatacggaaaactcatcaagtaatttgtgcggaaacacactaacgaagagca

SEQ ID NO: 26269 - DNA, 1029 bp, Heterodera glycines
atatgaaattctttattaaaagataattattatttttcaataaattcttttattattaatttacaacaaatctttaaatataaattgatacaacagtgattagtaaattcattaaattaaaatgaaaatatttttaacaaatttaattaaaaaaatacgtgaaccgtcggctatttagctgggaaaaagcgcttcgcgctttgggagcttcgctacctagattagctctggttttggagatttggaatttttaaaaaattgttaggggtttttaggccgcttccagtgattagaagaggtacaatggtgattagaagagttacaacagtgattagaagaggtacaaaagtgataaaagaggtacaaaagtgattagaagaggtacaaatttgatgaagaggtacaaaagtgattagaagaggtgcaacagagattgaagaggtgcaaatttgataagaggtgcaacagtgattagaagaggtgcaacagagattgaagaggtacaaatttgatgaagaggtacaaaagtgataaaagaggtacaaaagtgattagaagaggtgcaacagtgatcagaagaggtacaaatgtgattaaaagaggtacaactgtgattgaagaggtacaacatgagaatgtaataaacagatggcatataaaaaaaatacaaattatggacaataaaattaattaatttgaaacaaaaaatttattcatcaaaaataatttaatttaaatttaaaattatttattaatttttaataaaacaaaaaggttcaaattaattaaaaacggtgaaaataacgtaaaaatgcacaaaaaaataatgttacaccgtccggattcgaacttgcccccccccccctcaaaatgatgccccagaatccccaatcacacagggattctgaggtcttaacgatgtcaaaagtaaaatctgatcacgtattcgtgatcagcgtcataaaatagcccctaatgacatgtttttttgagaattttttgtgaaaaaaattttttcaactcaaaaat

SEQ ID NO: 26270 - DNA, 1110 bp, Heterodera glycines
  misc_feature (863)..(863): n is a, c, g, or t
  misc_feature (934)..(934): n is a, c, g, or t
  misc_feature (969)..(969): n is a, c, g, or t
  misc_feature (978)..(978): n is a, c, g, or t
  misc_feature (1013)..(1013): n is a, c, g, or t
  misc_feature (1020)..(1020): n is a, c, g, or t
  misc_feature (1022)..(1023): n is a, c, g, or t
  misc_feature (1028)..(1028): n is a, c, g, or t
  misc_feature (1053)..(1053): n is a, c, g, or t
  misc_feature (1056)..(1056): n is a, c, g, or t
  misc_feature (1064)..(1066): n is a, c, g, or t
agaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaaaactttacaaaataatacccctgggagaagggagggggaaacatgatttcaaaattttcaattttttctagtctaatctactcaaaccggttcagaattcaataaaaataacattcccgattcgaaaaagggggtatgaaaaatttattgtgaaaaaaagactttacaaaataatacccctaataaaatcaactctaaaacataatttcaaaattttcaattttttctactctaatctactcaaaacctctcaaaattcaataaaaataacattcacaaaacaaaaaataccttttaaaaattttattttaaaaaaaaaactttacaaaataatacccctccaaaaaaccaattataaacattatttcaaaattttcaattttttctaatctaatctactcaaaaccnttcacaattcaataaaaataacattcacccttctaaaaattacatattaaaaatttattaattaaaaaaanactttacaaaataatacccctttcaggagaaaatntcaaacatnatttcaaaattttcaattttttctactctaatctnctcaaancnnttcanaattcaaaaggaataacattcacgntcnaaaaatgnnntagccatgcagatggggaaaaaaagactacaaaataatacccct

SEQ ID NO: 26271 - DNA, 1754 bp, Heterodera glycines
attccagaaatatggaaaaagtcaattatttgccctgtcccaaaaattcaaaatccggtaaacccagtcgactttcgtccgatttccctgctatgttctgtttccaaaattggaagaaaatatagcaggaaaaataaattttgttgaaaaaaataatttgttaccaaattgtcaacatggttttcgtaaattctgttactactcaactttttgaagtggtggatgatttcagttttgctttagaaaataaaaaatcaattgatgtaattttttttgatttggctaaagcattcgacacggttccacataaccggctaatatctaagctaaaaagcattggtataaataattccttattaaaatggattcaaaattacttagaaaaccgaaagtttttcgtcaaaatcgggtctgatttctctgacgaatatccctgtctcagtggtgtgccgcaaggctcaatattgggaccactgttatttctcatttacatttaggatttaccaaaattctgcgaaactgaaaatgttaaaattaaactatttgccgatgctcttaaggcctatcatgttctttcaaatatttccttttctccactccaaaattttattaacaaatttaatcgatactttaaattaaacggccttaaaatcgcttcaaataaatgtttaactttacatttaggacacaaaaaccagaaaataaattattttattgatgactttccaattcctaaaaatcccggaaacgaaccatcagagagagaccttggcatttattttactaatgatttgaaatgggcacaacatattgacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaggatatagaaaaactggagaatgtccaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataatgaatccttttctttttccaaaaacattgtaaaaaatgaattcactataagatagagcccggacaagagggtcggtcggtcggtttcggttaaaaaaccgaaaccgaaaaataccgaaaaaaccgaaaaaaaaccgaccgaccggtccgatctctactataagaacagcgtattgctcaaccaatgctagattcttattctttctttattcgaacctctcgtctctatagacttttacctaaagagatgagattactaaatccaaatgagtttgccaaacttcttgaaagatctgatctgaatttgttgatttctttgccacccccagctccaaaagtgaccaattgtctgttttatttgatattgtttcattatttcttatttttagcattttaaaccagggctcggatccaaaatttttcaaaataaaaacatcaaggccaaaaaataagattttaggatcaaaaataagaacatttcgcaaaattgcttcaatcagttattttacaatttattcaatcaaaaaatgtatcaaatattatatggttcaccccttccccatgatccttttttaaacaatttaggggaaaaaa

SEQ ID NO: 26272 - DNA, 1032 bp, Heterodera glycines
  misc_feature (32)..(32): n is a, c, g, or t
tctagagtccaaaaaaaaaatttaaaaaattntcgaggccaatttttttctccttgggcactttggcatttttagcttttttgcggcctgtcgagatcaccgacgtggagcccagcgcgttcaaagtgttgctgaacttcatttattgggacgacctaagcgaacgtaatggcgacaacgcaattgctttactttacgcaggtgtcaaaaaaaaaattttttttttttgaaaaatttggattttaatttagccaaaaaatacaaaatccccgagttggtcaaagcgtgtgttgaattccccgtttctgagctgcgtgacattttctctgcactcgtacgaacccgtattcttgaagaggaggtggcaaatgttgaaacaaaaattaaaaaaaaattccgaattttttggggctccaatttttagggatgtaaaaccgctgaaaataacatttataaatgtaaaagttatgaattggacaaaaaaggttaaggattttacggttaactttatcccatactcgaaaaaaaaaagttttttttcaattctaggcatttttttaaattttcttgggtttcctttttaaaaaaacgttcaaagctttaattgccgaacaaaaaggtgtataattcacaaaaattaattaaaatgttttacagtaaccgctttaattattgtaatttattttttaaccccccccccccctccgacaggaatttgctgcgcgatgtttgaattacattgaccaaaatgcggactttctgttccgttccaacgctttcttacaaattgacaacaaattgttgtgcgaacttttgggccgcgatcagttgctgatcagacgagaaatcagtgtttggattgcggtaaattttgttgctaattggcattttaaaaaaaaagttattttattaggttttcggcaaaaaatttcataggcaacctaacattaaatttatgtcagaagcacaatcaaataaaaagctttcgtttttttaaagaaaaccaaaaaaaattttttttttttttttttt

SEQ ID NO: 26273 - DNA, 955 bp, Heterodera glycines
aaaaaagtttaaaattgaacaatttccgtagcgaaacccatagaaaattcaaaaaattttccgggcggcgcctatcggcaccggcgggaccccgcccacccctttccacaaagttttttggaaaaaacgcgccgcaaaaaaaggtggtttgaatagcaaaaaaaaaggtcgtcgccggggaaaataggggccgacgtaagaaaaattggtcctggcgcacccccccccctgcgccaagcgtccgacgtatgggggtctgactggcgcaccccttgtgcatgtatggtggtgatgccattgtcaatatatacgattaatggattttcaattacggaaacccgcaattacggggactttcaattacggaaatccgtaatgcgtaatgggggagtgggtcaaaaaatgccgtaattacggaaattcctaatccataatttaaaaaaacatcattatagcgcagcttttgaagcatatgacttcttttttctgtatttttctatgaataaaaatgcaataaaataacaaattaaaataatttgtgatgctttcgtttctaaaaatttttttttaaatttttccagaaaatcattaaaaatttctgtttgaaaattatttaaaaatgcgcaaaatagcaaattttattgttgttttgtgattattagacatgttcaactacaacgggaccattcggttgcaattcggcttttttggtcgggcgaccagcgaatttgtgtacatccgtggcatttcgtggcggatcacggcaatgccgttcatgaagccgggcaaccgccggtggctgtcccttttcctcaattgtgagggccaaggggacgacgaaaatggtgagcaaagaacaatttatgaaattttgagggagaattacgaaaatcattttttaaaaatttgggaaaattcggaatttgaaccccccataaaattttaaatatcgaaa

SEQ ID NO: 26274 - DNA, 1346 bp, Heterodera glycines
  misc_feature (1143)..(1143): n is a, c, g, or t
  misc_feature (1228)..(1228): n is a, c, g, or t
  misc_feature (1276)..(1276): n is a, c, g, or t
  misc_feature (1278)..(1278): n is a, c, g, or t
  misc_feature (1286)..(1286): n is a, c, g, or t
ccccctctgtcccacaaaatttttggaaaaagcgcgccacaaaaaaagcgtttttaaagcagaaaaaagtcgtcgtaaatgaagaaaatgataagtgaaaacaaaaaaatgttggaaaaaacaattccggtgaaaaatacaagccatttgaataaatattaaccattttgcattgcatataataaaaattttaaatgtccttgaatttcatgaattttccccactatgtccttgcaaatcggcgatacccgtccttggaaacggagcgtggacgatggcaacactgatttagggtaatactaccgatggtaccacttcagaatgtttccatgtgattacccatttttagacgaaaaatgcaaaatttgaacttacgaaattttgttcgagttcgggtccggggttcgaaattagtcgaaatggatgtcatattggtgatcagcaaccccaaaaacccaagggaacatgttttcacggcttttgaaaacaaaaattttttttttcaaaaaagttgtggtaccatcgggtagtattaccaaatttagtatcattcgaaagctcttggtgagttaagtctaaaaatcaaagaaaaatgtcaaaacgggagccacctaagcacaaggacaactgagtcccattgaatatagacagttctgtaccaaaaaataatgaaagaaattaacaattaaaagtagggttgtacggaccggggagggaattcccggtcctccgaggtctcggcccgttttacgccaaaaaatgatcatacgttttaattatacgccatttaagaaccattaaacgtatttttggtttaccccttgaacccaactctagccttcgaaaaaaatattctataaaattcgaaaaaatgaggcccaaaatttcggaaattggaattccgaccccactcaaattgtttagcattttcttcgtgccaatgccatttcttccgtcagttacgaaattcatttttctgttcgtgcgccgtcaatgccaatggtgccatttgaattggtgaacgaatgcacaaaggaaaagctgacattggccaaggaatatgaatggggcatcggttggataatgaaacgaagcaaaattattggggagacagcggcggttcattggaaagacggaaattgngacaagaattgtcactatgtgttcttttgcctttttagtggcactaattgcattgggtgagcaaataaaaaaaggcatttaattntgtttaaataatacagcgatcaaccgcagaagaagaaaatgaataatnangaatgatngatcgaccgatcatattcatccgtgatcaaatgcattttatgaagaaaaaactctcaatt

SEQ ID NO: 26275 - DNA, 1869 bp, Heterodera glycines
cttttccgccaccactgtgctgcttgcctgctcgcaatactcatggtgcacaatgatctgcaacaaatttggctggaatggacacggaggtgggaaatgggaatttgatcaaaaaatcgaacgaacaccgtataccagacggtatggtattaaattgattacagatggaccagatcaagttggagacggacgacctgtggacggatttgttggcgatgggtgccgggacaccgtcaaatagggaacgccgccaagtaaaaagcagagaaaaagcagcaaatatttacaaatttgggtcaattcaaattaaataatcactaccaaaaatgttaattgatctgtttttgctctgagtttgaatacgcaattaatccgatcatttaaccttcacaattgtacgatagatacctaataattaaagatcggatttttaggtactgaaaatactgaaataggtgaaaaaagtacaaaaaaatggaaaaatccagtgtcattatgcataaaaatgactcattttttaacaatttcgcccgcacaatagcaatttgtcaagaaaataaataataaattttggagatggatttttgagaattttttcatttgttagtgatgttttttttgaaaattttgggattgattcttagggggtatatttttcgttttattgcacttttgctatgaaatttctgggaaaaggctaaacaggtgctaaattcgtaattttcttttgctatttgtgctcccttttccgctccatgccaatgcctacggcggctacgccgcctcgggcgtacagccgccggccccggccgttgccgcccccgtccaagtggcgtccgggccgttgtccgtgggcagtgtttgcagtgagagcaaattgcactagggaattaagcccaattaaataaacaaaaatgccaaaagattgcaacccgacaaacaattgcccggccggaacgcaaggccaacccggcaaaccgggaccgccagggatcccaggtgcccgagacggagcagtacaaagaacacattgcaaattccccccctcccccccccccaggcgtcccgggcaaagacggagtgccgggcttttctgccgaggacgcgcacaacgcgccgttcaaaggatgcactgttagtggattggaagcccctgattaattgaatttttgctcataattttccacagaattgtccgcaagggccgcagggcgtgcccggcgaggcgggcaaaccgggcattcgcggcatgcgcggccccaccggacagccgggaatgccgggaagggtacgaagcggtgcacctatagcatcattgaaaaaatgcaatttgaacaaaaagcgcattcattattttaggacggagtgcccggctttccgggcgaaacgggcgccgaaggggcgttgggtactgtacaaattaatactcattttgattatccaaaaattaaaaggtttgccgggcgcagcgggatcgcccggcgaaaagggcgaggatcaaaagaaggaaatcggactgaagggaccgcgcggaccgacggggattatggtgggcgggaatgcggcataagaataaactctcgataaattttgccagggtcccgagggacctgtcggactacccggcaacgcggcaccgcccggccgcgagggcgtgtacggcctgaccggaccgccaggccccgcgggtgtgccgggcgcggagggcgaatacggcggcccagggtcggccggacagccgggcaaagacgcggaatactggtgagagtagtagcgacggcacaaaatagggatgggattgggatgactgtcaatggcatttcttagcaaatgccccgggcgcgacggggccgccggcggacaacgcgg

SEQ ID NO: 26276 - DNA, 1351 bp, Heterodera glycines
tcttttttgttaaagaaaaattaaaaaaaaattaataagaataaatttaatttttaatgctatttcccaaacatttttagggaagttaagggggagggaaaaaagaaaattgagcggttaaccgatttttgtcataaaataatgaaatttctcggttttttggtcaatctcctaataaaaaaagaaggcttctgtagtccagcgatggcgatagtcgctgtcgggaaaatttagctaattttgacctatttcgaaccgggaatgccatcaaaatcccgctcccgtaaaaaaaaatcacgcaaggaaaaagcacgggatcgagattcccgcaaaaatctcgcgggaagtcccgatcccgccggtctcaagttgttggttatacatccattttgtgccactttttccagagcacatttttagaaaatcaaagtgctcataaaaatgcatctctattccatttaaaattaaattatatttgtaaaatttaatacataaaagttttttggcttgctgtgcttccatttgctgctcgtctaatgcgccgtttcccatttgtaactcctccaatttctgtcgtttttctttttggatttcataatcattgtttttatcggccgttttttgctgcacaattgaccaattagaatttaaaatttccatttcattttcaattttattttcacgtgcctctccaaacattgtagcctctgatgatgatgatggtagtgataataatgatgatgatgatgatgataatgacggaaaatgtttataattggggatgaattgattttgttgcaaattttgcgaatggcacattaatgacgaagtgtccctgtgttaacataataattcagaaactgatttgataaaataacattaaaagcaattttttcaagcacttttctatcttatatactgtaaaatccacaaatttaattatcagtttatatagaaacattaaaaaaccaaagggggaggggtgattaatttttttaaactgttttacattttcagggtcactgaataaattaatagcatcttattaatttttcaaaattttcactcaaaacttttgttttttgggaatatttgttaaatttcaacattttaatcatataaacccgacaaacaaaacatttacattagcatgttaattgcccattcatttgggatcaacattggctggtcatcatcagcggatggatcattgaaattgctgttaattggatcaattaagttgctgctaatgctgctactgcttgatgaacggttctcgcccattttgccttcaattcgtggtccatcactttcattccttttcttattactgtccattccgtcacatttt

SEQ ID NO: 26277 - DNA, 1439 bp, Heterodera glycines
ttggataatgcttatcaaaacaatccttcaaaattagtggtcggcctgacggtgccaataggcgccatcgaggcaactctctaatcagtacttcaatatgggtttgatcagtctatcacaggcgcatgatcaaactcatttaatctgactaattggtaccaaatttattgattggtttctgactatctgatcagggcttgtttgatcatatttatcgattagtggtactaattcaatggtaataattgaaaaaattaaaattaagtttttatgaatcaacattttcagaccagtcgtttcccctccgttgttgccccccgtgaaattttcttaaaaaaattgctaaaattcttcaaaattctaaatttgaaattttttaaaaagatttccggaggaaacgacgcggcgggaacaacgggggggggggaataaagtgcacccgaaaattttatcacaaaaattgatcaaattcacaaaatactttttctccccactgatcagactgaaggacaaggaggacctggagaccgaagcggagaatcagcaacggtttgagctgcaaaagcagcagaacatgttgcgcaccaacctgaacatcaaacgcgcaatgcgcaaatggatttccatggaccgggagacgaagcagcaccagaacggcaacggcacaacgacgctcccggactgggccatgtgatgtggctgtcatgcgcacaacggcaccagtgataaatcgatcgattggaatgatcggatgatacagttcgggaatgatcagtgaaggaagataattgggattgaccaaagctaacggatattgactgaacaaagagagagaaaagagcacgctaattgaactgatcagtttttaccgggagattggaccaataagctgtcatatttacaccaaaatatattggtgtactaactgatcatgaattttcggttatatattattgtctattgaactgatcaaccggcgcccttgttcagtgaaaagtgcagagatcgggcgggaggatgatcaaaaatactcgggaatgaaaatgaaaaaaaaacttttattcttcaatacattcgatgcctaaaaatttctaaaatttgtaactcgacttgggttccgctgatcattgccgatcaatttttatttccgatcaaaccattaaaagttttacaaaattcaaactggaggaaaaaaattttttcttcccaccaagcttatttagttagttttattcccggctgatggtctcgggcttaatctcttcgagccaaaaaatgccaaaatccaatctgctcattctctctttttctaaagaaaagcaaaaatattatgtgaataaattaattatgattattgtcatctactacttctctctttgctttatttaccacattttaatgtacatacacaaaaatgtattttatatttctccgattct

SEQ ID NO: 26278 - DNA, 1437 bp, Heterodera glycines
  misc_feature (1405)..(1405): n is a, c, g, or t
tgtaacggtgccataaccgctgcaattggaatcggccttttaagcctaaaaaaacaaaattaattaattaattttaatacaatttatttttcgtgtttacaggtttgatgtatcgaacgacggtaatgttgacatcggaattctttccgttggcgttctcacaggagatgcacccgtccagcaacagcagcaccatgtctgatcaacgagcagggggaacacggagcattaagcattttaaattgttgtaagacccccggtaatacgtgggttaaagatgttaattgtctcgaatcaccactaaaacagtcgggggttcattttgtgtcaggtgattttccggaaattggttggacattcatttatttgtcagaatggggctggagcccaaaaaagatcaacggcattgagtctgatcgttggcacaaaaaagggcctagattcttggtctcgaggtcactggtataataatggtcgagcaaattgtcatggactactcgctaaagttcgaaagcagggctgggaaatattcaccgaataatccttagcattaaatcaaagtgcaaaaccccaaaattttctacattttcgaacccgaaatctcgtccagctctgatcagaacaggtccaataaaagtaagtgatcggtttttccaccaaacttcaaccgcataaaaaacacaccctgcatgaacccgcgcttgtcgaactcgtccatgtccttgatctcctctttggtcttccccttcccgaaaaattgttgcgccccatcgattcctcccaacccataaaagttgagctaaataaaaacacaaaaattataataattttcacattatacactgactttagtacaatatgaccaagtgcttaaaaattaaaatatattttaaaattgaattaattaatttactcaaattgtctgtgtccgcaaatttctggcgtaatcacaattctgtgaaacgcgattaaagtgtcaggtctttgcctttcttgctgcttctccttgtcctgtgatttgacttcgaatacgtgaatctgaatatatataattttaggaaatggaaaatttgaaaaattgctcactttattatataaattcaaatatttaattcaaaaatatactatgtatttctttctggcccgtatccataaaaaattatctgtgggggcacccgaaattaatttgcaaaatctcaaaaattttcgttaagtttcaaaaaagttatggccagaaggaactcaaaaacccagtaattcgaactttttttgctctgatttttttgtgcataaataaaaatttttgaaaatttgcaagctaatagcatttttcgaatgctttcgaataataccaagaatgtttaatttggttgagaaagaaaaaagttatggtcgaaaaattcgntcgacgacgtttcggctggacgacgttttgtc

SEQ ID NO: 26279 - DNA, 1138 bp, Heterodera glycines
aaataattcagttaaaacagcttttaattttaattgtctgaaacccataattttatctgtagaaaatagtcccatatgaacaagacataaaaagtgctttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatatgaacctagacataaaaagtgcttttgcgcaacaatctcccctctggtgtccttcattttaggaaggcactgaaccgtatacaaaaactctcacattctaaaataactcagttaaaacagcttttaattttaattgttctgaaaccaataattttatctgtagaaaatagtcccatatgaaccaagacataaaaagtgcctttgcgcaacaatctcccctctggtgtccttcattttagaaaggcactgaaccgtatacaaaaactctcacattctaaaataactcagttaaaacagcttttaattttaattgttctgaaaccaataattttatctgtagaaaatagtcccatataaaccaagacataaaaagtgcctttgcgcaacaatctcccctctggtgtccttcattttaggaaggcactgaaccgtatacaaaaactctcacattctaaaataactcagttaaaacagcttttaattttaattgttctgaaagctaataattttatctgtagaaaatagtcccttat

SEQ ID NO: 26280 - DNA, 914 bp, Heterodera glycines
ggatagattcacccggcggggattcgattttaaatgaaagcaaaaaaaaaaattattccaataaaaataacttttgccaaagagtttaaacagaagcgacctaactaatgtataaaagatatttccggaacttcatatcattgaagaaatgtgaaatttacattcttaaggatcattgataactttgttggttacgccttttagtgtatatttatttcctagcacagaatcctatttcgttctttaattcacagtcagcttcataaattgaacaagaaagaaacaaacagttcgcttaatcggtccaagttttgaaaagtttgcagaggaggcgccgtcggaatgactcgacccttcggcggtaagaagaaaaagttcgaattggccgttgcaggatttgaacagaagttgctggtcatctcggatttcaaccttcacttgactgaagaaataaataatttgttacttattaaatttaaaggttcttttaacataccctttcagattcaaatatgtacttaattatatacttttttaaaggacaaaggggttttcggggtcgctgatcgcgaaaactaaaaagtttaactctgtttgattcgggttcatgcttcgaaattagtcaaaacgggtgtcatattcgtgataattgacgttagttaaaaatcgtgctctttaatgtatgcagaaaagtatcagttaaacctaataattgccatgccaatacttttacatacaaaaagtaaactgactgaccctccaacttcggggtcattcgctttgcaataaaatttgaaatttgttcgattcagcaccgatttaaaagcagctaaaaacaaattataaatgaaatccaaaatagttatttgttaacccaatgtgattttgtcagccgaggcggggacatccgtaca

SEQ ID NO: 26281 - DNA, 1416 bp, Heterodera glycines
  misc_feature (33)..(33): n is a, c, g, or t
aatgaattttgttaaaaaatggccaactgattntaaaagccaccggtccgatctctagtttttagccaaggtcaaacccattctaaacagattacgctttcgaatgataccaacaatgttggattttgttgacaatgaaaaaagttattatattgaaaaaacatgctggggccgaatcgtgattttaatataacgactcatcactagggctgtgaattttaggttttaactaaattttttgctcaattgttttgaagaaaggagctcaaaaaacgcatttctgcattaaaaattttcgattctgatgtcgttatcgttaactagaaatcactattttggcgacttcgtcactaaaatagttaaaaatcactattttggcgttttgtcactatttcaacatttttggaaaattccttaacaaaaatgcaataaaaactaaaaaatacacccctaagaatcgacctaaaaatttaaaaaaaataccagttggaattggaaaattttcataaaaatttttcccccaaattttttttcttgacaaaatttttggtttaaaaatttcaatatttgctaaaaaaatgtaagaaaggaatgtacctcatttgtaactgcaatcagtgaataaaatattttggcatttttgctcactattttagttaactatttcgagatttttggtcactaaaagtcacagccctactcatcaccatagtaaaaaaaccaaatttggtgggacaagattaaaattccatgtcgaaatgaatcttttggcgttttatcactagggtgaggatggagggttggtttgtcatctattgtaaagaactattgtggttttttttatattcatttacgcaatctcggaaagttcttatacagtatgtaccaaaaatatacgttcaaataatttttttggtacttcgattacttctcatgaataaattgagctgaaatttttaccacacataccctcctcataattatttagactagagttaagccgcgagccctcggggggcagaattcgggggtcgggtctgggggagctcaattgtcgggggtcggggaccccgatcgggtagtgtttggcattttttaacaaggcattttaattaaaatttgaaccttggaattcgctttccgaattatgaaaatttttgggttgttaagggaactttttcaaaaaataaaccaattttttgattttcgagccaatttttaggaaaaaatttggagttttggggggccggcggtgccgattggcgccgccgaaagtttttaggaatttttaataattttattatgaaattgttcaaaattacaaaaattatcaactttttcctccttcgttgtttaattaacttttttaatttttacaacgcccggagtccccaatcccccgaaatagtgtcgggg

SEQ ID NO: 26282 - DNA, 1070 bp, Heterodera glycines
tattactgtgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcagttggaattcctattactgttgagcagaaaaagagatagccaattttccaaatttttcccaaacaaacgcgcagagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtattggcgtaattattctgagaatgcagttggaattcctattactgttgagcagaaaaagagatagccaattttccaaatttttcccaaacaaacgcgccgagaaacaa

SEQ ID NO: 26283 - DNA, 1882 bp, Heterodera glycines
attattaattttagaataataataattaatcaattttaattaaatttagtttataattttattttacagtcccccattcgtacattcaaagcgaaaattagtcaaaataatgttattgaattgtttattgacgcccttccagcaccatgcccttttgataattgaaaataaattgtgcatgatattataatatttaattgagaaagaaaaaatatatttgcgaattcaaaatggaatgttttttttattaattttagaataattattaaattatttataattttatttgtgaatttaaaattaaattattatattgtttagaaataccaatttgataattcttttaattaattaattaattaggaaaattccgttaattgatttctttattgggtactccttccatggaaatttttttattaattattgaataattaatatttatttaaattttttatttgcgaattaaaaataaaaaattataagtattgtttgagaaaaaacaatttaataaaacctattaataaattaggaaaaatccattaattgttttctttattgggtaccattcccccacccttcccttttgataatttatttatttggcgcgcttaaggagtactgttattaatttgagcgaatagaaatacaaatttgatgatcttgagaaaagttctttaacaataaaccaaataaactgcttttaataaaatgaaaagctaaaaagggacggtataaattatgtatcaaaaataacattttattaagaaaaaataaataattttaattattttcgagattttataaaatatcattattagttttacaatttaaaatattaattaatcttttaataattaatttaataataaaaaaatataattttaattatacggtcccccattccttttttcattcaaaccgaaattagtcaaaaatccgttaattgatttgtttattggtcacccttcccgcattcgttccatttgataattgattgtttgttttagccctttttatgggtactggaattaatttgtactgatagaaaattttgataagaaaattcataataaataaatttatttgtttgttaataagaacttcaaaagctaaaggcttacggtggctaaattgtattaaaaataaattaagaaatataaataatttttaattatttccaaatttaaattgaaattattttattattaattttagaataataattaattaattaaacgtttttaataataaatttaattaataatttttttaattatacggcccccatttcttttttccattttaaaatcgaaaattgtgaaaattcgttaattgatttgtttatttgacactgttgcagcactcttccctttcttcattgatttgtttattttttcatctttaagggctactgtaattattttggattaaaataatgatgcaaaaaattattcaaaaatcataaattacatttagataaaaaaaacattcaaaagccaaagggttagaaaaaataaatgtgcatcaaagtataaacattcattgagtaaataaataattttaattatttgcaaattaaaaattatttgtttttttaaataataattaattaattagaacattttttagaatttaataaataaatattatttaattatacggccccccatttctttttcgctttaagtcaaaaattggaaaattccgttaattgatttgtttattttattgcagcccccttcccttctcgccattggaactcgccatttcccttatccctcgctgcaaccctttctcgccactctcggtgccgagcaatttctcgccatatttctcgttgcaatgtagtctcgccacactctcggcccgctgccaatcg

SEQ ID NO: 26284 - DNA, 1766 bp, Heterodera glycines
cctgttcacccaaggatccggaaaggttcgcgctctattcacttatgcgccactttcccggtgaccctgaccatcttaaaatggtaaatggtcagccttgtacctctttcactgatgctgcaataaggcacggtcttcttgaggatgacaaaatctgggataaaacactcgctgaggcagcgttgtcacgatggcctgatcaaatgaggtggctcttcatgagcatcctcgtttatggccagcccagtaatgccgtcgaattgtggaacaagtacaaagaccaaatgtactttcctcaaggcattaccacatcggcacaacgccaagcagcagagcttgaagccctagccgacattgattggcggctgcacagctgctttaacttaagctctgtgcattttggcttgccagacccgccaaactcaattgccaaaaatacaaatgcggcaattaataagtttttctttggcgatgatgatttgaatttgcctccagggcaaccaaatcctcgtccacagccaaatacccctccgccacttaacagcgaccaacagaaggtctttgatgctgttttgttggcaatacagtcaaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaggagctgctcaatcgtttgattctcgctccgcacattgacacgtgtgatgaagtcaacgagatcatgatggcgaatgtgccaggtcaagtgcgggaatacttgtccacggataagcccctagacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttttggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttccctaaaaaggcgggcattcgctatgaccattcaaaaaggtcaggg

SEQ ID NO: 26285 - DNA, 1405 bp, Heterodera glycines
  misc_feature (38)..(38): n is a, c, g, or t
  misc_feature (49)..(49): n is a, c, g, or t
  misc_feature (114)..(114): n is a, c, g, or t
  misc_feature (140)..(140): n is a, c, g, or t
tgcagatttttcgaatcaacaaaaaatgaatgggtttntatttcgcctnttgcccctggagagggagggcaatatgagcgtatgattgggacggttaagtaccacttaaaaagngaaataagaaataaactcctcagttntgaggaattatggactttgttttcagaggtggagagaatagtcaatgagagaccaatcacttacacttcccaatctgaagttattcagcccctaagacctattgatctaattttacccaacattggtaacaatagattggaaataaacactagatctgttgagaactcagacaatgattatattttggaaaattcaaacactgctaatgtagtgcaaagataccagaaggcaatgaatatggctgaaaaattttggcaaaattggaaagattcctatttattgggtctaagggaacgtcatcaagggaacaaacacacaccaggaaaagcaccaaaacttggggacgtggtgatcatttctgaaccacaaactccaagaaattgttggaaattggggaaaatagaagaaattatgtcacaacgaactgcaagagtcagaatttcggaaaaatcaattattgaacgtgctattaagcacttatatcccttagaattagccgaaaatgccaataattctgactctggcattagaaagcaggaacacagttctgtgaaacaaattcattataattgggcaaaggaacctcctcaaaataaggcgcttgttaaggaaaattccccaaatcactacagatgggcaaaacaaccaccgaaaacaataaatgatataactaatgtgacatgtatttcagaaatgaacaaagacttcgatgccgtgtctcttgattgtgaagagatggaaagagatctcgaggacgaaaacaaggaggaagaatcgaaggatgagagaaagggcatttcacaaattcctgttgaggaaaggcgccccagggatggcgttggagaaaaaagggttattattaacgctcccatcgcattcgtcggggatgacgaagtggaaccaattggacggacattccaagacaacgggctccgtgccctagttctggtgcactcactaagggacattgcctggtggcatcggttaccagaggtcgtcatcattaatgatgtttgtcagatggtcgtcgtgcggacaacggaatgggccgagcacatcagaccatttttgagccttttgggaagatgggccaaaccggcggtctggattggtagtccatacatgttgtgaggcgtcgcctggctggaccggcacagacagtagaacttgacatcacagacttgtgtttatgggtgctccgcgaatcactcaagggggaggaagtgcgttgtataagaagcgatgcccaacaatcattttctga

SEQ ID NO: 26286 - DNA, 1520 bp, Heterodera glycines
  misc_feature (89)..(89): n is a, c, g, or t
  misc_feature (121)..(121): n is a, c, g, or t
tctcttgctggtatgcacaatgctaactatctgcagataaatcgctatctgcagataaatccatatgcacaatgctaaggattaaaatncgcatgcacaatgacaggttctttcaaaaaanaatccttagcttgagctgcagctaggctacatatgcacaatgctaaggatagggtagcagctacctatctgcagattaaaatcactatcctcatcgagaggaggatagttgcgagaaaaatgtcaattaaaatcaaaaaatgtttaaaaattgaaaaattgtactaaataattttaactactcttctctcttcttcctaagtttttttgtttaaattgtatgatgatttaagttaaacgaaaattcgaaatttacaattttgtaaaaattattttgacattaataataaagcaaaattaaaagtaattttgggcaatatttgccctaactgcaaaaccatcactgatgatatcttcacctattactacacgatcatcgttttccggctgatcatcaacaaattcttcttgatcaaattcgggaatccctttcatgagtgcaatattatgtaaaatggccgcggcaattatgaacatgccaatgttttccaatttaattcttattggtgtttgaagcgaatgaaatcttcgtttccacctgccaaatgtttgttcaataatcacacgcgttttgctgtgggcattgttatactgttgttgtgaattattgatgggattagcaaatggggttaaaagccattttttacagggataaccactatcacctaaaaaatatttgatgatagaagaaaattgaaataattttattacccagcaagacaccacgcaaccgcctgctttcaaaatcttgccaaacacttgagtgccgcaaaataaagctgtcatgagtgctccctggccatttgcaatttatatttaaaaagcgtccattatggtcgacaatggctaaaatcctcatttttatttttattttatttctttttttgccttgggcatttatgctgggccatcctttgcgattgtaataatcccgaccatgccgcacttcagagggcatcaaaatcgggatatgtgtacagtcgatcagaccgataacgttcggcattcctgccaccgcattaaaagcgggaatagagcacaaacgtgcctaaactctttaattatcaaaaaagttacacaaattactgtacattttcgtaatcatcaaaatatatgaaatcgccggcctttcggcataaagctcttgttacacggaaaatggcacgcgagactgatgcttggtgaattcccaaaatgtctccgcaccataattgaaacgacgaagatgccaaatatcccaatgtggccaaaacttggagctctgttggaagagctccactcttgccagttttccgctcgacgtcttcttggacaagttcacaaatatacttaatcactacatattattacatttattaatatttaaattttgccgacttttaatccatttcgattaaatc

SEQ ID NO: 26287 - DNA, 1838 bp, Heterodera glycines
ctcaatgattctcgttttgatcaaaaggcttttcgaaaacgccgaatttcttcatttcaatcgtttttcgtggcatctatgatcaccggctttgaaaaacctttaaatttcagcattcaacaattaaaatggaatttttctctccatcgagccgtttttttgaaccaaatggaagaggtcgagaagaatttggcggatgtgaagaagaaggatgtgcatggcaacacgtcagttttaagataaataacaaaatcgaaataattatttccatttttaagcgcacttcacatcgcttgtatgcttggcaatgaaggtagccaatgtgtactgcgtttacagtattattcgatgtatttttattttacagaaattgcgcgcattttgttggagaagggcgccaaagtgcgggcgaggaacaatgccgaatggaacgcattggacgaagccatcgcgtatggcgacgttgaattaggtgggataatttcacttatcaaaactcaccgaaaaccggaccaccgacaaattgacgcggcatcgacccttccgacacgccatttcattccctcgaagcggcaccaacccttttccgacgcggcattgtcccaaaatggcacggaatttccccgaagcgtcaacgacctgtccctcccccgacgcggaaccgaccctcccgacgtggcatgtcccgaagcggcacgaccatttcagggttttccccatcccctcgtttaatttgagcaggaaaatgcaccaactcacactcactcacccgacgaccaaaccccacagctttaaaaattaaaaaacaaaaaatgacatttttgtttgtaatttttagcatttaataaatcatatataattttattgaattttcagttcaaacggtccacagcatatttcaagcacaaaccaaaatcgcaatgttggacaccgcgcgaaaatttaacgcaaatttgccaggaatgggcgattttagcatcgacataaaatgggtaattagcaattttaatacttaaaaaaaatccaatctcaaacctcaaattttacaggaactgaccacactgttgcgtaatatttttcctttaaatataacataatttttgacacaacctatcttcaagcactgccatctcgtttgcgccctgaagataccatcactgtacacaaaaaaggagaaaagttgcgcgtcaatttttccctcaaggaatttgacatcacaactttcaaatggtaatttcatttgctaattcgtcggggttggagcttcataatttcttttttggaggattgcaaaatgatagttttaaagattaatttgagatcccttggtattgtttaaagaaccttttgtttattaatgtttttcaattcaaaataatttctaggcaacggggcgacatgactttgctgctggacatccacaaggatgagaaagcagtattgttggacaatattgagaaggtgaattttgccaaatttctcaaaattaaccattatttctagaaatattgcgtttttcgaacggaggaagtgttgccgcagcagcttctgacggagaagaagatcaccaaataccatttgaacgccaaccaactggacttcaagagggcaaaaacactgctaaaccatgagaaaacggttaattattttgaaacctaaacttgaacagaaaaattttaaattgagtttcagaaatataaaaattaacaatttttcatccacattctttttgctatttccaatctggctattttagtttctaaggtttcagcagtctggtttgatcaccaaaatataatgacctgaggcgcgtgagaaatgtcaatggaaacgaacag

SEQ ID NO: 26288 - DNA, 1298 bp, Heterodera glycines
  misc_feature (41)..(41): n is a, c, g, or t
cagctgctgctggtggtgtggacaagcgaggacggctcacnaccgaacagtggcgaggccaggcaggagatgaacacgcggacacccttggaggtgggtgacgatctgtgcaagggaaacaaaagagcttgatttaattgaaaaaggagtcaaacgtgggcaggcaggagctacggcatgaataaaggatattgcaagaaattagactggttggaaaactttttactcaaatgggtactctgtaagccgaaaaaatcccaaggtgtctttttttttgttgcttttcgttcatcatttccgatgctatttttcaaaattataggcgcggtgtaccacaaaatgcgcctcgtttagcaatttctcgccacaaaattcaaaaattctgaactctaaaatgttgttttaaccgactgactgactaaccaagttgacattgatggattggcccagcggcacaggcgtcagtgacacaagctcgtggaacagttcgggttgcacattgcacgactcgcgcgccatgtgctcaatgtgttcacggtacagcgcaccaaacttttggatgctgcgcccgtccacgcccaagtcgaacaactgacagaacaaataaacaaacaaaatgagaaaagttcaattaaacacaattggatggagtggacagaaagcaatttcctcgcaccgaagctgggctcagaggccaggctttttcatgaacctgggtttttgccgaaaaaaccaaggcccgggctaactgtaagcaggaaacccccaagtcctgtatacagactttttccgaaatgtcgctctctaataggaagcatatgatttagtgaatattattaatttcacgctattagttatatataaaatggaaatttaaaaaattctaaaaataattcagaaaaaaaaaattgcatttgaactaccacacctgaatgcatccgctcttcatcagcacgtaaagcaaatggcgactgtcgtcaatggctaactggaacacggtgtccttggcgtagaaaatctgcagcaccggcaccaagtagttgagcaaccgcttggaatggttcgttttgcgacagctgccacccgtgccgaaccaacccttgccctaaggcataaatttacgaaattttgacggtttgccattatttttttttatttgtgtaagcatttttaaataaatttggtatagatatctcacgaaatattccaattcgaaaaggttgtcgtcggcgccgaaaaagattcgaccattgcccgagtgcaaaggtcgttgacgatcagtccgtcaagtggcaact

SEQ ID NO: 26289 - DNA, 954 bp, Heterodera glycines
tggaatattttctcagcgcatttgatcgtgaaaatttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttagaaaaaatggctatctctttttctggtctacagtcaaggga

SEQ ID NO: 26290 - DNA, 880 bp, Heterodera glycines
gcattctcagaataattacgccgatagtaattgatatgtgcatttgtttctcgccgcattagtttgggaaaaatttggtttattgtctatggcattttttgctcaccagtgataggaataccaaccgcgattctcagaataatttcgctgatcataattgttgtgcaatttctttctctgcgcgttaaattgggaaaaatttggatatattgtctatctcatttagtgctcaacagtaatagcatttcccaccgcattctcagaatacatactccgatgctaatgcttctggtatttgtttctctgcgcgtgttgtctagaaaaatcgtggaaaatcggctcatctctttttgtactcaacagtaataggaattccaaccgcatctctcagagtgattgcgcgcgatactaattgttctggtatttgtttctcgacgcctttgtatgggaaagttttggacaacaggctatctctttttctgctcaacacccccccaggacccccccgggtccaaaaatttttaaggaaaaataatattttggctgaaaattttaggttttccttgctgggctggtaccccccccccccagacctagcctcacccagattttccaagaaatgtcgctatttttcaaaaaatccacaaatttttaatgaaaatctgctaaaaatggctcaaaatcacaaaatttggtcattttttggataaaatctgttaacaaagcgcatttaaaaccgcaaaaattttcccggcggcgcctatcggcaccgtcggaccccctgtcccccaaaaatttttttgggaaaaccgcgccacataaaatacgggtgtgaaaagcaaaaaataaaaaaaaaaaaaggtcgtcgcccggggggagg

SEQ ID NO: 26291 - DNA, 2268 bp, Heterodera glycines
ttgtttatactttgtctggagttgtaaaattcagagaattgccgtaacaaccgtagcggctacaatgtaagtgaccccgaggaattcactgaataaaaataaggcaaaattcagatggatagcgcacagagcgggcattcgaatattcgcaacgggaggcatcgggggagtgcaccgtggaggttgttgaatgcattttgaatcttccaaaataaccattttttaagacagccaagacgtgagcgccgatctgacagaattgggccgaacgccgctgggcgttgtctgtgcgggcgttaagtccatcctggacattgaacgaacgttggaatatttggtagggagcaaaacgacagggaccgagcatcggcagcagaacaattactgatctgacattccattttcaggagacccaatcagtcaatgtggtcgttctggacaaaagtgcggtctttcccggcttttttggtcctcccactgcaattaaaggcccttatcacaccgattcattggataaagtggccgacattttgcgtacgtccattttgtggcatcattatttaattctaccaattttatcagttctgtccttccaaatgggcctcccaaatggcactcttatcgcatgtccactcactgacgatgccgttgacaagcggttagtcgacgaaagaaatgtaattgcggaagcgactaaaatggcactgaaagaggccgaagaagcaggcatcagaggcaaggaggtgacaccgtttgtgctggagagaatccgtcaacgggcgggaaaagccgcaacagaactcagtgagcgaacgcacaaataattacgagaatatgcgtcctttctcctcacttaaacagctttcagatatcgctttactcgaaaacaacgcccgaattgctgcccgcttggctttgctttgctccagcaagacattacccgccggcattgaaaagcagcccttgataacagccggccagcaaaactcgtccagtcaatgcgaaaacggtggcacagtgaaaaaacgccgtcccaaaattgtcagttttgtcatgtctgctcatttccactgctgacaatggtatcatattaaaggtgtgtgccggtgcctctgtcgttgatgtctctgtgtttcttgaccaaagttccgttccgccgcttggcccagccgccgtcggcacttatcttccggcgcggatcattcaaacaagtggtggggtggcgcggaaccatgcggacgcactgagtcggttgggatgcgacgtgacactcatttcggcattgggcacaacgacggaaagaaatagcggcggcggtgaagagtcacggaacgatacagtggatctttatggacgctttttgatggaaaaatgcgatcacattgtttgtctttataatcataaaccgttaagaattgcaaaatttgtttaggattggtcccatgtacgccactgtccgggcacagcgactgccagttcagttgggatttgttcaaagggcacaatcatttcgcaggcattcattgcggtggaaccaattatggagcgcatagatgagaaatatgtatgaattaatgacatgattggtttgtccgaacctttttagattcggtcaatggaggcacacattgccaatgccgactttttgctggtggatgccaatatgaacagcggggcattacggatagcggtcgaattggcacgcttgaacggtgtcaaaggtactcaaactgaaagccaatttagggggggggtatctacgaccaaaagaaaagtgtctcttatcgcctatagtttggttcgaaccgacaaattggaccaaggtgccgaggctgttcgaagcgcttggcaaaaatgctctgcacaaagtgagtgccatatcgccgaacctgaacgaactggaggaagtggtgcgacggttgaacgatgagaaaagcctaatgtttgtacgtgggctaaaaggttgttcggttgggcatttgaactaataatgacaaaacctatctgtcagtttttctgaactcgctttgctattcctcggcaccgaccgcccatttcacgtcgcttattaacgaatggatcgcacggaacgaagtgcccgtcaccatattcccccggtcaatgtcccacctgctggtcacttgtgactcgatgggtgtccttttgttcgtgcattctgcgggctcgtcctcctccccagtggctcatcatttccctgctccatgagaggtcgacctgatcagattgtgtgtgtgtcgggagccggcg

SEQ ID NO: 26292 - DNA, 1192 bp, Heterodera glycines
ttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaactttttaaatataagcctaaaatttttggcctgtttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaagcaattaaaaatttttagattttttattcatctccctttttgatagtgaaagcatctgagtgccttatttaactttcaaataaaatttggtgcgtttcagagcactttctgaaaaatacttatgaattaattatgcaaaaaataaataaataatgaactctcttccttttgaaaaattttcctgcaccgaagcgtactcactttttccgcttcgcttagtcctttac

SEQ ID NO: 26293 - DNA, 1271 bp, Heterodera glycines
tgcaaaatttcttcaaatttggttggttgaaattgcatctgtgatacatttccaaattttttgactcggtaaggcgctttgacaaagacggctttcgttttgcaattagtcggtcaacattcggaaattggtctcgaattttttcggcaatacgtgcaatcattttaaaagaaaaaaaacataaaagccaaaatttattaattttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatggaccaaaatgccaaaatatggaaatatggacataaatcgcgaaatatggaaaaatatggaaaatatggatatagaaatccttcctagaagcttcaaaccaagctaaaaacatgtttttcgtgcgtttcaggcctcccacattccaggaaaaaaatatggatttccatataattaccatccctactgatgaattattatcggccgctcattcttaatcaaatcatttcttctgctgctgatcactgtttttgttgttttgtccgtcactcattgtcagaagacggcccatttgtgatgctttgtcccccttcttcgtcttcttcttcccgtggtggcggagacaatggcctaaattaagcgaaaaattcaaatttggataaaaacaaatgcccttttattgctcacccaatgctattagtgccactaaaaagccaaatgaaaacattgttccatttgccccaatgttcatcgttcttctgaagctgaacagccgcggcctccccaattttgcatcgtttcattatccaattgtccgttttctttgctttggccaatgtcagcttttccattgtccattcgttcaccaattcaaatggcacaatttgcattggggcgcatgaacagtaaaatgaatttcgtaactgacggaacaaatggtggtacggagaaatgccgaaacaatttggaaaacaaaaatcagtgatttgccgaaattatggccacacctccttgcaattgttgacccaatcgaggtacggttgttcagttaaaagttcacaacacaatcgcttgggttggccatcttttctcggagtttgcaaccatttgta

SEQ ID NO: 26294 - DNA, 1305 bp, Heterodera glycines
gcatcggctcaccggcgccatcaactcttacatggccaaccactgtgactccacaagaacagcttgttcaatattcgttgagctcgctatcgatttcaacagcctcttcaggcatatattttttcacaaaactcgttgttttcacgaatctttcgtttatatttaataaaaaatttagttcgcgtgtgggaggaagaaatctttcgggcgctccatttcccaattccgctttggaacatgcactcgcaggcggcttctgcactcgctcgtacaaacaatggactggaggctactcatctacattttatggtctttttaatttagtaaaaaaaaaaattgaaaaagagtatttagaagggtctctgtcatcacccggcactctcggacttcatctgtggagtcaatgaaagcatcgtcagacaggtggacgctgcccaatctgctcgccatttcattcacaagcgacaaaagcgatacatcctgcaggacgcgctcattatgcgaattttagcggacgcgtcgtacaacaacaacggtgaaattcatgaccttatgacggccctcggtctacaaattgaaggatacgcaggaaaattaaaagatttcgaaaattttgatgattcgattgttcatgttccatgatgaattttattgaattatttaataaatttattcactttcaatgtatgaagtttagtgtgcctagagcccagagatataattcgaatgcttacaaatagaattcggatcacctaggaaccctaaaacttgttcgaattttgatcagcgccctttgacgaagccttgaatttttttgctattttatgtttatatctgggtctaggattaggaaatgggttatataaaggtcgtattcttactcagtgaccccgaaaaccctaaattagacccgttttccgggtttttatgagctttttagacttttggacatttcgtggttttttactcttttggacatttcgtggcttggacaattcgtggcttggacatttcgtggcttggacatttcgtggcttggacatttcgtggcttggacaattcgtggcttggacatttcgtgggtcagcgcgatttatagttcaaactagagttgctcggtaccggtaccggtactggccggtaattaccggttttttcaaaaatgaaattaccgttaccggtttgtctagtaccggtaccgccggtaaaaatttgcactggtaagaatgggggtctggtcgagaaaagagtaggaaattggtgaagaaggagaaattttgagaaaaaattaaattttatttcatt

SEQ ID NO: 26295 - DNA, 1017 bp, Heterodera glycines
cgccaaccaatattttggtaagtttaactccgtttaattttcaatttaacatttatattttcgcggtcattttctcattgtttcaaaaattttatcaaaatgagagtcaaaattttgccaggtcattgtcacttttagtgaaggttaattaagggttagttacatctaatttgtaaatacttttgcatccctaattaagtgtcactttcctttatattaattcatcgaaagatttataattttataaaatgattatacttaagttgtttgttttcagatccgtgaaaagcagtgcggtgacaaaaatgtttttccgctgaacaaatggctccttcttccacgcaaccacaaagagcatcttccgttttatcttttaatttataattatgaaaggaaggaacgaattatgatttgattaaaaagttaaatggcaaattgagtttttattagcgtcgtcaatttcgtgagctaattatgtctttgttcgtccccggggttaaggcgcaaaagggagctggaatgagcaagtttgaagtgtatgctcttgatcagtcggttagtttctaatcaggcaaaataagttttataaattaatttgccgaaattagtaaatattcaaatataaaaaatagcggtaagacttggactcagcccacccgaaaaaatgacatgaatttgttataaaactgcttaatattgaatattattcacaaaaatgtatgaaaaagtgacgatatatagcgaaaatttttatcaacatttgaaatttttcaaaaaaacgtcatttttgagtgaatttatcaagaaatatgctgttatacatctatttaatactgtatttttagcaataaaatgcaatttggaatagacgcaagctcttacatttttttggagatgagcaaaaagttataaattggaaccttgaaaacggcttgataacaaatgtgcgttactgctatggaaaacggccgacacaaaagtacaaaaaggaaatgcgtttgacaaaaacagaggcag

SEQ ID NO: 26296 - DNA, 1430 bp, Heterodera glycines
tgcaacacagttacagcggcaccgtcttatggcattcaacaggcacaattttttttttaaatttttttcattggctagagaattttcaaaattaatttccttgtccagaagagatcagggggattttttcttaaaatttttttaagtatttaaagcaacattgaaaaactgattataattatgacacttagaattcagattctaaacaaaatttagcgaataacctgaaaatatttgaattgatatttgaattgaaaaactatgtctaattccaattaaattaatttttaatttaattgattattatcactaaattattttcccattttcatgaaaaattgaatttttaaattaaaataaattattttctctttttatttttagtagagtagagcgggaccgggaattttgggcttaaccgggaccgggaccttttcgggttgaaaacccgggaatttttggctgggaaaaccggggaaaaacccgaaaaaacccgggactggtcccggtcccggtcaaaaccgggacctcggtactcagttgtccgtgttttggtcccggtcccgctctactctaattttttctattgaaagcggatttttttctttgtacaaagatacgattattgttgttcatagaattaaattaggtattgaaagagttatgaatagaaaattcaatcatctctatttgtaaagtaatttcatcatagtgatactaaatactaaaagttttgtattagtcactattttggacttttttaactattttggcactttttctcactatttaaaaaaaatgttttttggcttccttttttcaattttccaaaattagtacaccattcgatagagcttcaatagctttacaatttagttcagaggtgatctttagctttggtttttttcggtttcggtttttaaccgaaaccgaccgaccgaccctcttgtccggtctctaatttaaagtaataaaaaatggaatattatttaatttattctatgaaatgtttgtaaattaacaaaatggagcaaacaataataaataaaaacaatacaaaatgataaaataaaaaaaattgataacataaatttaactccaatgcgacacaatcaaatgcaaaaacccttttttcagcgagaaataaaaaaacataaaaattattagcaaagagaaatataaaaaatgatatttattcattattaattttgtggtgaataaaaaatgaaaaaattaaattaatttattaatcttttatttcatataaataaaatgatcatattccaaatatatttttattaattaatgattttattataagaacatttaaaaataatattttacaaatccataaaattcgaaaataaatataaaattaaaccactttttaaaaaagaagaacaaggagcgaaagacagattctttatgta

SEQ ID NO: 26297 - DNA, 1687 bp, Heterodera glycines
tcataaagtgcgattgaattgttaccccaaataaattatataattacttcccgaaaaactaattaatcatttgtcagaaaagtaatccgtgcgccaaaatatgccctagaaaagcgaggagatgaaagtgttgagaagacttgagaagattcaaatgaaatgcataaaaataggctaatgtgcttcgatttaaaaaaaattattttaaaaaaaagtttttgagttaatttattaaacaaagtaaaattagcgaaattgttatgagttaaataatttgacttttgttcctgcacgaataacataacatttttaaagaaaaattacaaatgaaatcaaatttaaataattaattacaaaaataattatactaaaagattttgattttcttctatccccatgtcattagtccatcgccgccggcattgcccgacaatgggccgcccccgcaaatggcactttccgagcacgacacggcaagacggccggcaacgcgcggctgcaacgcgtcctccaccttcagcgtcatttggccacccgcgccgtccaatttggccttgctctgaaacgggagaaaacaaaacaatgaatgcggcataaatgtggatggttaattcgggaattttgacatgaatgcggcataaatgtggatggttaattcgggaattttgactcaagaaattctcggaataacactcattttaatgtattcaagcggttatctctcgtggatttgtcaaatctataggaaaatggcacagtgagagatttacagattaattttgatccaatgaaaatgaaggcggatatttaagttctaaatctgtcggctttctactgaatatcttcagaattttcaaaatgtctcagggattaaatcaaaacgaaaaaagtcgaagtttaaataaaatggcactcgataaacaatgaaattatgagaaaattttcgataaatttacctccttcgccaattgccactggccattttcatctcttctgtgtaaagacaaaattttgtaacaaaaaattgaattaaattaaaatgccacctaaaagtgttcaattgccaatgtttgcttgcacaattattgccctttaactaaaaaaaattatttaatttgtttaattaatttttaaaaaacttaattaatattttgcttacaataacatttttggctcccggctcttcgaaaaccagtttttctgtctgctgtccatcgggaagcttaaaaacatagacaaatttaaaatttacgtttaaataaaatttaattgaatgatttgggatttaatttataattttacgttgttatattaaaagtagtgattcataattatcattttaataaacaataattaaaattttaaaaaatatcgtagcaaaatttcaattttttttgcgcctttcacctcaatgctaatcataaatggcgttttggtattcgagacgacatttgccaaaatttcgcaataaggtgccgcatgtgagaattttatgccgtacatattgaacaaaacaatggaagaaattgaaaaaaagaaaatggcaccgaacatttcaatcccaatttttaaaatctaaatatacctatttaaaatagagaaaatagagtataaataaagaacaattttgtaaatttcaatcaagtgaagggcaatttttttgaaaattattaaaaatattcattaa

SEQ ID NO: 26298 - DNA, 1517 bp, Heterodera glycines
  misc_feature (72)..(73): n is a, c, g, or t
  misc_feature (78)..(78): n is a, c, g, or t
  misc_feature (96)..(98): n is a, c, g, or t
gggaatatttattaaattaaaattaaaattgcgtaaaaatgggaaaataaaaaacaaatggacaaataatgnnaattntaatatgagagtaaacannncaataataaattttctttttaattactaaaaaaatattgaaaatcataattttttaaattaaaataaaataagttttgtttaatgaaaatataaagtaaataaaaaataaaaattgtttttgcgttaaaaagagttcgctttatttgagcaaaacttaatttgatgcttaccatttccactcaaacgaattgacaacgtttccattaattcgttaaccctttgcttttctcctccaaccaattctggcagtctctgatgaatctgaacagaaaaaagaaaggaggcaaaatagacgattaataagcctaatttgaatgtgataaaagtcaaattaaattttattgctattcgagagtctcgggtttcgggtcggcttttgacgcgtgaaaagatttttcgtaccgtgtagagtctcggaaacccagtctcaatcctcctttgatacttttcgagtaccctagagctcgagtcattatcatactatctctctctcgctctctatctctctctcactctctatatttctctctgtctcattctttctcttcttctagcgttctctatctttctctcgctctctctctcctcccctcccctttctcactctctcatactatctctttctctctcccctctctctctcacgtatatttttctctgtctctgtttctctcacctgtcttctcatttgatctgcttcttctaagctggccaatccaatcattctcaatctgtatgcaaatacgttctccccctccagacgtttcatatggaataattccgctagtttcggctttgaatttggcacttcccaactgatcaattggtgaaggcgatgtaaatgcagtttctcaatttcttcgtcaaattttagaagcctgaaaaggttttttggcattttgactttatttatattaaaacaaataggaagtgatcgccgttttgtcaccatttttggccattaatttgacaaaatcaaaaatatataaagacccgtgatcaaaagacttaagccatagaccgatccaccgatcacttccaccgtttatatggctactgatcggccattttcccctctcccccccccccttttgacggggtcaacccgccgatcagtccctcccagatttgatcattgatcgatcctccaatcagtctaccgcccaccatttatccccaaaccctctttttgccctaccatttttgctcttccgccgtttgagtgccgtcgtcttgccacgtggctctgatctgatcaatccgatcgcacatggcatccctccgaaatttgccatatttttccaacatttgccacccctttttcagcccattttccatccccgtgtttggcattttgtcagcagtttttaacaccaatttcaaatgcttgcaaaatgttaggtattggcaaatgtctg

SEQ ID NO: 26299 - DNA, 1738 bp, Heterodera glycines
ttattttctttttaataaaattaaaattgtggtgtagtggaaaatgggcacgggaaagatgggccgtgatcactgatcagcagcaggcgaattattcaggccaaaacaatgaatggccaaactgcacaaaattattcacatttcgccaactggtcacttcgccaactcagccaaaaacggacatttcgccaacattcatttcgccaaataacctaaaaacatttctctcgttatgaaatatgcacacaacaaaaaaccattcagtaataattagggctggcaaaaatatgtacaaaaattggtcagaatatgtatacataaatatgtaagaaaaataccaaaatatgtaaataaaaaatttttaaatggttatttttttggatcttcgtaaatggtgaaataggcacaaaataccataaaataagacttattgattcggcaccgaaagctattaactcaaggcaattctttcgtacatgactagagatcggaattttgcgaaaatacggaagtagttagtgtctataaatccgccggattacggtagcctcccatacctatgggagggggtgcaggccaactgagcgccagccatgtgagcgccgccggctgagcgcgggccatctgagcgccaaaattttcagtaccgaaaccaaaacctattgcgcgacttttttttttgcaacccaaacctattgaaggggtgcgcgacttttttttttgtaaaattttttttctgaaaattatttttttattatttttattttaaataataattttttattcgaaaaattctgcgaaaacctaggcggactcgaactttcgctctgccaacgaacccaacacactaccactctgccatgcgaccacttgtttaaatttaacgcgaaaggttttcgtttcaataaactatggcgttatgtatatatatatattgtggcgttttgtcttgttttgcatattttcaaagttttttcaccggactacagtacccctcgcagtgatgacgtcatcatctttgcagcatatagtggacatttatcctttttctggcaactggtctcgtggcagagtgatattgtgttgggtttggtggcagaccaaaagttcgagtccactagcctgcggattatttattgcgatttttcaccggactaccgtacctctcgcagtggcgacgtcacaatctttgcagcatatagtggacaattatcctttttctggcaactggtctcgtggcagagtggtagtgtgttgggttggtggcagagcaaaagttcgagtccgcttgcctgtggctaatttattgcgaatttcagcaggactacagtacccctcgcagtgatgacgtcatcatctttgcagcatatagtggacaattatcctttttctggcaactggtctcgtggcagagtgatattgtgttgggtttggtggcagaccaaaagttcgaggccgcttgcctgcagctaatttattgcgaatttcagcaggactacagtacccctcgcagtgatgacgtcatcatctttgcagcatatagtggacaattatcctttttctggcaactggtctcgtggcagagtgatagtgtggttgggtttggtggcaggccaaaagttcgaggccgcttgcctgcggctaatttattgcgattttccctggactacagtacccctctcaagtgttgacgtcatcatctttgcagcatatagtggacaattatcctttttctggc

SEQ ID NO: 26300 - DNA, 1335 bp, Heterodera glycines
ttttttgctaattgagcagaagcgtacccatctttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcgggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagttttcccagaatgtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgatagcgttcaattgctctagtcaatttttaaaaatttttgt

SEQ ID NO: 26301 - DNA, 2094 bp, Heterodera glycines
ttgtaaactaataaaatttaaacaaatatttttctctcatccaggcaggggactcattggcattgctttaagcatggcttttcctttttcagtcacttctcgcgcaccaaaagcaggcgaacagcaggggcgcgagtacaagtttgagcgcaaggaggacattctgcaacgcattcgtgatcgccaaatgatcgaatggggcgaatataatggtaaaaaaaattatgaaattgcttattttaatatcattcgacatccctaaatgttctctattagcccctaaaatttcgttaaatttaaaaaaaagttatggaccaataatgttcgaaaacaaggttttcgagtttttctggcaaataacttttttgaaacgcaataaaaatttttgaaattttgcagactcatagagaattcttcatgttatcgaatggatatgaagaattaaaaaaatttggttattcttgaacaaacttatgaataatttttcaacacaattttttccatttgatgatttttttcggtaacgtactaaccccaaaaaattgaaaaaaaattttctttcaggtgctttgtatgggacaacagcagagtccgtccgtgaggtggtccgatcgggacgcgtttgtgtgttggactgtagcgcgcgagcattagaaactctttacaattcagagtaagggcacagtcttcatcatttaatcacaaataccaggctcatgtcatattcgtaagaagtgtttcagagaaaatgccatagaattcatggaatttaaaaaataacaattttttcactccaattctcctaataagatttttttaagaatttaagactgattaaaaggctcaaccttcaatttatcaaaaaagaattttgttaaatttgacttaagaaaaattatcactaaaaatttaaaaaaaaaattttaaatttccaatttaaaaattaaaaaaaaaacacaaacacaaaaaataaataaattttaaattagacacttataaaaactgattaaattaaaaattatgaaaattatcaaatttaaaactgtcatgaataggatctgttttttctttatcaatactttatcaacaataataatcagatttatgccatttgttgtgcttgtggcggcaccgccctttgaagaattggtgcagctgagtcggctgcatgggaagccgcgcgaggaggacgaactgcgccgaatctgtgatcagtctgatcagttgttccacagtgattatgccaaatgctttgatctggtgctggtcaaccggaaccgggacatttcattgcggaggtacggtaaattgggcgaaatgataaaaaaaaaatagaagaaaatggtagctacggtaattaggcataacaatacaaaagaaaccaagtttgaatgatggtaagggcagcaatttaaaaaaattgagatatgatacctaattcaattacaataaacaacacaataggagctacggtaattaggcctaccaagacaacaatgcaactttgagagatggtgaaggcaccaataaaaataaataaaattgttgaatcatagtttaattatgtcattttttattgaaaaatatttatatttattggacacaatttcaattgacatttctgtaaatctagttttgtgaaaagttacagcattatggatatggtaaaataaaattaatcaattcgaacatacagtatctgctgtccttcgttcgctattaatcgtatccatcaaaggttgttggacgcgttggaagcactgaaaaccgaaccacaatgggtgccgttggaatggcttcagggtagtgccaatgtgaagtcgaaaagctagccaaaatcgtgacccaactcgaatatgatctttccaaagggtgcagcactacgttctcccccgaccccattttataaaaaaatattacacacattttttatactgactttttggaaacggtggggggggggggggctagctgctcgccttttcaagcatttgatatatttatgcactttatacaaataactagagatgggatttttaggtgctaaaaatcccaaaataggtgctaaaaaagtgcaaaaatagatgctaaaaa

SEQ ID NO: 26302 - DNA, 1080 bp, Heterodera glycines
  misc_feature (25)..(25): n is a, c, g, or t
  misc_feature (48)..(48): n is a, c, g, or t
  misc_feature (106)..(106): n is a, c, g, or t
  misc_feature (153)..(153): n is a, c, g, or t
  misc_feature (165)..(165): n is a, c, g, or t
ttgaaagagaatagaaagaccaggnttcgatgaagtttgttaagccanaaaaaatccaaacattaaaaaatctataaaaaattaaaatgagaattcatgcgagatnttctggaaataagcttaattgggcctagttaagctgtaaaaaaaatntggggcgattgnaaagagaatagaaagaaccaggttcgatgaagttttggtaagccaaaaaaaatgcaaacatttaaaaatctataaaaaatttaaaaatgagaattcatgcgagattttctggaaataagcttaatagggcctagttaagctgtaaaaaaaatttggggcgatttgaaagagaatagaaatagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttgttaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaattgggcctagttaagctgtaaaaaaaatttggggcgatttgaaagagaatagaaagaaccaggttcgatgaagttttgttaagccaaagaaagtccaaaacatttaaaaatctataaaaaatttaaaaat

SEQ ID NO: 26303 - DNA, 885 bp, Heterodera glycines
ctcgaactgcttgaagtgggcggaggagacattgctctttttggccgacaattctaaacatggaaaagggaattaaattggtttgaattggttgcaattgagtggacacctcaaaagcaaaagaagaaatggctggttgtgaaacagaaacattcagcaaatgatcaaagtccatcacttccaatgactccgacttatgcatgactacgcattcttgcgaatttgaccgtactaagggagccgctgaaagaaaaaaaactctgtactgcttggaaagatgtcataaagttcaacgcactttcaaaatggtgtcctttttgttttccgttcgtttgactcttttgctgttggccaatttgacttggaattgcctttcgctgtttagcgcccgccactaagggaactcgtccaccgttttcagttgacgattgctcgactaacacaaaagcctcgccacttttcagagactttatttggccaattgtaggggattctgtgcaaaagtgagtagcgcatgtgaatttccaagccgaagacaatcgggtcgcaatgtcaacgccaattcctggatttttaacatctcattgacattaattgcaattaataaaattatgtattcacctcggatttttcttaggtctgaaaagccattgacgtcgagcggaaacaatttgagattgcataatgctttccgaagaacaaaagcgtgatttttattaccactgtcctttaatattttgtctctccattcggtgagtgctctttcatagaacattttctcagaaaactcgagtcgaactttagctcgtttaagcttctcagccattggttaaatgttagaactaaaaattgggtactttttcactttacccccacaaaaaaaac

SEQ ID NO: 26304 - DNA, 1716 bp, Heterodera glycines
  misc_feature (1623)..(1623): n is a, c, g, or t
  misc_feature (1701)..(1701): n is a, c, g, or t
aaagtgtttgatgggatgccatgaaatgatcagtaaaataaaaaaatcaaagcgaagaccaaacacaaaaaaaaaacaaaataaaatataaaaatccctgactaaaaggcaatgagtgagcttacagacaagcaatgacattctcttttaaaagcggtcatcatctcggatgaagccatcattgatggcgacctaaaaaatcagattacgtattacgagtaattaaatccaaaatcattttgcacctgattttaaggcaacttcctctgtcattcgcactttgtcttcacaaatcgttgactttggcaaacttttgtgatcgatgcgccgctgtaagagtttcgttcaaacagtcgagaagacgctggaatgatatttttttgatttttttttttttgctaatcttggccataatttgtcataccctgtcctcgggcgatagttcgaagttgaccgaatgggagagaacgcgcgtcaaataatccatgagacgaaagcgcaacttcaccgtcatctacgaacacaacaattcttattgaaaattagaaatggctaatagtggtaaattcattgattcaagaatactattttttttactgttaggtgtaaagacctgtaaatcgctgaaagatccacggaacccaaaccaattgtcgagttcaagcagttcgtatggttcttcgggctccgattttgtaaaactgcgcatgtattcgggcaattgttctgccagttccggttccaaactgctgagtgcactaaatttcctatattttcaaataattaaatcgtccctcattactggtcatttgcgactttaccttgagctcagtgaagacggtgttgccatggcggaattggccgcaggaaaagagtcgaatgagtcatcactgctgctcgtggcactggactctataaaaatataatttgaaaaggaaagagtcatttagggaataattaccgccaatctcctcgttctcttcccgtttctttctctgcctactgtctgtcgacgtctgccactgttctctcttctccaatgagtgtccgctgtcattccaatcgctttttgtgtctgtggcgttctgtgccctcccgtccgtctgccgacacttttcactctcctccccccgttgtctttttccaagctgtttctttttgttttgctcttccaaattctgctccattaagtttctttgctccaattgtttgcgatgtcttcgtcgaagttctctctccaaatttcgttgttctttccggtgctttcgaagaattttatcgcgaaacaatttcctttgttgccggagagaaccgtttggatccactaaataaggaaatcaattcaaaaatcaaaaaagaaaaacaaaaaaatttaccaagttcaaaatatttcacgcatttgaggtccattcggacaggccctgcaaacaacagaatgtgtagcgatgtgacagcagtcacagttcggaccatgtgttgctggtgcgtatcaccgaccaattccttgagaataaaaatttctttaaaaattttcaggcggccgccgccaggtcctttctttcccagatttaattcgaaaaaacatgctgcaaaagtgttgtaaaaaggcgaatcacctgatanataaggtactgaagcataggctcggatcccttctggctaaaacttcattgagcttcgcagatcgtttggatgggtggncagtttgacgcctga

SEQ ID NO: 26305 - DNA, 2076 bp, Heterodera glycines
  misc_feature (2068)..(2068): n is a, c, g, or t
aaaattattattttaaaggaaaaaaaatttttttaattccctattttcccggggtacccggattcccggccccggtttaaaaactggtacccgaaccggtacctggcttttcaatacccagtaatacctgggcccggtttttgcccaaatacccgggcccagcctatcctagtttatacccaagcacacatgaattcagatcgtgctgggtcgtttcgtaaaaactgctaaatttacagaatttttaagaaaaatcagtcatgattcagaaagtaatgttttttttaaacatttttggttagaagtttctgaaaatttaatgaaatattcctaaaattttcatatttatagcgcaagtcgagagctatcgtgggatacaacgattattttttatgttgtatttaagaaaagttattactgatttttctcaaaaattctgtaaatttggcaaggtttttacgaggtcggatttacaaatatgtatgaaaaacgcattattcttctcaggcggaacttatgtataccttccgaaaatttttttttgcaccattcacagattttcttaacaaatctgaatgcgcgatataaccagcagagaccagaaatagaccaataaataaacaattagtctttacacttaatctcaggattaaaattcatttaaaaaatcgaaaattttccacattgaaagcggccccgacgctttcacacatcgggcggcccctggttgatagcaatgaaaatatacaatattagcggcaattattaagaggtcaacgaaaggcaatcaaagaatggcattatttaatgatggaaagtgaggtcaacgaaaggcaataaaagaatggcattatttaatgatggaaagtgaggtcaacgaaaggcaatcaaagaatggcattatttaaagttggaaaatgtcattatttcttcattttaaattctgaatacatttggaatttagtgttggacaaattataaattttttaactaccattttaatgttaacatcgcttgtttatcataaaataacttttagccgttcagctgtactttttttttgtaaatataattttgcgttaaaaaccaaaaacgtactttttcaattttgtgattaacttttctgctttaaatttcgtgatggttttaagtcctaaatttttctcgtcttcacttgttttcactcacttctggttctttatgtccgtattttttgggtccatacggatttttaaggactacggattttcggattttagtcgctaagtccgtatcgatgtcaagtccgtaaacctgatcctgatccgtattttcgcaaaatcacgctctctactgaaatctcagccaattgtatgcaaaaattatatttcaatcaatcattaaaactatttgttgtatgtactaaaaaaagcaaatatacaaaaatggccaattatgaacctgtgagataaaaactttcaaaaattttgtcataaattcaatcaatttaaattttctctctctctctctctctgtgagaaaaccttatcggatagattttgcacacaaataaaattatgaaaaattattctttcattttttaggtcattgttttgccgaagtgattttttgccttctcccactaatatttaaaagtgaaccatcgccagcaaattgttcatttaatcatttcatataccggtactcagattattcaatgtgcaaatattagatttatgttcaatttttcgaatattttgaaaatttcctattttccattagtgagcctaaaaaaattgttgggtgttagttgaatgaaattcaattttatttttccagcgatttatcatattttaaaattactcgccagggatagtactgaattccgatttttccgacattttttggggccgtaattcttatttccgaaaaatttttcagacctcggaataatgcaatgacagagaattacttattcttaacttagccccaaatgaattaaattttaaaatcttgatatttttcgatagcccgaagtgttttctattataatgaaaaatttcgaaaaaatcagttaagtttcaaaaanagttatga

SEQ ID NO: 26306 - DNA, 1952 bp, Heterodera glycines
  misc_feature (37)..(37): n is a, c, g, or t
  misc_feature (49)..(49): n is a, c, g, or t
  misc_feature (71)..(71): n is a, c, g, or t
ttttcaaaactttttcatttatttttcttgatttttntaataattttgnaacatatatgttcacaatgatntaattaatttgatttttatgctttaaattcaccaaatggattttcatttttatttataactgaaatataaaatcaaaaatgaatttgttggttgttgtttttaaatatttttgtacattatttttaatactctaatttatgctttttctacctctttttcttgtgtttgttttttaaattaataaattttaattattttatgggttaggaatttgagagatatagtttttcacagctttgaattttcaaattcgactcaatctcaaaggtacataatcctgctcttcttattgatgattgtcccaataaacatttatttattttttatttttattaaaaaatatcattgtgaattcattcatttatttattttatttttattttaaatccataatttcttcatccatcatttaaagccttcttaaacacctgcaaacaattgttcttgctaatgcaaaattaaaagaataattcaaagaattgaaaaaaggaaaattaaccacttttaaaatggttgcggttttggcgggactaagaaagctaatttgttagcagattttgttcgtaaatgcttaatgcccatttttggtgctctaaaaaatcatttaatttattaaaagataaatttttaaagtttattaattaagaaaaaaaggaaaaaagataaattttcaggaataatgaaagaaaaagcacaaaataaatatgccttaaatattttccttgaagaaatgattttaagtttttcgatttttttggtttttttcggtttttaaccgaaaccgaccgaccgaataatcaaaaaaccgaacaatcgatcgacttttatgaaaaatcaaaaaaacccaatggcgaattggagtaacataacctattagtaacaatattttagtgctttttgtgctgttttgtcattttgaggaattttttaaaatttatcttgctattttcaaaaaaattattaacaaaaatgcaataaaaatgaaaaatacaccccctgagaatcgagccgaaaaatttcagaaaaatacacccctaagaaagaaaacattatcaaaaattcatctccaaaatctattttatgaaacgccccagcacggtaccatcaatttacattagaattgtttaattgtcttgtttttcatgttttaaatgatcaattatttactaaatttattttattttttgttatgttttaatactctttaatgaagaaaggttttaacctaaatatgcctttttgagctgagtaaatttttttccaaaatagtgcaaatgttcaaattcttttttctaaacacacttttatttttattttatgcaaatgttatagaaatttcaaactttattatttctgcccgggattcgggattgggataggattaccggaatttaaatgccggttttgtcggggtcccgatcccgaccttttccaaaaaaagccgccatagggattgtaaatgcgattattaaatttttggagttttttcccgaataaggacaaagacaaatttattaaatttggcggtcaatttttgagagaatattttcgtttctttggggtcaatttcttgaaattttttctgatcatttcttaggggtgagttttcgattttgttaaggaatttttcgaaattataaaataggcacattaagcacaaaaatcccgaattttgcacaaataatcattataaaagtaatcgttgactccccaaactaagcggaaaatgcttttttccatccttatctgtacgtatcaattgcacaaaattttaggcatttgcctaaaaaattccctactactaattaatgattcgttgatttgcattattggcattttatttttaattttaaatttattcatattttcccgcataattt

SEQ ID NO: 26307 - DNA, 1805 bp, Heterodera glycines
ggggcgcaaatgtgcggggcgcaaatgtagggggcgcaaatgtaggggcgcaaatgtaggggcgccaatgtagggggcaaaatgtgtggggcgcaaatgtaagggcgcaaatgtaggggcgccaaagtagggggcgccaaaaaagtggtgggcgcaaatgtaggggcgcaaatgtagcagctccgtgaaaatgactataataaaatgatatttattattaattgtgcaattttaaacaatttagcacatcacatatactgaatggcttccattggtattaggaaaggtaattaatttattaaagaaaaggcaattaaaataattcgaaaaaattgtcaaatttattttgcttcatatgaacaagattcaatcgtgactggaaaatgcgtcgtcatacaaataattgaaagtaatgttctgtgtattaaatattgtagtataaagtaaaattcataaggacatcattctgaattccaaaccccggacccgaattcatccaaattttcgaaattagcctttttggttaaaaatatttttaaatacacggaaataaactgaaagctatacatacttgaataagtgataacttacgcagttttttgaacaaaaatgctaaacgataaattggacttgcgactttttgttcgaattcgggtccggggtttgaaattggccgaaatggataccggattcgcgaaaaatgaccacgaaaatttaaagaacatgttttaggacattaaaaatttcactgacacattttatattgacgcatttaccactgacgcattttccaggagctgtttcaattgcttttgattggaattgatgagcaacgaaaaaaaaacatcttcttaaagttgtttcataggcagttggcccgctttgtcttcaattaacaaccaaataatttccggggactaattaggcaaataaattctttttgtggttttcctaggacggctataactttctgattggcccctacaccggctaccgtcctgacaccaatccgtccgtgtccaacgcgttcgccaccgccgcgttccgctttgggcatacgctgatcagcccacagctggagcgactggataaagcactccggccaacgcccgaggggcccctcccattgcacgaggcgttctttgcacccgagcgtctgcttgccgaagggggcgttgacccgttgctccggggcctgttcggcacaccgctgaagatgccaatgagtgatcaggtgatagatagaccacagaccgcatgagcaatgcctgttgaataaaatgcgattttaggcttttgaatcgcgtttttaaatatccttattttaaagccaaattcgtatttatggcagtgatttgcttattgggaagttttcagtggaagctctttgatagtaccacttttttaagagaaagatatcaataatttaatttttcaattaaggttttttaaacatttatttatactgtatttttaataaattcttttttttttgcaaatttttatttttaaaattgtattagccgaatgcatattaattttcagctattgaataaagaactgactgagaagctgtttcaccgtgcccacaatgtgtccctggacttagctgccctgaatatccaacggggccgtgaccatggcattccagggtaattcttggcgaaagcaagcggcaattaattgggtcttgtgccaagttatcttgaatatcgtcgcttttgcaatttgactgtgccgtccgactgggatcagttggctgttgatgtgccaaattccaaagtttttccgcaattttcaatatg

SEQ ID NO: 26308 - DNA, 1031 bp, Heterodera glycines
attttccaatttttcccaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaatattctgagaatgcggttggaattcctattactgttgagcagaaaagagatagccaattttcccaatttttcccaaacaacgcgccgagaa

SEQ ID NO: 26309 - DNA, 1405 bp, Heterodera glycines
caattaaaaaaaacttgaaaacgattttttcaatttttttccaaaaatcgctttaaaaaattcaaaaaaaactttttctcgagatttataaaaagttttcaaagatttttttttgaaaaaatttctcggggggggggggcatagtgcatactaatttgtaagctgcgctgggattttattgagttgaaatctttctgacaatgactttttttctttataatttgttgaaatttgtgtaaataagttaaatacatatatttttttttcttcctttgtcaggttttcttgcacgcaatggtccgcgatgcccacgggcgaaaaatgagcaaatcgctgggcaatgtcatcgacccattagacgtgatccacggcattacgcttgagcaactgaacaagaagttggaggacggcaatttggacccgaagtaaaaaaagaaagaaaaatcgcaatagtgtctttgctcatcctccgcagggagttggaaacggcaaagcttggccaagcaagcgactacccccagggcatcccggagtgtggcacggacgcactgcgattcgcgttgatggcctacaccacgtaacaatggcactttgccataattgaaaaatgcattcgtttagccagggccgtgacattaatttggacgttctccgcgtgcagggctaccgcttcttctgcaacaaactttggcagggcacgcgcttcgttctcagtcggcttgggcccgactttattcccagcgatacgtttgaggtaaaaacggacaaagtgttggaaaaacaaatgccaacttttcccaatattctaattaatgccaattcttaaaataagtccaatttctgggttcaccaaagaagttggtctaattgtaagataactgatttttgtgttattttttggcaataaaacatgtctaaatggaataaaagacaaaaaagccgattagggcatccactcgttgattatttattttattgcaaaatgtttttgtttgttttaagccttccactttggcacttaatttggccgaccggtggcttctctcccgactgtcccattgtgtttctgaatgcgatgtcggcttccgcacttacaacttccggcagctgacttccgccattcaccacttttggatccacgaattctgcgacatttatttggagtcggtgaagagtattattgtcgttaacaatgccaacaaaaagggggcggacgcaattgcggaagagcgaagcaaaaacggcaccgatgaagtgacaacgcaaaaggtaattacacaaacaattcattagattattatctatggtacactacatttccaagagcaggtcatcccacctctaaaatttaaaaaaactttcagtaaagtctaagaattttttaaagatattaaaagaaaaaaat

SEQ ID NO: 26310 - DNA, 1355 bp, Heterodera glycines
ggtgccgatggctcctccgggggaaaattttaagaatttatatgaatttattagaccttagccaaatttttcagaaattttcctcttttagatgaaaataaggcattacccccaaatcagaacatttcgtagaaataaagaacataaagaaacctttgtattaatcagaaaaaaaaattaattaaatgaaaacgtcaaccggtgttgaactcataacaaagaattctattagtgctgaagtactacgtataaattttttgcttatatccctcgaatataccattcttagcggtgtatttcacccccgcgcccccgcgggggccaaggtcatgggcggggcggaggttgcgggggtctgagtcacgggggcgggggtgaggggggcgtggttcgaaccctactttgaacccaataaaaaattcaattaaaatattatagtaaatatgtctaaatgaataaatttagagattttatcacaaagagatgaaattattgagtcgttaaaacttctcttaaatgaatgtgaaatatatgaacgagcggggaagcctttgagggaaaaactatggggcgggccggctttgaaccggcgtctctggctttccggaccagtgttctaccagctgaactaccgaccctgccctctccagctccccactttgctcgatcatgtaggatcaattgttgcctcaattgatccattaatcttcctctcggggaagcttcttcttctctatctcaaatgctataatgtgtaagcttggttgatattttttacatcgcaatttttcgttataattacttcaagattttttcacgtatgagtagtaacacatacgccatctctgtaggttgacgttaattagaagtgacaggtagcgaaaagggggtgtcaattagtggctaattggtcaggggaggggggggggggcgctaattggtcagtggtcaagaggggagcgctactgccggtcatgtaattaattaattggagggagggggacccaaacctattggaggtttttaaatttacatgtaatttttttggtaaagaaatattttgactgatttaaaatgtgacagctttttgattgattgtaaatgtgacagatggggcataaaaattttttgattggtcatcgatgaagtgttgacgaatattcaaaaaatccgtcacaaataattaaaaataaaatgtcaattcccttttggtctatgtggggtcaattaatcgatggtatagcactaggggagggggtcatcacagtgggcaatggtttatgcgacggcgtcgcgttcctattgggaaccggccactttggcgcaggccattttggcgcaagactctatatcat

SEQ ID NO: 26311 - DNA, 2005 bp, Heterodera glycines
acatgttaattcccgggcatgatttacgtgttaatacactgtcatgattcacgtgttaattcacggtcatgtgcgtttaatttacagtcattattcagtgtcaatttacgggttaaatcacgtatcaattcacgctcataattcaagtgtcaattcagggtcatgatttacttgtaaattcacgggcatgatttacgtgttaatacacggtcatgatttacgttttacttcacgggcatgatttacgtgttaatacacagtcattattcacgtgtcaatttaggggttaattcacgtgacaattcacagtcatgatttacgtgttaattcaaaatcatgatttatgtgttaatttacggtaatgattcaaatgttaattcccgggcatgatttacgtgttaatacacggtcgggattcacgtgttaattcacggtcatgtacgtttaatttacagtcattattcacgtgtcaatttacggcttaaagcacgtgtcaattcagctcattattcacatttcaatttacgggttaaatcacgtgtcaattcagggtcatgatttacttgtaaattcacgatcatgatttacgtgttactttacgggcatgatttacgtgttaatacacattcatgattcacgtgttaattcacggtcatgatttacatgttaattcccgggcatgatttacgtgttaatacacggtcatgattcacgtgttaattcacggtcatgtgcgtttaatttacagtcattattcagtgtcaatttacgggttaaatcacgtgtcaattcacggtcatgatttacgtgttaatttacggtcatgtaagtttaacttacagtcattattcacgtgtcaatttaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacttgtaaattcacgatcatgattcacgtgttaattcacgggcatgatttacgtgttaattcaaaatcatgatttacgtgttaatttacggtcatgatttacatgttaattcccgggcatgatttacgtgttaatacacggtcatgattcacgtgttaattcacggtcatgtgcgtttaatttacagtcattattcagtgtcaatttacgggttaaatcacgtatcaattcacgctcataattcaagtgtcaattcagggtcatgatttacttgtaaattcacgggcatgatttacgtgttaatacacggtcatgatttacgttttacttcacgggcatgatttacgtgttaatacacagtcattattcacgtgtcaatttaggggttaattcacgtgacaattcacagtcatgatttacgtgttaattcaaaatcatgatttatgtgttaatttacggtaatgattcaaatgttaattcccgggcatgatttacgtgttaatacacggtcgggattcacgtgttaattcacggtcatgtacgtttaatttacagtcattattcacgtgtcaatttacggcttaaagcacgtgtcaattcagctcattattcacatgtcaatttacgggttaaatcacgtgtcaattcagggtcatgatttacttgtaaattcacgatcatgatttacgtgctactttacgggcatgatttacgtgttaatacacattcatgattcacgtgttaattaacggtcatgatttacatgttaattcccgggcatgatttacgtgttaatacacggtcatgattcacgtgttaattcacggtcatgtaagtttaacttacagtcattattcacgtgtcaatttaggggttaattcacgtgacaattcacagtcatgatttacgtgttaattcaacgggcaatgatttacgtgttaatacacggtcatgattcac

SEQ ID NO: 26312 - DNA, 1434 bp, Heterodera glycines
taaatgctgggcgatgtggaggtgcaggacactggcgcaacaattgatggcacaatatggccaagtgacagaaatgtggatttgtcgttcaccttccgaagcaatgtggagccgttcacggcataaaggtgaaatgcctgatgaacaaattgagcgaggcggcatttagtgattatgcccgctcaattctcccggcagaagtgacggattttgattttgccacaacaacacagaaactcgaaaagttattcgccaagccccaatccgtgttcaatgataggtatgaatgcctaagaaattacggcatcggcattcatcagacggtccaaatccgttagaaataaacgagacattgacttgccattacaaattagggacggaaataatgggaatgaagggcagaatccagagaatggacctgaccctgatggaaataacgaaattagggaacagccgaatgaggtgaaccaggaagatgaccagcttcaccgcagcccaacgggtgtttttaattctatccatatttttttcatcgaatttatatatgcttttttattattttttaaatatcattctttgaaatatcagtttatcctttgtttgttgttaaatttagcttttcatagagtgcaaatttattttaaaaatcttttaaagatagatttaaatttttttattttactttttggtttaaaatgacaatttacgcgcgcgtgctgaagacgcccatacgcattctttcacagttcctcgggtggatgaagtcgttgtttatgttctattttcatctgaagaataaataattttacttatttttaaaaattacccaaataaatattttagtttatttaaccagcttttatcttttatctaaaaaatcattaaaccttctcttgaatttttgtgctttttgaagagttgtgattgcgaaatgcataaataatcagatttttaaacatttatcggattttttattgccttaagattttttaatgtattttttagttttttcttattattttttgtttattttataaatttttatttttatgccataatttttttcagcattcactatggaattaatttttaatatttttgttagcatcttttttttcttttattgatgtttacaactcccatggcattgagttgttcaatggctcctttcactgctccgaaaatgagtatttgttttttactcatagcaataaatatgtttgttatttattatttttgacctttattaattaattaatgcgtaattatattttaattagtttcatattcattaattatgttaaatatctcgctccgctgtgttttattcgtttgaatttaattttcattttatggaataaaaaagataataatttctaatggtatttatcaatcgtttttttttgattaattaaaattttgtttatatcaata

SEQ ID NO: 26313 - DNA, 1881 bp, Heterodera glycines
aaataaaatttttatgtattaaaaaaaatttattaatttttgcaattggaatgcccttatttagtgttgtttttagtgggattctgtttccatggcaatgaaaatgattccctaggattaagttattccttctttatttaccaaaataaatttggtttttgttgggcggacaaagatagtaggtatcccaacacatttcaaagtggattattgtcagttttgtatagcattggaagtaaacctttgcatattttgaataaggtctttttgcttttttcataattaatttatgattaggtatatgatttttagaatgtacggaatggtcatatcaaaagaatcgccgatgaaggcgaaataaaaacttacaacggaatttattaatatttcatctattattagacattcaatcctccgttatcgacttggtcggaatcaatgtcaggtgggacattgaacaatgctcacattcattataatcattaatattttatgcccaactttcttctcttggcctcttgaccctatgaaaaatcttggaattaaattaccttattttgagatgactgtcaataccctgcccaactctttcactctgctatttcagattgtacccaaaaggggggatttatttaatgacctttcaaattggcagccgttttctgaatttttcgttcaagcgatttccgctcaagttccttcattgaaagattctttgttgagggaattttctgcatttaaattgaacacgcgaataaattagaagtaaaatcgttctaaaagaatttaaactgttaggtaatcaaggtcatttcgtttagctgattgcttctcgcttctcgaggcttgatcagaaaagcgtcagttgaaaatttaaactttattattacttttaaaacttttggcataatgtcttttttctttttgttgtttccttttttccagagccataaccgaggtaacagccgtttttgaccaagtttttcaaatttagaaaaaatgcattttgataacgatggtgatgtaattgaagatgattacggagaaaatattgatgaatatgattcgcagcagaatttgggtacacaatcaaaccctcaattaattggtgaaataatgtccactaaaatggcaaatcaaccgccaatgtttatctccggctgggaagaggatgagcaaggcattgagcaaaaagttgtgttgtttcttaattgatctcgctctctgagaatctttttaaaggatatgagtgacccgattgagcagtttctttccgcggcggaggagggcaatttgcatttgatggaacttttgttgagtgaaaggcctgatcttttgatggttattgcattttttaatatctgtatattttaaaggtctagtttgttttaaggcacgtgatcgcgataattacacagcattgcatcgggctgcttacagtgacaaatccgaaacgtgcaaatggttgctaagcaaagtttagtctatctcgccctctccatattattttgtttgtccaatttccttttcaggtgctgacccggaagcaaagacaagcgaaggttggacgccattgcattccgctgcaaattggggaaatttcgaagtaatcgccacacttctgagttggggtgttgacgtgaaccgtcggactgagataagtttatcattcctactttactttatttcaaattcgataatttttgttgattattttaaggcaaaattgtgcctctccatttggcaattaattcgatggcggatgacccgcacaagcagtacatgagcgtcaagtaccttttggagatgccaggtttttcctatcagttttcggttctttgatcaaaattcctctgcacaccaattttcatgtcaattgat

SEQ ID NO: 26314 - DNA, 1486 bp, Heterodera glycines
atgtaagtgtcgaatgacaccataataatttgcttctcaagggttcacaagacctccccgtaaccaaaatttcaaggcaataggataataagataaaattttcaaaaaaaaaaaattttccctggcgcgccaatcggcattcgccgccctcctcccttatttttcttgaaaaatttttaatttttcaatttcatactgtatttttccttttaattagccctccaaatcttttttttattgaaattgcaaattcaattttaatttgccaattcaaggacggcgatctccaccaattgctgctccatgacgagcaaatttcgccccgtgccaatttgcccccgttgctcgtccgtctcgcggactaccgacgccatgctgaccaattggactatgtgggcgtttcgtttggcctcacgttggcgctgctcaaattttggaaacggcttggctttgtgcccgtttatttgcgccaaaatacgaacgatttgacgggcgaacacagctgcgtgatggtgccgcaaagttgcagggggaggaggaggtgaacatggcgaagatgacggaaacggcaggatggacggggaacggagtgagtcagtgttcatacacagacagaaatttggttgggcacccaaattcaaggagtcggctttccccaacgggcatttatcccacaaaaaataaattttttatttttacaactttctaagaaatttttttttgaaattaaattggtaataattttaaaaatattgaaaattttcgttggaaattttacatgggaataaaattcaaattttaaaagtttctgattttttttctaaaattttttaagaaatcatttttagaaaagataatgcaatttgtattttgagaaatatcctttcgtaaaattccattttgcttccctcctccaaataaattccaatagggcatcatcatggcatgccggtgaatgctgccgcttctggcgccactttgaactcggacggcacttggctgtccgccttctttgtggagttccgtcgccgcttcgtctcgttgcttggcacttcgttcagcgcgttcagcccccacttacgttcagattgatgttcatggacagcgccagcatcatcggctgctccgtgcagcagcggcaggacgaacagcaggccgaaaatggtgagcgtcaaccgggagcaggacaaaatgtcgccgccgtaacgtcgccgggacataacgtcgccgcaaaaaagaattttcaaaattttaagaaaattgaaaagtattttagattttttgaaaatctaagtgttaataaaaactaaatttagctgaatttccggaaagaaacccaaaaagcttgaaatttttttttatttccttgaattttcttaataaaaattttttttttgaatttttttcttattaagctagctaactaaatttatgacaatttttctagatttttttctaaaataaaaaaaaaatgttgcggcgacgt

SEQ ID NO: 26315 - DNA, 1116 bp, Heterodera glycines
tatatctaatctcaacctaaatttgtacaaaaaatcgatagtggttcatatggtatcaccttatacaattttttttttcaattttagtcttaaaatcttaaaaacataaatgtcataccatctgaactattagcaaaaaatcaaaaattttgaattttccactttattaacgagctcggttttgattggtcaaaatatcattttgcaaagcatttattcaaaaagcattccctgtcaggtacatcgatcactccgtcatcacatttcttcattcaaatcagccaattttcgacagaagaggcaccaatttgtctatggattcctaaagttcagcggatttgggatgtttttgtcgatggaatttggcccatttttgcgccaaacattcgtcacattaatttttgtgatgttcaacaactgtactgtttgcgtgaccgcacgtcgcccacaattctcactgatctcaatcaattgaattccatctgtcccggtcatccattgtcctacgatatgtttggtgccaataatgatgggccaaatgcgactgctggccaaatgttgtccaaatggttgcaaacgccgagcagcgatggccaaccgaagcgattgtttccccaatattttgaccttggttgggtcgacagtttcaaagaggtgaagttcggtcacatacattcatacatggaaaatgggcgggggtaagggccggatccgaagcagatggtttccctcctccgtatcggtcctcccccaccccgctccacaaaaattaaaaaaaaatttccaaacaaatttactagagtgccacgggaccaggaatttttgccaaaaccgggaccgggacttgccgggacctgagaagccgggaccgggacctcgacatttgtcgtttattaggtaaatggagctgaattgtaagtcataaatggacgggggggggggtcagaaattgcctttaccaaataagaaatatcccccatcagaggccaaaattgaaaaaaaggctcaacattttttttaaccttttttttttgcgtggcgcgctttttccaaaaaatttgcggaaggggggcgggggggggggggtccggcggtgcgaatagacgccgccggaaa

SEQ ID NO: 26316 - DNA, 2303 bp, Heterodera glycines
  misc_feature (1621)..(1621): n is a, c, g, or t
  misc_feature (1626)..(1626): n is a, c, g, or t
  misc_feature (1636)..(1637): n is a, c, g, or t
  misc_feature (1645)..(1645): n is a, c, g, or t
  misc_feature (1647)..(1647): n is a, c, g, or t
  misc_feature (1652)..(1653): n is a, c, g, or t
  misc_feature (1680)..(1680): n is a, c, g, or t
  misc_feature (1708)..(1708): n is a, c, g, or t
  misc_feature (1716)..(1716): n is a, c, g, or t
  misc_feature (1719)..(1719): n is a, c, g, or t
  misc_feature (1757)..(1757): n is a, c, g, or t
  misc_feature (1773)..(1773): n is a, c, g, or t
  misc_feature (1775)..(1775): n is a, c, g, or t
  misc_feature (1784)..(1784): n is a, c, g, or t
  misc_feature (1793)..(1793): n is a, c, g, or t
  misc_feature (1806)..(1806): n is a, c, g, or t
  misc_feature (1816)..(1816): n is a, c, g, or t
  misc_feature (1876)..(1876): n is a, c, g, or t
  misc_feature (1886)..(1886): n is a, c, g, or t
  misc_feature (1896)..(1896): n is a, c, g, or t
  misc_feature (1927)..(1927): n is a, c, g, or t
  misc_feature (1937)..(1937): n is a, c, g, or t
  misc_feature (1944)..(1944): n is a, c, g, or t
  misc_feature (1973)..(1973): n is a, c, g, or t
  misc_feature (1994)..(1994): n is a, c, g, or t
  misc_feature (2027)..(2027): n is a, c, g, or t
  misc_feature (2037)..(2037): n is a, c, g, or t
  misc_feature (2048)..(2048): n is a, c, g, or t
  misc_feature (2053)..(2053): n is a, c, g, or t
  misc_feature (2056)..(2056): n is a, c, g, or t
  misc_feature (2067)..(2067): n is a, c, g, or t
  misc_feature (2069)..(2069): n is a, c, g, or t
  misc_feature (2074)..(2074): n is a, c, g, or t
  misc_feature (2077)..(2077): n is a, c, g, or t
  misc_feature (2101)..(2101): n is a, c, g, or t
  misc_feature (2122)..(2122): n is a, c, g, or t
  misc_feature (2142)..(2142): n is a, c, g, or t
atgtcaaaagtaaaatctgatcacgtattcgtgatccgttgcccaaatagcccctaatgacatgtttttggaagatttttgtgaaaaaaattttccactcaaaaattctggtcacccccctttggtcccgaaaccaaaaatcacttttatttttataacaattcgcaaaaaagagataaaaatgtaaaataaaattgatattatagagaaaaaaattgcggatttttgtagtactttacttttcccgaatagcttttcagaaggcagctacgaatttttttctgaaaaatcgaaaatttccagaaattctggaataacttttttcatattgatgttagaaaacctaaataaatcccataaaattctcccgattttttgctatttttaaagctttaattcacttaaattgaccggtcctccattgagttatgaattttcaaattttaacccaaaatcctgagggtcaaaaaattgccaaatatttttgaatttttaaaaaattctaaaatttcctaaactgaaaattaacatcagattcgtgctcagcacatcaaaataccccagaaaaatatttttgacccccattttcaacccaaaaaaaattttcgaaaatttctatggggcctagctcgaaaatttttgaaaatttccggccatatggcacaccattcgatagagcttaaaaaactctacaattttgccctaaggcgttttttcgataaaaccaacccctaaacgagtatgggcccgggactcaaatgtcccgctcaggccaaaaaatttttctatttccggaaaaaaatcgaaattttttcaaaaatatcaccaatcgatagagctcgaaaaactatgttttggaagtggtcttcgtttctctgggaaaaatcgttaaaaaatcctaaaattcaaaaacccgaaaaccgttttttaggcctaactcgaaaatttttgaaaattttcgaaatttttaaatttggaaaaatcgggctttcaaaactctacaataagtctgctggtaactccccgcccagatcaaaccctaatgagttattcaaccgggactgaactggacaaagttggtactgaaaaagttcacgaacctacagcctttcctattgcagatagaggcctggaattttttttgttttttagaaaacacttcaacttagccccctcacagcagacattttttgattcgagtttcagaaaaaaagttaggggccctaaaatgcacgaaaaaatgagaaatcagccgctgggactcagttggccgcgctgaatttttctctatagttttcccggatgctcctcaaaaagttgtaagacccttccactactttcagggcgctcccggccttcggccgggagaaaatggttttagcaacgaaactccttgtcaatataacatatatagtaactagcgggtgtttgcatgcgagggtggcgcttgggaaagcgctgcgcgcttcttgagcttcgctacctagattagctctggttttggagatttggaatttttaaaaaagctcagacgggcgtttcgcgcccgtttttcaaattttgttggactaagacgggcgctttgcgcccgtttttaaattttgttgggacttctcgtccncttcnattaaaaganntacaactntnattannagaaatacaaaactcattataatattnacaaatttcattaacatatacaaaattnattataanatntacaaatttcataataaatacaaaaataataaaatatntacaaattttattaananctacaaaanttataaaanacatacaaaactnattataacanctacaaattttatcaaaatctacaaaattcattataatatctacaaatttcatcaataantacaaaactnataaaacatntacaaaatttattataacacttacaaatttnattaacaatnacaaaantaattacaatacatataaattttatcaanacctacaaaaattattataanacatacaaaattaataaaatatttacaaaattnattaaaaaanatacaacactnattanaanaattacaacantnattanaanaattacaacaatcattacaatatntacaacaatcattacaacacntacaacacatattataatanctacaaatttcatcaacacttacaaaacttattaaaaatatacaacatatacataaaattctatcaattaaaaaaataattaatttaaacttataaaatttatttatcaaaaaaaaattaaataaaaaggaattttttatttattaactcaacaaaatatt

SEQ ID NO: 26317 - DNA, 1526 bp, Heterodera glycines
  misc_feature (1282)..(1282): n is a, c, g, or t
tgcgggggtcagagtcgcggaggcgggggtgagaaatttctcgcccccggggacgggggcgggggtggcattttaagcgtccaaatagcatttttgagactgaaaaataaaatgttttggggcctactacatttgatagggtattcaacggtttcggattttatgggtacactcgtgaaatgccatgggaggcgcgggtaagcaaagaacactcaccatgggataatcggcaattgcatgacaaattctaattttttaaacttagcaaaagccctaaaacgaacccaaaatctggcacggaccccctaaaaatggacaaaatgttattctgataaattcaatactcagcacaccttgcacaaattaaaacaaaaagaaaattcaattttttttttcaaatttgtgcctcaaaattttagtttgatgattttccattccatttctgtgcgttttagacccgaaaatcagaattttcacttttagtcgaaaaaagaaaaattctatttttgaaattcaaatttggcacaaatggagaaacagcaatagcaaacagaatttttatgcattcaattcagtacaaatataatggtaagtgatacaaacaatgcgtgtgttctgacatggttatatgagacaacaaatgaatgaatatccatcacaaatacatcaataaatacactcggccaatcattcattgtgtgatccgtcgtccgttctttccatccttccgccgtttgccatgcgattgtgacgacttctcgtttccgggcctgaaaattcaaaaaaatgataattaaaaataaattgagtccaataaattctgaatttttcaattttctccctcccccacaacacagcaaactgaaacagaaccaaaaattacactcgtcctccctgctgccccccgtcccacacctcaacaaaacccacctctcctcctccatcagcgcctggtccaacgcatgcgctccgcttcacgtcgcataaagattcgcacatggagtccaaggtgcagcggatggtggcagcccatcgtggtacgcgtgattcggctcagtcggccccagcaaagtgaacagcgctcggctcgtctcgatttggcggtctgtgggaaaaaaaattggggaaaattattttcggttttaaattttttttaatctaaacttacgtttcctgcccttgctctggccgccttgcgcagctgcgcttgacgcttttccgccttggccgcgcgcgcccgtgccgcgtacattgcgttggccattcgctgaaaatggggggnggggggggaattagcacaatgaaaatgcacataacaaaacaattaattacctaaataaactgacgatttaagtggcggtggaggaggacgaataattaagtggatggaatgaatgaacggaatgaacgtggaaaagcaaaatgtgtgagccttaaatagcaaattttgttagtcggaagagtcaaatttttcggataattcatatataaaagcacaaaaatttcatttggtgcattatttcatc

SEQ ID NO: 26318 - DNA, 1607 bp, Heterodera glycines
  misc_feature (566)..(566): n is a, c, g, or t
cgacagtaaaaagtaataagtttctttagtggtgtaaaatcgtaaaatgttctccaaaacaacaaaatgaagttaaatcagtattgaataaataatttttaaaatcaaaaatacttaccaggaaaaaaaataagtaaatcttggagatgaattttttgagaaaatttttcattcttcttaggggtatatttttgaaaatttaaggggccgattcttaagactgtatttttctgaaattttctaggtaaaagacgtaaaaacagtatcactagtaacaatgatttagtaatacataatggtatgttaatttaaaagaaatgtagtaatactgacaagcaatataatttgttttaataagaattatttgtttttttgttttactgtcggaaaatcctttgctgtcgaaaagtccgggagccatgaaagggttgtaaattatatggattaacaaattttttctgcacatatgcaattgttggataagggaccacaccgattattgattatattttccctttcactccctctcttattgtctctctcccgccccttgaccagccccatanatatgtctccctttccctcactcgaggcattctcccattcattccaccatttcatttatttattatttattcctgctgtcctcccatatttattgtataataaataattatttatttattgacaacatttggttttgtcatagaccaaacattttattgttgtagtaaatacacaacaatttggcgcagtcagcaaaggacctgctcaaaatcttcgggtaaaaaaggcatcaaattttgttttcaggacacaaagccgagacggcaaaataatttcaccgaaaagccggattggctgtgaattgtttttaagcctaattggcaaattcttcaaaaagcagtcaaagaaactgctagacaccaaaagccgggtcggctctccgaattcgtctaaagccgggtcggctcagcaaaaatcgacaaaagccaggttggctcgtcaatttcgtcaaaaaaactgtgatcaaaagtgttatgagcagcaaatgggtgagtgaatgacgaccgatcgattgatagggaggcgcagtgattttggaaaaaagttttttggatgcgcagccgaggaattgagaataaggactcggagtcctgttaaaataggattttatttcatgaatcatattcggatcaatctcgtaatccggtagtggtccgggtctgggtgatttaaaaaccaactctctttgatcaagtaaccaaattcaatatcacacctattttagcacgattttttcctcttcgtcatttttcgcagtttttttggaaatttacaaaaacctagcccttcaaaaaacaaaaagtttccttttcagaatcccactttttctatttggcctttgaaaatacggtgtgctccgaatatgttacggagaaattttggaacgctttgcgcagtttgacagtgccggttgtgctgtgcagggaaagtggtgcgcgagtcgggcattccggacgatttgtacatcgcagcggacgattttgacaatgccacggcattggccgaccatctgaaggcattgcaaaaggacaaggaccgat

SEQ ID NO: 26319 - DNA, 1125 bp, Heterodera glycines
  misc_feature (18)..(18): n is a, c, g, or t
  misc_feature (1049)..(1049): n is a, c, g, or t
gacttcaaatttttttcnccagttttgatgggtttaaaattagtagttggtttcagaatttttccctctacaaaaaaaaatttataatagaatttttattattaattcgaaatctttaatttattggacaaatcccaagacttaaaattgggagaagcatgggactgtagctgaggacccaaaatggggccccattggggaattaaacatgatttctgaaaagtccctgaaatgtcgattttttctttccatagcttcttgtaaagctcgagctgttctttccaatggtcttatccctgtctcgatccctgccgaactcaaaaagttatgaagtgaaatgtgaaatattgttttcgccacaattgggagaagcatggggctgtggctggggacccaaaatggggccccattggggaattaaatatgatttctgaaaaagtccctgaaatgtcgattttttctttccatagcttcttgtagagctcgagctgctctttccaatggtcttatcccggtctcgatccgtgcagaactcaaaaagttatgaagtgaaatgtgaaatatgtttgcaccacaagggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaatttttcccagttttgattgggttttcaaatagtagtttggttcagaattttcccctctacaaaaaaaatttataatagaatattttattattaattcgaaatcgttaatttatttgacaaatccaagacttaaaattgggagaagcatggggctgtggctgaggacccaaaatggggccccattggggaattaaacatgatttctgaaaaagtcactgaaatgtcgattttttctttccatatcttcttgtanagctcgagctgttctttccaatggtcttatcccggtctcgatccctgccgaaactcaaaaagtatgaagtgaaatg

SEQ ID NO: 26320 - DNA, 1198 bp, Heterodera glycines
  misc_feature (64)..(64): n is a, c, g, or t
  misc_feature (88)..(88): n is a, c, g, or t
  misc_feature (90)..(90): n is a, c, g, or t
ttaggcaaaatgtaaatgtgaccgtactgtttcggccttacatagcatctacaaatccatgggnttggaaatttattcttaaaaaagngnacaaacactataacagcacaataagtcacgtgatcacgcgcgcaaatctacaatgaccatgtctctcaaaaagctagttgttagcgcatcgacagcaacagcggcaacaatgtcgttccggcattgccatcgactttgtcggagccatgtcgccggattcacaacggtatggctcttcttgcttcaccgtctcctcctgtttagcgcgcttcgtacgctccagcacgacatggacgagctccaggctgaaggcgttaacgctcacttcccccatttttgcgtaccccccccccgcttacgggtagtaggaggcgtgcgtgccgcccccgaactcgatcatgcacggcatgtacgggtgcttcagctttagcccgtgtttggcgaagaagtattgtcgaacctggacagaaggccgcaccatgactgcttctacacactcaccgacttacggtaagctccagatagccaccgcaggcgaacgtccggttcgcgttttgcacgctgaggtcgtgacagtggagcgcaatgttacgctccgccggtttcagatgcgcggtatgaagtcggcagtgttgttgcaggtgcgacaccatacgctgtcgcgcgtggacactgtggaagaggagttgaagctccttcattgaacagtcgttgaacgcgcacaggtagttgagcagcggcattcgaacaggctacaaacagtggtgggggggggggtagaaaattagctggcctccacttacctcctcttcctctcccccgccgagcagttttgcgccttcgcttccaccgccaccgcccgctccgtccgtcacgtcgctgtgctcactggagcgctgctccacccctttaacagtgtcggaggagtcatccacaacggttgccgtcgcggacgagggggagtctgtggcgacgggggtgtcttcaatgtcctcatcctcctcctcctcctccccatcatcggattcgatgaacagcagtgcgccgtggccgccgctgccctcttcagcaccgtccttctcggaggagggggcttctttttccagtctaaactcggcggtggtaggtgtggtgacagtagctgtgtcactgtggaccaactttgctg

SEQ ID NO: 26321 - DNA, 1926 bp, Heterodera glycines
  misc_feature (1903)..(1903): n is a, c, g, or t
tcaaatcgcgcacagtgtccgcacgttttacacgaactgggtactttttctggttatattcaatgaaaatgtcaaactcaactaatgtcttgtaatgatattcataacaaacgtaaataactgcgccttctttaatttcatattgttccattgtataccattgttcaaaaaacatgtcataacttccaggagattgacgactctttaattttatatcatctatgttaatgtccaactcccttttcagcatttgcatggccttcttctccaaatcttctacgtagtcgctttttctgacccaaattgggtaatttttctcgttaaaatgcacaaaaatttcatattcatcaaatgttatgataatgacttggtctttttcaatgccataatctttcaaagttttactgtcttcaagcgttggaccaaagcgaccgccgagtctcagcatttgttgttggttgggcaaaataccaatctcttggatatttccgattttcatcttcaaatcgcgcacagtgtccgcacgttttacacgaactgggtactttttctggttatattcaatgaaaatgtcaaactcaactaatgtcttgtaatgatattcataacaaacgtaaataactgcgccttctttaatttcatattgttccattgtataccattgttcaaaaaacatgtcataacttccaggagattgacgactctttaattttatatcatctatgttaatgtccaactcccttttcagcatttgcatggccttcttctccaaatcttctacgtagtcgctttttctgacccaaattgggtaatttttctcgttaaaatgcacaaaaatttcatattcatcaaatgttatgctaatgacttggtctttttcaatgccataaactttcaaagttttactgtcttcaagcgttgaaccaaagcgaccgccgagtctcagcatttgtcttttgggctcaattttatttctcagctcttgtctgttgggatcaattttaatctcttctgcgaacttcttcttcaaatcggccacagtatcctctcccttcaccattacggtgggcccacatgaccagacaaaatcactgatctcaatcactgagctaatttcaaattcatcatcagcaacggatgagcgcatcatcagccgcataagcattgttagtccagcagaaatgcctaagccaaaatgattcattgggggtaattagaaagaatgggaatatggagggaagggtattacgatgaatgaatgaatgaatctgaggaccgttgcttcaccactgtcaagggacagccttttatggggcagagttttagtcacttattgaattacaaattaagtgatcactttcatttggcaaaatattgtctaatattgattagaaattattaaatgatcactctgatttggcaaaatattgtcaattattgaattagaaattaagtgatcactttcatttggcattattatagtgaattattgaattagaacttacagaaaatttcttttaaaaaatgtttttaattatttttcaaaaacaatttaacaaaatttgtgactttatcatcatttaagaattttttatgaatttttaaaataaaaagccgaaaatttacactaaaaatcgaccatgctcctctacaaggcgcgaattcccggcacggtccgctcaactcttcttttaactatttgcaacatttctgaacttgactctcagggttctgacaaaaatatttggcattttatgaaacattttcaataaatttctaaaaataaaaatggcatttattgagaaattcaaaataaataatattccatgccgctagcattgatcaaagtataaaagcttaattagtgccaaagtttggtttcaattgacaattctcttcgccnttgtgctgtgactgctgcttctg

SEQ ID NO: 26322 - DNA, 1137 bp, Heterodera glycines
aaatgcaatttatggggtcaaatcggaaattgagagaaaaccgggcaaaaaggggagggggggggggaatgaccctttctgttgttgctttgtaatgttaaatatttttaattaggcaattaattgtctcaattcgctgtttaactttattttatttatttttgggcttaccacgaagaaacagcggggagagcgttgttggtcaacagaatgagaagctgaagcaagaccaatttgctgctgcttctggtgcggtttgtggtggcgattggtcgctgactttgagagtaccgcacggaaacggcgacgaacggcgaaaactctggcatttcgaagaagcaaaaagggactgaaagtggccgaattaattcgaaacagaaagcgaaatattaaaaattgaggacgtaataattcataaatgggagaaaaaaagaggggaataaattaatttttgaaaagagagcaaaggaagaattagaaattgagaaaatggtgattaaaggagttttgaaacttagccatccctgaaatgttaagcgattattggaaaaggacaaatgatcactgatcagtcacttggaaaaggacaaattcggcagaacgaagcaaatgggacgaagagattggagaaggaaaaggaagagaaagagaaggaataaaaggaggaaatggaagagaaagggcgagggaagaaaggaattgaaaggggaggacgtcgccggaggggcaaaggcaaagtgcccataaaaaggggctgtgggtgggaatttgggagggatcggacgattcttccgtcgatgcccaacacaactcggaaaggtaataaagtgggaaaagttgttggacgcactgctgttgatgggggaacaaagcagaagaggggggaataaattggaactgaagaaaaacatgacgaaaaacaacggaaaccaaaaatatgggaaaataaaataaaatttaaaatggaaaagtaataaagggggcctactttgatcataaatttgagggcacaacgaatgccaaagtgatggctgaaagaatgaattaattggatgaaatgacgggccgcggatggtcagtttcgcctcacctccgtccccccccccaccgcctcccccgtcgcccatcgtattcaaa

SEQ ID NO: 26323 - DNA, 1125 bp, Heterodera glycines
  misc_feature (12)..(12): n is a, c, g, or t
gcataagacgcngatactatgtttctggatttttttctcagcgcatttgatcgtgataattttggaaaaatggctatctctttttctggtctacagtcaagggaatttcagcgcattttgatcaaattaatggctttagtcaaggggatccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaattttggaaaaatggctatctctttttctggtctacagtcaagggaattccaaccgcactctcagcataatgacgccgatactaattgttctggaatttttttctcagcgcatttgatcgtgaaaatttttggaaaatggctatctctttttct

SEQ ID NO: 26324 - DNA, 1613 bp, Heterodera glycines
  misc_feature (56)..(57): n is a, c, g, or t
  misc_feature (95)..(95): n is a, c, g, or t
gacggatacgcatgattccactgttccaagcaccccacgaaaagtgacaaaatacnncaaaatataaggaaacattttaaaattttttattcttnagccttattcataatataagcctaagaggaccttattaacatgtaaataaaattaggtgcgtttaagagcactttctgaaaaaatattcatgaattaattttgcaaaaattggaaaagtacgcaaaattgcaatgtttaaaatttttaaagaaacattatgggacagttaaataattatatgaataagcattcttctcagctgttaccctgcaaaatctggtgcatttctgatcactactcgaaaaatgagtaaattaattttcactaaaaagttaagcctaaactttttggcctgtttaaaaaggaattaaaaatttttaaaaattttaatcatcttcctttttgatagaaaaagcatcagagagccttattaacatgtaaataaaatttatcagattcagatcgccatgaaggagtaatctgatcatgttggtccaaaagatttatttgtaaagcatcaaaagttagcttacaaattagaggaaatttttctgctttttttctctatataaatagatttttggttaaatttaagaaaaatttgaaaaattttcttaataaacttagttaaaaaataaaatttttccttggagatttctacaaaaaggcctaattttcatcaaaaaatttgctcaaaatcgtaaacttagtcattttttggaaaaggtacgcagcaaaaaaagcggattgtgttttggtttctttaaaatatcttttaggaatttttccagcgattaaattccgtttttctaaataaatttaaattaaaaaaatcattagaaaaaaattttttaatcaaggatcacggagtttttggggtgccgtgatctcggattttttttaaagccccgtgatcacggctcacggatttccgtgattggaaattcaatcacggccagccctggttgggatttgggatataccataaaataggacaattaaaggaaaataaaattttatcttcaattcacagagttgaaaaaagagatgggcacaaataaaacaggaacagtgaaaaacaaaaaaatttaatacaaatcgtcatcgaactagaaggtcaccggctagcgctccgcttttttgacgaatttggggtgcacaatgagttgggccattgtttcgtcgtctttggctgtgcatttgtactccccgtggtcttcaatgagtacattgatgatcagcaggcgacgacggcatccagcccgttcctgtaaaacaagaagcatcaataaaatacacaatagaaaaacaaaatgaaatttggcataaaaacaaattttagataatgtaaaaaaatataaaattaaaaaatatattgttaaaaaaatggttttgtttctgacttttctaatatattttttaaatttctgataggcatttgaattgaagaatttgagctagttttggtttgaattttggaaatatccatacttagggatttttgggcttaaaggaatccccaaataggtaatttaaactcctactcaatttttgaaaatgatctttcataacacaaa

SEQ ID NO: 26325 - DNA, 1709 bp, Heterodera glycines
  misc_feature (755)..(755): n is a, c, g, or t
  misc_feature (1671)..(1671): n is a, c, g, or t
aaaatctcaaaaaataatcaaaattagctttaataatttttgagatttgttcggttttctaaattgtaaaacaaactcaataacaaaatatccctctgagaaaaaaattcgtaaattttcaaattattgttattttgccttctctattgtaaacgttaattatgctatttgccccaggctctgatctgtcactgcgctgctcaattgcccaccaccatggcacaagtgagccgttccatatgcagtggaggacaaaccgaggcatcattctgaaccaaatccaacattccaacgaaatccccggatattcgggcagatacaggcgagtttcgagattatggaagcaatttttggcttttttataattaaacagtttcaaaaataaaagaataattgaatgagtgaaaattggtcaatttacattaatttataaagaaaatttgaatatttattttttaatttacggtaaacagacatttttttcacttatttcttctttctttttgatttggtgccaccaacattttaatggacttactggggaaaatacaaaattttaattgtactaaaaattcccccagtgccaatttggtcattctttgttttgtgacttttttttgtctcagaataatccaactaaaacattgtaaatgttttttaaatattttatggaccgaaggacttcaactatgactccaaaaggtacaaattttgcgggcaaatcctcgggagtccccccccccggtttctcgtanaaagccaattcaagtaataaaatataccaaaaattttaaattaaaaatgcttacctaattttgggttgtcttatctttttgtttcttttgcagttactccaatgataaccctggcgaattccatttgcacattcgaaatgtgtcgttggatgacgacggacaattccaatgccaacttctgaagccgggtggcaaattttttcgtgcaaatgcttttgtcaccgttttaggtccattcattttttttcttgcttaaaatttcaaaaaattcgtttccacagtgcctccgtccggcgttcgcttccaacattaccagtccggctcgaccatcgcggtcaacgaaggcattccgttgaacatcacttgcgtgaccgaccgatcgaagccggaggcaaaattagaaaaaatcaaatatttaataattttgaaattacaagttctgctgttaaattattattagtcttttatttacccattttataattaatatttgtttaaaatttttttgtgtaaaggtgattatgaatttgttcgtgaacggcaaaaagacgacggagcatgtgtatggacggcaggaatgggaaaacggcaccgtgtacacttatgccagcctggcattcagaccggggtaaaaaagaaaaaatggaattattaaaaataaaaataaggcaggaataaaaaagaaaattggaattaaaaattaaacaagataagggtaaaaaagaataaattaaaaatatcagggtaaaagcgtatgaaaattaattttcagaaaaattcaccataaaaaagtgatttcctgcgaagcgcagcacccggaaacgaacacaaacttacgcgactcgatcactttggatgttttctgtgagtttggcctaattgttatgatgatcggataattggtgattgcaaatanatgaactacaaatgtattttgagggttgcggtataatt

SEQ ID NO: 26326 - DNA, 1544 bp, Heterodera glycines
  misc_feature (65)..(65): n is a, c, g, or t
gatcagtgcgtctgctgccggcacggcgcttaaggcgggccaaaacgtgacacttttgtgcacgnccgaggggggaatccgccgccgcagctgacatggtccaaccaaaacggacgcatccacgaggaggacgactacagctacgacacgggcactcaggtgggagaaaaggacaaactgacgagtaaatgcaaaaaagcattctattaattagtgatgcatgtccaaaacaattaaaaaattaaaagggaaattatagtaaataaaactgaaaatttcaaaaacccaaaaaaatgcaaacaaaaaatccggtgctagttgcaaagtcgtgtcttttgaattttattaaaaatcaaagggggaaggaaccctctgaatttttttgtaaaataatttgtgtaatgaaaacttgcccctggagtttttggagttcctgatcacctttctggcatcgaacacctaattactttgacttcctaacttcaatttgaaccaaaaaaaactcataaaatgagaggtctgaattttcgacttttgttcaattcgagttagggattagaaatttgtcaaaatggaagtcagattcgcggtctgtagggcccggattttagttgctaaaaaccccgaaataagtacctaagtagtcgctaaaaaactgccaaaataattgctaaaaaacaaaaaaatgccaaaatacttgctaaaatagttgccaaaaatggaacataattgctcaaaaatgtgaaaatttcccaaaatcatgatggtaaatttttggggaaaattgttggtccggcagtgccgataggcgcctccagggaaaatttgaaaattgagtgaacatttgtgccaattttcagttaaacatgccgaaaatttcaaaattgtttatttattttttcataacttttttgttgaaaagcataaatagttgaaaaaaatattttttttaaatttcacaaaccaacatagttgttaaaaagtttcatatacgaaaatagttgaaaataattgctaaaaattcgctcaaaatcgaaaattggttgaagaaaatctgttttttttgtgcttatcctcagcaactacatccttttgaaatttcatcaacaaatttcacaaatattcaattaatttacgtttcgaaacatttcatatatttgagcataagcaaattcattaaaaaaaaattcaaaaggaaattttttataattataaattataaattttaaataaaaaatataaaataatgattaaatttaaatttaattgattgctcagaattatatggaaaatttgtagtttgtaaagacttgttgatttccttttttaggcaaatgcctaaaattttgcgcacttgatacgcaaagataaacacgaaaaacgcgttttccgcttggtttggggtgtctacgatgacttttataatgcctatttttgcctatttcgtggtttttgtgcctaaagtgcctattttaggctttttgaaaaaatccataagaaaaatgcaataaaaacgaaaaacacacccctaagaaatgacccta

SEQ ID NO: 26327 - DNA, 1001 bp, Heterodera glycines
tttttaccactatttttctctcactcatcgtctgctcgtctctcctttattataagctattttccaaaagccaacgcccttttctccctcttttctattagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaatttactatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaataagtgcagtggggaagaatgacgcccaaaatgaaggaaatattcgatgctgtgcgaactctttgtgacccctctctgactctgccaatgcagcagtttacaatttttaccactatttttctctcactcatcgtctgctcgtctctcctttattataggctatttttccaaagccaacaacgcccttttctccctcttttctattagtcatttctcattggtgttgacgatccaacattcagtgtacaaatttgttaaacctctcaacattttaaatcaaaatcctaataaaaatttcgttgaatttcttcgcctcttatttgtgcaaaattttcgaaaaagtaatttactatttaaaattaaaaaattcagaagcaaattcaagaattttttttatttttaaatgcattttttaccacatgaattatgattaaatttttgcgtttcgaaagcattttggaattaagaaaaataaaaattgataatcattt

SEQ ID NO: 26328 - DNA, 789 bp, Heterodera glycines
ccccccccgaaacccaaaaaagtaaaaattttcagtaaattttttgaaattttaagcaattttcttcacaaaattgtattaaaatacacccctaaaaatcgcttggtagaaacgtttcaatttttaatttaaaatattttgtctttttaaaataataaaaattaaattcaaaatgcttcggaaagtaaaggaaaaagtgaagaaatctatgggcaaaagaaattttttgattttaattttagttcatcttttatgtcatacactggtggaaaaagtctttactcaagccgatcaaatttgaaaaaattaaaatttcgactagaaaatttaattgattattttttgtttatgtgtttttatttacccctatttatgtgctttttatgcaccacataattattttgatccactcattcattctgaacatgagtcgtttgatcactctttactcaaaaaaaagggcggaaaaaagtctttactcagaacatgaaaaaccaccttaaaattcatttaaaaacctgtaattcatgctagcttatcttttgatactgatcaaaaaagtctcttacatcaacttgatcagatcactctttcatggtgaccaggaaagtcaaaaatggcttgaaattggggaaattttagaaaaaaattcctagggggttaggaaaatttttctggaaattttgaataggctcattggatagagcacaaaattcactacagattgtccttttggatggttaaggctacgatttatactcgctgagataggggttggggtccaaaatt

SEQ ID NO: 26329 - DNA, 1814 bp, Heterodera glycines
  misc_feature (1740)..(1740): n is a, c, g, or t
attgtttttttgcggcactgtcttatgctgtttgatacaaaccatttttccctcctttttgcttgcctcagcattcagccgggcgccccgctcaccgaatttcaccggctaatcagcagcaaatttttctccccccttatctgccaatttcagctccttccgttgtgcgcttttcatttggtatgtattctccatatttggaggtatttattctttagggggatggaaggggtacggtaggggagtgaacgaattactgtaaaagatatttgactaatttaattaattattaaacccttaaggtgattttccgccaccgccggcttactgcacccgcctccgccgtacgctgaaattgcccgtgggtggaccgacggatgggggacatttcacagggccgacctcgggggctggacaaactaggtaatatattaatttacttattaacttattaatacctagtcaaccccaaaacccgttctaaaattttttaatttttctattttgactaattatgaaaattaattattatttttttaaattgggattttcaaccaaattgtataattattatacctcaaaaaattgacagggaattgattttttcaggtatttgctaatatgcataagtgaaagaaaaatttttttgaaaatttgtcgaaaaatgtttttaggatacagggggaggggagagagaaaaatatttttatgttgagttaataaaaaagtttaaaaatgacttataatatttttgataaggaatattaagagccttataaataatatatttaaacacatattcataattatattttattgaaagcatgtatgaaggatgaggcgaagagggtaaggaaggaggagacggatgagggaaagtgagatggactatggaggaggaggagagagagatgaggcgaggagggtaaggaaggaggggacgaatgatggaaaccgtgccaaaatgcagcaaaagcgccagtcaaagcaaatttgcaaacttggccaaagcaacgcatccatggcagagagttcacattgattttgctggtcctttcttcggaaaagattacttgatcattatagacgcctattcaaaatactcagaagtttttgagatggcaaccaaatcgacggcagccacaaacaacaaacttcggtatttgtttagtcgtcacggattacctgaaattttggtatccgacaatggaactcaatttaccagcaatgaattttcaaaattcatttccaacaatggcatttctcacctcttctctgcgccatataacccaatgtcaaatggccaagcggaaagatttgtagacacgtttaagaggtcattccgaagcatctgtgctctctcacccgtccactcactgtctctaattattctcttacgcatctgtactctctcacccgcccacaaactgctctctcccatcctgcactctctcatctcatctctgactgctctcttgcacatctatactctctcacccgcccacagactgctctctcccagcctgcactctctcatctcatctctgactgctctcttccatcctgcactctttcatttcatctctaactgttctcttctgtccctgaactctcatcctcccactgactatctctaactgttctctccctctctcacgtacccgtactcccaaataaaatgaccttttctattattagatttccggaacaatggttgtttgtcggcctaatggttcagantgttatcggattatgcttttttgtaaattttcggggctcattcttcatttgtacaattaacaacaataataaaa

SEQ ID NO: 26330 - DNA, 1330 bp, Heterodera glycines
gctagctggctcaaaaaaaattttcgaaaatctgagtctttcgtttttatttattttttgcaaaattaattctagaatattttttcagaaagggttctgaaacgcaccaaatgttatttacatgttagtttaggcactctgatgctttttctatcaaaaagggagatgaataaaatttataaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcacgctgatgctttagtatcaaaaaggaagatggagacaaggggggttaaaaaatttttccttatattttggttatatcgtt

SEQ ID NO: 26331 - DNA, 1378 bp, Heterodera glycines
  misc_feature (24)..(24): n is a, c, g, or t
gtcctgattggagtgcaaatcgtnggcacctcagaaaagctcaatactttcccatttctcgtcccagccgttgagcttcactttgtatcttcccgattgtagcttcactttcttcccaccgaccacttggattgccaggtggtcactcccgacccttctcggtgcccagctgcttgatcagagccgcatccccataatcgccatggctggctgggtcgagaagaagattggtattgcattctgtcatgccatcctccgatgccaccaccaccgggcacaccattaaataggccgggagttgctggcccacggtggtgaatgctctctgctctccgtcgagcaaaggtgggtcctcccctttagcccccatcccgtccttgctggactcggtgggagggggagtgcgcacgtgcttcgcttcaatttcccgaatgatcatcgtccgattttgttgtgcatcttccgttctcgagtggctagggggttcgttccttctctcccccttccagcatatcagccagtggtgatccatttgttcgcacgtccggcaggctgtttttcgtgtacactgctgcgcggtgtgatcggatcccaggcatttgagacaacggcgttgctcgatcagtctcctccttttggcttgtgctgacccatatttgcaacaccggcttggttggtgtcccgtttgtccacacaacgagcacccttgtcggggttgtcctccctgtccctcctgtgcttgggaatgcgctcccatcggtcgggagtaactcccgagcggcacacgattcggattcgctggtcgagtgggtggcatcgcgacttcggtcctggtgtgtgcttcgttcgacgttcgtttctccgggggctgatctctgatcataaatgcccgctggaatccttgtcctgttcgggcgttccgtccgcctcgttcgggctccgatcgctgctcatgtcgtcgttcgggtcctttcattgctgccaacgcggattcggcggccctcatgcacttgacttgcactcccaccgctttccgaaactctcgcactgtccattttgctcccatcgtactctcccggatcctcaattctgtgaggatgtggaccgggagtttggcctccaacaacgggccgaacgactcgtcgtccacgttcgctcccagttgttcgagctggcacactcctctctcgaattcatcgatcactgccgtcaagctcgacacgttgtcctttgctggctgcaagtgtagaagctgagctcggatcgctctttgcaagtcgttcgtgtccccaaatcgttccttcagcagctgcaccacaaccggataattccatccgacggtgggtacaaaatgtcggcggtgtaagcgcactgcttc

SEQ ID NO: 26332 - DNA, 1873 bp, Heterodera glycines
ataggccagaaaatactgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaataggtataaggggcaaacttttgatgcggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgttataaagcaagagccgacacggaaattatgcataaagcattgcataatttattcgaatgggcaaataaatggcaaataaaagtttcaattcaaaaaacttttgtattatatttgggttcaaaaaacccaaaagaaacatataaatttgatggaaatacaataaatgctgtggatacaactagggatttaggagtaatcattgataacaaattacaattttccgatcatattaaccaaataacaaggaatgcgtatttacgtatgcgttccttgtttcgaataattaaatccaaatcgtctaagatttggattacgttatataaaacttatattaggcctttattggaatacgctccggaggtttggaatccgtctcttcaaaaaaatattaaaaaaatcgaaaagtgtcaaaaatatttcaccaaaagggtattttttaaatgcagccttccgccaattccataccaaaatcgattagaatacctgcaactgccaacacttgagaataggcgaaagctatttgatctgttcatggcacataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaaaacaaattctttatttgaacatttttggactaaaatacctgccccgaaaccgaatattctccaatttcccaaaaaaatggtatccaccagttaattgactctcaaatgagttttgtcaagactacagtggaagcattgaaacaactccagacctcttttacctccgaccaaatgccaatttttaataccctaattaccactttgtccactcaaattgacctgcttaatggatcgatttcccaactccgctccactgctctctccactgaaggcatgccaatttcagcggaggaattggaaagacagagaagtgtcgtcattattggcatgccagagcacaacgacagttcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctgcatggccaaaaaacaaaacaccattcgggctgctgattcgtctctgcaccatgtccgtctccgtgaatcgctgaacaaaggacaattggaggaacgcccgcgcctgcatttggcaaggggttgaaaaac

SEQ ID NO: 26333 - DNA, 1260 bp, Heterodera glycines
aaattttgaggtcaaaagtgattagaagaggtgcaacagtgattagaagagtgatcagaagaggtccacctgtgattaaaagaggtacaacagtgattagaagaggtgcaacttgattaagaaaagtaaaacagtgattagaagaggtacaactgtgattggatgaggtacaacagtgattagaagaggtacaacaatgattagaagaggtacaatagtgataaaaaagaggtacaacagtgattaataaattcattaaattaaaatgaaaatattttttaacaaatttaatttaaaaaatacatgaaattctatcaattaaaaaaataattcatttaaacttataaaatttattcattaaaaaaaattaatttaaatataattttttatttattaactcaaaaaatattttaaatgaataaaaattgaaaaacacgaaaaaaatggtagaaaaataatgtacaccgcccggcttcgaacttcgcccccccccccctcaaaatgatgcctcagaatccccaatcacacagggattctgaggccttaacgatgtcaaaagtaaaatctgatcacgtattcgtgatcagcgtcataaaatagccctaatgacatgtttttgaaagatttttggttaaaaaaatttttcactcaaaaatcctggtcacccccctttggacccgaagcacaaaatcacttttatttttatatctttttttaaagaagtgataaaaataccaaataaattttataaaatagagcaaaaaattgcggatttttatattattttacttttccaaaatatcttttcagaaccgagttatgaattttttactgaaaattcgaatttttccagaacttctggaataactttttttagtttcatgatagaaaatctaaataaaacccataaaattctcctgattttttgctatttttaaagctttgttgtatgaaaattgacttaccctgaggttagttatgaattttcaaaatttaccccaaaatcccgagggtcaaaaaaaatgaaaaaaatttcgaatttttaaaaaattctaaaaattatgaaacgaaaaacaaaggtcatattcgtaatcagcatttcaaaataccacagaaaaaaatttttcacccccattttcaacccaaaaaaaattttcaaaaatttctagggggcctagctcgaaaatttttgaaaattttcgaacatgtagtacaccattcgatagcattttaaaagctctacaattttctctaaggcaa

SEQ ID NO: 26334 - DNA, 1039 bp, Heterodera glycines
cctaccgggaattggacaccaacttttgtcttctattgtagcggttgaataaagcactaatagtgtgtttgaaaccgcacgaaaaatagttattgcaaaaaatggctatctctgaaagtcactattaaatccctaccgggaattggacaccaacttttgtcttctgttgtagcgctgaataaagcactaatagtgtgtttgaaaacgcacgaaaaatagttattgacaaaaaatggctatctctgaaagtcacgattaaatccctaccgggaattggtcaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctgttgtagcgtgaataaagcactaatagtgtgtttgaaaacgcacgaaaaatagttattgaaaaaatggctatctctgaaagtagtgtgtttgaaaacgcacgaaaaatagttattgacaaaaaatggctatctctgaaagtcacgattaaatccctaccgggaattggacacaacttttgtcttctgttgtagcgctgaataaaacactaatagtgtgtttgaaaacgcacgaaaaatagttcttgacaaaaaatggctatctctgaaagtcacgattaaatccctaccgtgaattggtcaccaacttttgtcttctgttgtagcgctgaataaagcactaatagtgtgtttgaaaacgcacgaaaaatagttattgacaaaaaatggctatctctgaaagtcactattaaatccctaccgggaattggacaccaacttttgtcttctgttgtagcgtgaataaagcactaatagtgtgtttgaaaacgcacgaaaaatagttattgacaaaaaatggctatctctgaaagtcacgattaaatccctaccgggaattggacaccaacttttgtcttctattgtagcggtgaataaagcactaatagtgtgtt

SEQ ID NO: 26335 - DNA, 1711 bp, Heterodera glycines
cccacataaaattgtttgttaccactattttttggtcttactatgattttagtagaaaaacaatttctatattttggcattaatataacttctagcggaatttgaatccagttatctgcgcccatgtttcatctacaaggtccatatcttgtacatccggtccaatttgatgcggaaagaatcactggtttatgctatcataactctcatcatcatatacattaaaatcaacatcaattgcttttatctcattcctttcaatttttataatattataaatagtcccactttcctcttttgggttttgtgagtataactcagaattcgaagaactaaaatattcaaacttttccacttttggtactgaagttatactgcctaagcatggatactgatttagtttttcatttggataaaccaatgcaaaatatggccatttgtcctccttatccagccgtacagccaaagcacacttacccattctctgaaaaataatcatccttagctgatcatctctatttttatcctttttttgttttatttgatattcatcgctttctggtttaatcattacccaggcaagagcatcagtacatctcaaacctattccagaactagaaggacagtcaatattattaatcagttctgttggattcttttcatcacttttttcagtttctctcagttcatgtattttttcattatcagattttattgccaaagctgccattgtttttctaatcatttctctacaatgatttatttctgcaattctttttatttccttttcattagcactttggcttgtcgaagcaatattttgatttatatttttatttgtttcgctttttccttgcccgtttccttccataagccttttatcacagaccgcaaggtctgtgtactccatgcttttgaactgccgaagcaaaccaaatttttgattctgatcccctttttatttcaattccccctttttattttacttgcttttgtttggtgtttatttttgtctaatttgattaatagaagaaaagaaattcactttgtccgcccacagaagtcaaatgtccgttcgatcagtcagctttgtccgttcactttgaatccgccgaagcgtttgatcaccactgatgtcgttcttcacctgtaattctccaaaatgatttgttgaaatccaaaacaaaacaatgttcctaaacgccttcaattgtaccaagagtgtataatttaaccggcatttacacatcagatcaattaaatactaattattttccaaaattttaggggccataaaagtgcattagtgtttaacaattaattaaaagcataacgcagtttatttggttaatcaaatgaaaagcatattgtttgttaagcaaagctgaatgtttggccctcgtaatacaatttccactcatactcacagttttcacacaatgcgaaatgtgtcgcacttttgggccgccgaagcgttgaacacagttgatggtccgcaccacactcaaatctcaatttcactcaggtgtcgccgattctctgaaattgggaaattgccaaattattaataattgccctattttatttatgcatgcgtaagtaccaacatttcccatttgtcttgcacaataactgataattggaattttcccccttttttagaactaaaactcattcgttatgaatttttgatcattaattgatttttttt

SEQ ID NO: 26336 - DNA, 1288 bp, Heterodera glycines
gagctcggattttacaaaataattaattttatctatgattttttataagtactaaattttttccaaaattttaagaaattagtcgggcgtaaaaaaacacacaggatgttgtatagctcaaagagctttcgaatgagctattgaatgtatggagaagtcatgtttttagttatttacgattttttgaaatttaattacaagcccttaagggtcatatgagacgggggtctggggttcgagcccgcttggctgtgtttattaaatttttaaacttatttttcgaagaaaccacaaaacttattgccaaaaatggtaaatttctcaaaaattcatccctcaaattttttttcttaacaaaattatgtcactattcgtcattatattggacttttcgccattattttggcatttttttagcatttttactatttgtttttttttggaaaaaatggtttgataaataaaaattccatttatccccagggggggggggtaaatgggacggggtgattatttttcaaacccctaagaaagggggggggaataattggggacggcgggattaatggagacagggggataaaaagagaaaatacggtatacggtatttttcaaaagctttaaaaaataaaataagagaaaaataattcctctctcaacataaaattaaaaatgtaagaaaatatttctcaaaataaaaaaatgtttagtgaaaaaaaacaataattgaaaagatcttctcggtgataatgacatggttttatttgaataaataaatgttaaatagaaataaaaacactttcgttgttggtctcatcaattttacataaaaattcattaataagaaattattttttcattagagcatgaaataactagccttttttataaaatttgtctatctggataatgaaaataattttaaaaattgaaaaaattaagaataaaaaattaaattatgaaattccaaactctgtaatgaataagaataaatattcttacaataatatttattttaaattaatgaatatatatatagaaattatatttcgtgcacaaataaaaataatatattagaattcacggaataattatatagatttaaaatttaatcaaaattttcatccttattttttgtttgtgagaatgttgaaaaaatatacattcaattaaacaggcttaatttattgttaaacaaatttttaattttttatgaaattcgaaatggttgacaagagacttgttcgacaatgagctgcagtacaatttatagaacaacaacgccgct

SEQ ID NO: 26337 - DNA, 1480 bp, Heterodera glycines
tttttcatattcgcccaaaatcccgagggccaaaaaattgccaaaaaataaagaatttttaaaaaattccaaaaattatgaaacttaaaatagacatcatattcgtactcagcaccttattttaccccagaaaaatatttttcacccccattttcgtccgaaaaaaaatttccgaaaatttctagggggcctagctcgaaaatttttgaaaattttacatcatgtagtacaccgttcgatagagcttaaaaagctctacaattttgctctaaggcattttttggctaaaaccgacccctgacgagttatgggcccgggactcaaatgtcccgcttaggccaaaaattttttctatttccggaaaaaaatcgaaattttttcaaaaaaaataccattcgatagagctcgaaaaactatgttttggaagtggtcttcgttttcccgggaaaattcgttaaaaaatcataaaattcaaaaacccgaaaaccgttttttaggcctaacttgaaaaattttgaaaattttcgaaattttaaaacttggttggatagcctttcaaatactacacatttttgctcagaaacaatttttcggtcaaagcaacccctggcgagttattcgcctggtactgaagtgtacattttgagcacacttcagttagccaagcgtgcaggccagggggtggctctaataaaaaaataaaaaataccagcatgtagaggacagtggggggagtgccctcacagcgggcactttttgattcgggttttagaaaaaaagttaggggccctaaactgcaagaaaaagtgaaaaatcggtccccgggactcagtcgtccgcgctgaatttttctctatagttttcccggatgctcctcaaaaagttgtaagacccttccactactttcagggcgctcccggccttcggccgggagaaaatggttttagcaacgaaactccttgtcaatataacgtatatattaactagcgggtgcgtgaaccgtcgactatttagctgggaaaaagcgcttcgcgctttcggagcttcgctacctaggctgtgaagcgattcaaattgatcgaatggttggagaaattttttgaatttaaaaaaaattattaggggtttttagtccacatcgaggctcaagacgggcgcttcgcgcccttcgcgtcctcgaacgggcgcttcgcgcccgtttctaatttttgttgtgcttttcggccgcttcgcggccgttttttaaattgtgttgagtcggacgggcgcttcgcgcccgatatttatgggttgtggagtaattgttcgatccgaagcaatttgggattgcaaaagtgattagaagaggtacacatttgatgaagaggtacaaatgtgatttaaagaggtacaaaagtgatttaaagaggtacaaaaatgataaaagaggtacaaaagtgattagaagaggtacaaaagtgattataagaggtacaacagt

SEQ ID NO: 26338 - DNA, 986 bp, Heterodera glycines
ccatcatttcggcaagtcctccgatcttcgtcccagtcctgtgcccgtttgccttaaaaatggaggggaaattgtgtacataattcaacaaaagaatgaagttgtttgtgcccaccgtcggtgcccatttggtcagtgcttgcgccattggtcagcaaatgtcgtgccacttcagtcttcccgttcttcaccgcgtgcatcagcgcgttgtatccgtcggcgtccgtgtgttggacttcagcgccatgatcgatgagataagtcactgaaaatgaagagaaaatcaggtagttaggtaggtatataaatcgatcttctaatttttttcaacccaccaacgttcaggcgtccctcactgctcgcgcccatcaaaggtgtcgtgccatcgattgcttgctggttgacttcagctgcccattcctcgaccagcagacggcacatctccaaactaccagtctcggcagctaggatcagtgcgaaaacgcttcctgaaacgggaacaacaaatattggacaaaaaaattcagaaattttacaaaaatccaccggtgttgtccaagcgtccaacggttgcaccgcgggtgagcaagtagcgcgcaaagtccaccttaacaaatgggaaatatttcgagacacatttttttcctacccttccagaggccgcagcgatcatcaacatggtggttccattttggccacccggcatgtcaatgctggttccgctctcgacatgcattctcgctgaaaaaatgatgtggtcagagtgtcaaacacacaacggcgatcaatttggacgccatgccattacccatgatctccacaaagtcgacgaactgctcccggttgaatgactcgatcagaatggaaatctcgcgcactgcgtcttcgtttcccaggccgatggacatgatgagttggcgaacacgttgctccaaatcaacggcttcatcaccaccaccagcggcagcagcagcagcaggaggagg

SEQ ID NO: 26339 - DNA, 1479 bp, Heterodera glycines
tttttgtctttaaaacaaaatttgatcctttttctccccaaaagatgtagaccagttcttttgtttgtgactgcgccaattgttgtgtatttgctacaacaataaaaatgtttggtttttaaccaaaacaaatgttgtccaataaataaataaataatttattaaacaaataaatgaggaggaggacagcaggaaataaataataataaaataaaataatgaaatggtggaatgaatgggagaatgcccggagtgagggaaagggagacatatttatggggctggtcaaggggcggggcgagagacaataagagagggagtgaaagggaaaatataatcaatagggttgttcccttatccaacacatttcattcgttctccctaaatttttctcattttgttgctgcacttttctgctgttggtcgattgtgccatcactctttggttattttttggccatgtcaaaaaacgacgacgccccaacaaaaaagaaatgtaaaaattcaacaaaaaattttaaatatttcttcaatttttcagctttatctgcgccgattgttggcttttggtgtttgattttcttacgccttcccaatttggccccgaaattgcattgatcaaccgctgctttgacatttacgtggacgaacatttcaagacacgcaaatggaaattgggcgaaattcgaatttgctacaaaattgaagaaaatggcactaagcaaatgcatattcacaatgccgatgcaaatccattgccaatccccaaaatccgtttccgaacaaaatcatcggattcagacacatcaaaagcatgtaaagattgattaatttgcaatttttcgtcttaatttctgcttttcagttacatcgatcaaaatgtcatcgcatttctccgccgttttcaccgttgtattttcgccgtttgtttaacggatttgttcattttcacgggcaatgttagccttttggacaacatttggccaatgttccgcaattctatgtgtgcgatgattttgaataccatcgcttttcgtcgtttgcgtcaattggccccgtcacttctcaacgattgttcattcaattgaaccacaaaaatggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcaaaataagcgaaactgtctgtggcgatcgatggcaaatttgtgggatttccattgccggaccattcgctgccaaacaaaatccgttttcgtttccttcagattcagtaaatcaaaaactatacagaaaccaattaatatggttggtcatcttcttcattgtt

SEQ ID NO: 26340 - DNA, 1912 bp, Heterodera glycines
cgcgtactgaaacggctgggtcgcttttgcggcctcaaatgcacgttctgcacgcccatacactttgctctccagcgcactgatgcgctttttctcaggccattccgccgtataaacatcaaatttcttgaaaaatcgtcgaactgcgtcggtgccctcagacccattcaaatctgggattttttccaacaccaaatgaaattctagacgtgcaaaacatccaaattttggctggggttaggtgcattttgtcggggctgatgacgctgctgttcaaaaacaggctgcgcgtagctcggagccggtggaatgcgttcgttcgcataagggaaagacggtggaagcgattcaacatgctgaatgtattggcggtggatgacgctgtgttgaggcgctaacggcggtcggttcaacaatggacgctgctccacaaattcgcggttattcgaagcgcggacatttgtttgacccctaatttcgctgctaatatgtcgattttgcattcggttttctccaaaatgctggtgtcggttcgggctgactctctcaactccaaagttttgcagtccccctctttcatgaccaaaattttcaaaaatttcgaagtcacgcaaacctccacgcatttgctgtccaaattccatttgtgcgtcgccgccgtgctccaaattttgtccaatttccaccgattcgtttccgttttgttgccccaaatttggtgcgtctccgttttgagtgccattgtcgttgcgaatgttgcgtccgatgctcacgttcagaagtcggttgcgcagctcggtctccgtcatttgtggctgtaaaatcaatccatgattgctgtggtgtgtcaaatttggaaagatcggagagtttctatcaatttgaaacaatggcgggtcaattcggtgatttaagaagcttctgtgatggctttcagatgattcttcaagggggttttgctattggagaatggcgccgtcattgttcaacacaattccctcagattaattatggattttaaatgataaattcatacataaaacaaaatcgtacaagaaatcttggaatttttttttaaacgacattggtcgtctgccccacaagaaaggcgcggatcaaataaaaatttaattggaaaatttaattttaaattcttgatttttttattttcttttttttttacataaatgatttttatttaaattaattttatcaccaattattaatctttttgattaattaataaaaacataataaattatttttgttttttccttttatacacaatttaataatacttgaaataatttatttactatattaatgctgcatataaaatgataaacaattacatagtaatgtggaaaaaattttttcatctatacatattctcaatccgttcaaattcattgaaatccctaactctctggcatcaattagttttttaagaaattttgcaagtgtatgaattaataattttcattatttgtttttattggttttctttttttgtaaattatatgttaaataatatttttattaaaaagtttgtgctgaatcatataaaaaatattgaatatgaaatttgggttttccatgttgttaactttaattctttttgtttgaaatataaatgtttttattacattctaattatttagaattgaatttatttatgtgtgatttttaaattattagttgttttatataaaatatttctgcataagattaaattaaattaaatattttaattttcattaattagccttatattcaagcccccgataatttcaatgattatataacgattttttgtcattttatttattaagccaattatgattatttaatcataaacataagaaatgagaaaattacattggtaaaactattttaaattgcaaaattaaaa

SEQ ID NO: 26341 - DNA, 1474 bp, Heterodera glycines
  misc_feature (9)..(9): n is a, c, g, or t
  misc_feature (18)..(19): n is a, c, g, or t
gcttgcatnggcctgcannggtccctgaaataaaataatagtttatattttttggttatgttcggaaaggaggatgtattatttattagggaattaaaggggtcaaaacagagctatggaactatgtggctttgtttgaaaggcaagattgcgaggaaaggaagtggcaacaggaaagaggaataggaattacgcgatttgttgggagtgcaaagtgtgaggattaaagtgaaatgtaaaaataaaatggagataggtcgagtaggaatttaaatgcagtaaaaatggcctttttatctgaaaaatttgacaaggataggagcgagggtttgattttccgtcatgatttccagttgcgggaaattcgtttgttctttatgttaatattaattcactgtgcactaactcaattagtaccgaggatgttgttgtatatgtgaatacatatttggtgaagttgggagttgtcgaatgtgactaggttattccagatattagggaattctttacctttctacataacatgccatggatttttgattaaagatgttgggtcggaaaatgcgtgtaggttgtttaaaggactgttagagggagtgtttttaatttgcgacacggtaggcaaatgggaagggaccaagtagcgcttagagagagagagtaaaaatacaaatgataaaattaaggcgagtcaaaaatggagctattgaaaagcttgagctgctcgggtgtgactcccaatttgtgacagttggaggagaggatggaacaggctttgggtcggactttaaagcatccgtgagatttggttgcttatcagcagagccagagcacacgagctgttctttgatttgagatggtgtagcggtgattggttgttggatttggtcagagaatgtaagagtattaaatgaagggtggagtgaggacatcaattcgggttgccatggttaccaacccagtattaagttcctcagaaagtttaaagattgcctcatttgttgcattgagcctacgattgaggtagcgaaggttgctgtttgaggcatcttcaaggccagaaacttcactcaatacattttcgaggtcactaacttttgcttggacggagggatttctacctgagaagaggcgacggtcaatcgcaacaatatcttcgtaaggtgaattctctaaaggattggccatgataggggaaatggaaagtatcggagagggaactgaacttgcgcaccgtagagggaaagaaataaaataaaagttaattgtatataatcactggatatcgcacaataaccaggatttaacttgctttgctgtatttaattgggggtgattccggggcagatataaatggttcaatgcaccaaatatattaaatgagaattgaatgttagaaccaaaagaaacaaatatttaattgtcttaaatcactggatactgtacttcgtaacctaggggtttacttggttta

SEQ ID NO: 26342 - DNA, 2073 bp, Heterodera glycines
  misc_feature (151)..(151): n is a, c, g, or t
atccggtgctcgactgctcgacctgtgctgcagtggaccctggcaaacgaccaaccgcgtcacaggcgtgaaccacagtggctaaagcaaggtggaaccaagcctggtgccgacgctggaactgccgcaggatcaggactgtgtacgaacncaacaatgcattacattttacacatttattacattgcattacgcttttgaatttgacggggtggggaattggccaaaaattaattggaaagcattctcataaagcattttacatgccattattcttggtgttttcttttgatgctattgatttatcaaattttcttggagccgacaatttgcccgaaatttagcatgaaatgtggtcaaaacgtcgtcgacagttggcacgtcaacaaagtgccacttcttcactgacttcttcaaatttttcggcggacaagaaacagcagtcacaacagtagtgatgaatgtgcattgaccattttagccgtaataaaacattttttgcgatgcatgctgttctgatttaaatggttgggctgtgcgagacgccataatttagtgtcgaattgagttacgagacatctatttcttcaataagttttgacttgtaaatttaatattgtctaaaatgaaccgacgatatgcatacttccctttttggaactcaaatgcgagaacattgggacaaacattctcgcacagccctaattaacaccaaattgaaaggctgttctcaaaaataaatgtgtaccatcccttaaggtgtttgtgatcgtcctcccaccatctgtcatcatcaatattcgaaacaccaaaaaaaaaattaaacatttttgcttcaccaaagccttcggacactttcggcgacgaattattgttttatgtgttgcgtaaccgagcgagagaactgatgagactgttcacaatacacaaacacataaatattcctcatttgtttttttttgatattttcaatttgcttttaaacaggtcgaacacctcacttatcacaggttttctttcaaaattcaatcctcagagtttgttcactcggtgctgcctttatggcttcttcatcgacactcatagaccaccgccgtcttctcattgttttaattggttgttatattgtgcatggcgcaccgtttgccgatcggagtgactcgcaaccagcagagaaagcgcggtgagtttttcgggataacacatgtttttcgggttccttttgagtcccttccttaaatgtggtactctgtaagtcttctaatttatggtactgtgaaatttggagtgatgggccccttttgtacggttaccgcacatcaattgtcgatttattactgaaattcgtgcatattgatggtagaatcagccatttgttggtttacggatgggctagaccatgtaatttgcataacttataggataaaaccgctcatttgtcgttgtgtttgttcaatgagtttctattcggcaaacggtgatctgaccactaatcctccctccactttttattttcttttctttttgtccaggcctcgttttctttgtttgttttctctgcgggtaatattgcacttttgaaaagatctcagtttaaagttggaaaaaattcaatttattttgtgaactaaacagttaacgcaataaaattaaaaacaaattcattcgtgtaactatggaaacttttttgtctaagaaagtcgcaacaaatatttttttgtgtctgaatttgcatttttatgtccactttaaggtttctttttatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtaagtgaaatcatatcaatttcaatcactttctcattaattttgtaggtcaaccttggatgtgttcccaagaaagtgatgtacaacaccgccatacatgccgagtttctgcgggaccatgctgactacggcatcgactcaatgaacgtaaaattcaattggaggtagagtata

SEQ ID NO: 26343 - DNA, 1105 bp, Heterodera glycines
  misc_feature (1044)..(1044): n is a, c, g, or t
aaaaaaaaaataacattccgggtgcgaaaaatggggtttgaaaaattttttggggaaaaaaagactttacaaaaaataatacccctgggagaagggagtgggaaacatgatttcaaaaattttcaattttttctagtctaatctactcaaaacggttcagaattcaataaaaataacattcacggtgcgaaaaatggggtttgaaaagtttattgggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaaatggggtttgaaaagtttattttgaaaaaagactttacaaataatacccctgngagaagggagtgggaaacatgatttcaaatttttcattttttctagtctaatctactcaaa

SEQ ID NO: 26344 - DNA, 1727 bp, Heterodera glycines
aattaaaaaccaaaattatgctcaaatttcgtgattttatatgcatatttttgtcagccttaattattattattttttattatattattaaatttatttaaataagatattttaagtaaatttgttatgtttcattgttattcgttggccatgctatcactgataacgctgctgttaagtgtcggtgccggtgctttttggccctattcgggtggccaacccgtggacgtaaataaattttaaaaattttgaaaatttgtctatttaaccaattttattaaaaaaaaatcatcttcttggtttttaaaaattggaattcctttttgtaaggcctcaactgctgtgagtgcaccgtcgggtgcacattcgggtgcggtgtcctccagttaccatgacttgagcctggtcatcaacggatgcgtttaccatgtgtgtgggttttttaggcgcttagagttgagggccacaaaatttgaatcgagagtgcgttgagagagggagagagagagaaagaaagaaagaatgaaagaaagaggagagagaggtagagatagagagagagaaagaaagagaaatgaaagaaagaggagagagagagagagaaagaaagaaagaggagatagtgatagagagagggggcgagggtaagaagatacagaagagaatggatacagtaagcacatggtctcactatatcctaatcttgtacatgatgcgcctaaagtgggggcctgagaattttaagaggggtgtggctggctgctaggtacctgaaattcttgaaatttttctccacattttccattttcaagaatggcatgatcaccgagaacgggggacaggcacgcaaagcaaccgctgaggaggaggccaaggtcaagcagtattttgcatcgtcccaacgctcccaggaacagttccagcaggccatggccgaggcagggacaaaaatttttttttgttgaaaaaactcggtttataggcctaaattttccaaaaaatttccagaatatgcgacgcatgttcactgcaccgtttggcgcctggcaattccccccattcccgcaacaattcccattctcgtccatgccaatgatcgagacgccgtgcttttgtgaaagctgccgaaatggcgcgtcaatggtgctgtcagctggtggcggattagggcacagagggctaatctccttccccatccctgccatttccgggatcaatcaactccatttcgtttctctcctcactaaaaaattttcaaactttcaatttgaaatttatgacaaaaaaatcatagaaaagtttttataaaaaaattttaaaaaaatttgaaaattttatgataaagtttccaaagaaagaatcgctcaagatttacaaacaaaatttttttaatttatagctttgaaaattaaaaaaaaattctgggggcggatcagatgattaattaattgtctatggcaaaataaacaacttaatatgattatctctagtcactatatggacaataacttaattcataccgagtctctcgagaaattaggaaggaaagctcaatttttggcttgtagccagtcctgggatctcggcttttcgggtcccgattctattaaaaagcataagtcccgacttttatgatccgatcaattttgctcgtcccgctttttcccaaaaagctcgaccccatcccaacccaatatgccatattcagaatcacaaagtgcagtcgt

SEQ ID NO: 26345 - DNA, 1082 bp, Heterodera glycines
cgcatgtctaaatttgaaagaaatggaaatcagcatggtcggctcattagtgtcgattagcaaatcaccaacccgcagcagattcgtggccagtcatttctcttccgtttgttggcggatttaaactgcaaacggaagattatgccaaatggggtggtgccttcggtcggctgaactcacttcgctccttgggccaaagcactggcatcccaatggattaggccagaatcggaggaagagaagaaattattggcgaagatgggatggaatttgatctgtcgcaggagaaaaccgacaagttcgttacggctcattctgattttacccgactgatcggatgttgagagactttgaaggcgacgggtaactgccgattgacctgacgaatgtcaacaaaggacatgacgccgtcttgggaaccaaacgcaatctgacggaggggtgggggacgaagtgacacgaaaatgcaatgaaaaacggaacacaatacaagttgatcaacgttggtcggtcacttaccaagtttggttgggccgggtgtgtggccaacgcggtgattgaattgttcaaagttgtgacggaacgcgaaaggaccggctgatggccgaactcagccgcagcggcagcgcccaggcccgtatccagaaaacaatttcgaagagggcacctgaagagccaggccaaaaatttttttagtgttattttcaaaatcttcagcgattcttacaagggaacctcgcgagctgtcactcaaaaagtgggtatacatttggtaccattggatagagcaggatcgacttctattgtgaatttttaattttaccggtgtgtgacgaaaaattaagttatgaagcatcgaaaatcgaaatttgggccaaagggcccatttccagctctttttattaattttcaaacctttaaaattgactgatttttgcttatttccactaaagaaaaaatatcacatctttttttagtctaaaagtgatttttaaaattattaattatattatatattgtaagccgggactcgggtctcggctaccgattgggattggatgggagaggctcctccccattgg

SEQ ID NO: 26346 - DNA, 1304 bp, Heterodera glycines
tagcatcggggtttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttctgcagctcttagggtaatggaaaaaattttgaagaggctctccggaacggattagcatcggggttacgagatagaaaattgtcctaaaaagagatagccatttttctgagaattaattcacaatttcatcacctcttgcggtaatggaaaaaattttgaagaggctatgcggaacggattaacatcggggttccgagataagcatccccataagagtgtctaaggggatgggatttgtccccataagagcgtttatggtgatgggacccatccccatgagagtttttaagaggatggcatccgtccccattagaattaaattttcatgaaattttttgtcacttataccgtttagcgtagactcaatagaaccaaccatataagaggtttttaggtgaatggcattgtgaccattataaagtctacaaagatggctttgctttgtcgagtgagttttaaatggggtgagagacatttccgttgtcatcaaattttcaagaaattttttgtcaattacaccatttagcgtagactcaatagaaccaagcattctaggtgtctttaggtcgatcgcaacgatacgcgtctaaaaa

SEQ ID NO: 26347 - DNA, 2165 bp, Heterodera glycines
cagcggcagaatcaacatcacgaagatgttggagaggagaggggaagcaactccaaaggaagcggaaacgatcctacagcaacaacaaatgccaacagtggcacagtgccatcagcaaaatagaccaaagcagcaacatggtggagcagtaattgcagcaataaggacgacgacaatgacaacaacaataacatttccactgcacattgctgttgaaaatgttcgttttgtttacaacgggaacaaatttacgtgatttattaataaaaaaaactaccaaaaataccaatttagagttggaaaaacttttgtaattcgatcgctctgtcagatccaatcaacaatgatcgagtttctattgttgagcggcggcaaaattaacaaattgaacgcatggaagagctcaccgctgcataagaccgccgaaaatatccattcaagactatttaaaagggtgaaaaacggtcaagtttacactagcgccataattagcgtaatttgccataaaaaatgaatgggcaatgattcgatgcactaaaagcaaagggccaatttaggcactcagaccatccctctgctcgttctgctcggcttcgacacggagatgaaggaggacgggtgccacatttggcgcctccgccacttcagcaaacgtaacacccaaacagtgtcttctgtcggtgttttactgtccctcgccttatttcccagcaacttattgcaacgtgtgcctgaacatgctagtgggttggggcggtaagcagggtttagcctgctcattgtgcaaatacaccgtccacgagcgatgtgtgcgttctgcggccaacaattgcatccacacgtacaacccgtcaaagagggcggcggacaacaacggggagagtttggtgcaggaccaccggtggatggagtccaattggtgggggggggggggggaaatggccaaatccaactccgaaaatgcctttccgcttaaagtggcggaaagtgtgccaaatgcaaggccaacgtgagcattttccaaggcagacactgccgttggtgcaaaaacctggtaacatttggaggtctttccctgttgggagtgttgcgttcagcttcactccaaatgcattccgtcgtggcccgcggcgtgtgactttggccaattcgctcatcacatcgttcgtcgccatttcctcgctttgtccgtcattgctctgtccgtcccttcagttgcctcccgtgcacatcatcccgactttcatggaccgttcctgctccatctcgaccaatttccgccccgtcgcccactcggcccacccccaacaaaattcagccgcactgttcggccacaaatagtgacagttccctcggagggggccttttgcaggtgttggagaaccgtaaccatgctatccaatgcaaaagcattccaagttaaaagtcattccgttgccgccgaacagccgttgccggccattgctggtgctaatcaacccaaagtcgggcggacgacagggcgaacgcatcttccgcaagtttcagtatttgctgaacccgagacaggtgcgagaagggatcagtcgcaaagttaattacaaattttttaccgcaggtgtacaatctttgcaaggacgggcccgagccggggtaagtggccaatgaaagggaattggaagggaaggggaaagaaatgattggttggtcaaagtcggcattggcaggctgaacctgttcaagtcactgaagcagtacaacatcctcgtctgtggcggtttgtggtggccaatgcacaagggcaaaacactctttgctgccttcaggcgatggcaccgtcggatgggttttggaatcgatgggtaaggcactgattaacaaaaagcacacgcatccatcgattcgccttgccacctcgaaaattgccagacaaaattgcctatggcgacggtcgtccgccggtggccgttcttccgcttggcactggcaatgatttggcgcggtgtctgaaatggggcggaggatatgagaacgaacctttgcagacgattttgcagagcatcgaacggtcgactcaggtgaaaaggaaagggaagagaaggaaaagccaaggaaagaaagcgaaggcggcaaaacaaaggggcgatagaagaaagcattttcagagcaaagacaagggcaattag

SEQ ID NO: 26348 - DNA, 959 bp, Heterodera glycines
gtatgatttataaaaactatttttttatggtctgtaaacgacataagtaagtaccttcaaattatactcaaattattgtgttcgagaaacaaatgggacaattaattactcattcgcattgtgtgtcattgtttagcaaaaagtctcaattccctcccccgcccattttttgcttattaattctccaatttcaatggttttagccttctcttccgtcgttttgtgctttctttctttccgtctctctctccgttaagtgcaatttgttcctccttttctgagcaacttgaaattcgtctgctgaccaaattcagttgtataaataagagaagttttcctctcgaaatgaattttaattttggttttgaatttggttacctatgtttttagacggggtaaacttaactcatccaagtccaatttattcatactcaactcatccatgcacaagccacgagcataccgcacaatgtaagaaatgcaatgatgacgagcccgcatcgtgctgtggatgtgttgggtatgaatggattgggcagggccatgactcaaggaatgtgcaatggaatacgatttagtcggggtcgtttttttgtaattcaccactcactgtattttgaaatgatgcttttcgtctcttatctttacacttttttatacatttttacattgctataagccttgactttgagtaaccaacctcaaattgattttcccgcaaaaggacttgcttcgtttaaacttttaaagtgcagtgaaagaaaagagcgatcaaaatcagcggaaatggaaacattttgctactcggaattagtagataataataagtattcatcaaacattttttgttgatacatttttaggattattcgaaaaagggtaatccttcggaaatggtgtcgcgacgggaaaaagagataaaaattttcttttaactttttctagggtagaaaaatgca

SEQ ID NO: 26349 - DNA, 1472 bp, Heterodera glycines
tgtgagttctaaaaatggaaaaaatgatacttatggagtttaaagtgtatttttcacattgattgaaaatatctataaatatacttataaattaaataccctataaatatatatacctatattttaaaagacctttatattcatgttctatttttgctgaaaaaggcatttttaatggcacttttttttcatttcaacgatttacaatgttaatgatgcctaattcttttgttttgtttatctttatgatgaaaaaaaactggattttataagtatatttatagggaatttaatacgcatgtgaaaaatactattttaactccataaatgccgaaaaagtatataatatttatttattaaatatttctttaggataaattatttattttcaaatttaggtatttgtctgtccatcatcaaaaaattatcaattttttttaaatttttttgtgctcaactcggaaaaacccaaccttcttttcgaccagcttaaagaaaatgatgtataaaagaactgtagtacaaataataaggcacagtatcaaaaaaatcctttttgtattaatatgcatttctgctaaaacagttaatttaaacaaaaataagaaaaagcgcaaaatatgtacataatatgaaaaaaaaatccagaaataagtatgaaaaatataaaaaattattgcggaagaatttgttttaatataatttttttaagtcagctgaattattattgatcgtttcaattttttaattaagaaatcagaaaaatcaaatgccaacaaatatgattttaaagaaaatctatggaataaaaaaagataggatatattagtactgtctatcagcattatttgccctgtaaagtttgggttgtgtctgatgatgcacgatgggggaaacacaaatcagtggggaaaatggtcactcccccggggttggggaagtgtcgtgtggagtgggatgcggaaaacaaattaaaatattaaaaaaaaaattaattaaaattaaccaattaaaagcattcaattcaaaaaatgtcacaaaaaaaacaatgatgattttttgagtacttaccaagaaaacctatataattctttcagaaagctttggattttaaatttaaaaaattttaaactttttttatattatcaagtctttgcctggagtatcctttgaataggaaaacactagataggtagtacccgttaaaagcaggtcctcaaaaaccaggaaaagaagatatggtcccaagacggatctgggccttaggatgaaggctcaaaatttgttcttaggttagttttaggtaacaagatatacatacataaattaaaattttttatttaaaatctaggtcttggccgggtatggttatattttgccagaaagaattagctttttttggattgtagaatttattatttcttcattaaaagacacattttaatcgattgagcacataactgtgatgtttg

SEQ ID NO: 26350 - DNA, 1058 bp, Heterodera glycines
agttggcattcgcccatttaccgcagtgtccgtgctctcccttctctccgggttgtccgggctcgcccgcaccgccggggttgcctggctcgccgggctgtccggcatcgccgggtggaccttgtccgccagggtgtccgggctctccaggttggccaggttggccaggtccgccgggtttgccgggatagccaggcgggccgggcggtcccaccttgacgggtccgggcctaaatatgcattaattaactaaatatacctcccctcctctcctacttgagttctcctggtgcgcctggctgtccgggtgctccggcgtcgccgggctttccgtccggacccgctggaccgggcggaccgcgtgggccctttttgccgggatagccgggtgccccgggctctcccgctgcgccaggttggccgggtgggccctgggggccgggatgtccgttctcggccggagcacatgtttgacatctgtcatatttaggcattttgtgaatggatgaaccaccgcttctcaatggcatgcttaccctgtgccgctcggtttcggacgcggcggagcctgtgccggcgcgccaggctgtccaggtccgccgggctgtccgtcgccgccgggatttccatctgggccgggagggcctaagacgagggagggcattagttactgtccagaaaatgccatgacaggctcactgaccgggcggaccacgcggggattcgccacagccgcagcacgcgtcagcattacgcgccacgcggtggcgagtcgccgcatgcattccctgcaatttgtaaatttaattactttttgaattcacattaattgccccctaattggttgacctgagtgcgcgtcacttcgcgccaaatattgccggaacgcattttgcagaagtcaacttcggccatcatttgtgagttgatgtgctgcacgtaactatacacctgcgcaagagtggacacgtttttttatagttttaagtgattctatccggatgtaattaacgcataattatgtaattagctgcagtttggcaattaaggaaaggaat

SEQ ID NO: 26351 - DNA, 2189 bp, Heterodera glycines
agagagagagagagggagggaaatagtgaggctgagatgagaagggaaggaataattatgcagagatagtgagaaaatgaagagaggaaggatagaaagggaggagagagagagagagagagatgagaaagcgtgagaggaggaggaagtgagagagagagagagagagaggcgagagagagagaaagggtggaggggtgagaaagaaagagaaacaaattaagcatgaaaatagtgtgtatgcgtcaaatttcaaatttatttgtgtgcataaggcacaataattgcttttggttgcgtgctttttttgggcgccgcccgcgcccggcggcgcttttgcgttcactttcactttttttgcgctccgccgagcgccggcgccgccgctctctttgtgttgttctttggttttttgcgttgcgtttgttcaattttctgctgctttccttttgcccgcgaaaaatttactctcaatttttgttttgtcattgaaaaatgacggcgaaaaattgaaaagtgaaaatgggcgaaatgattagagagaaaaatgggaggaacggacgcggacggacggaacggacgaggcggggcgggaggccaacgaggcacacacacacacacacaaaatcacaacacatttgggacgaagaaattgcaaaaaaaaaaaagaaaaaaatatggggacgtttaaaaattttgtagaaataaaaaaaaaataataatttgtttgaatttaattataaagtgaaaggaatggttagagagagagaggaaattgattttgggatgaatttatgaaaaatgggaatgttatggagttaaagaattttattttatgaaattttgaaatagaaatttaaaaattttcaaattaaggtacggtaagaagagaatgaaaaataaaaattttcgaattaaggtacggtaagaagagaatgaaaaaagttttttaaattattattttatatggggaatttgtaaaaaaattgtagaaattttcaagattttgtgaaaacattaaattgaaaaaataagcaaaaaaaatatatttttttaataaaaattgaattaaaagtagcaaattataaatttaataatgacttgggttttggggtaggcagtctaattttttttccccgattcaatcacaaggtacaaaagtgtgctgcactaactgtggagaaaaaaattgataaatgataaaacgttaaaatcaaactaattaaattaaaacaaaaaatcgtagaaaaattaaatgaaagttcagcaaaaatcttaaaaattacatgaccaattgaaaaaaaaccctttgaggagccatgaaaactcttgaaatttttggaaaattttcccagtataaagaattatttttaaggacgtccttggataaaagaacaaatcctaagtttcaccttttttatagtatgaaaaagcttggattaatttaaattgaacgaaaatgtaaaaatttataaaatatttaatttaaaaaaagttttgaaattaaattttcctccgtattttttaaaatgccttattagcagcatacagttttatttctgtgggatttggcctgcgactgatgactgactgctgctggtgaacaaataatgggaggccattctcaaatcagcacacaaatttatccccaattattttttaaataaaaaaacgaacaaaaaaattttctgccaaaaatgctcaataattaattatttgtgagtgtttatgtttaatgaaaaaaagtaattaataaatttccaaaaataaataattttttgttggggatttttattttggggctgattttagcttttgtttgcttaaattttaaatttaaatagaaaataaaagataaaaataaatatttgaattttaattgaggtttaaaattaataattattaatttaaattaaaaaaataaaataatcatttttaaatttcttgaatcgacttttactatattttaaagcaatttataataaaaattgcaatttggaattaatcataggaacaaggacacaaaactaactaactgttgacgataatcggattaaatatataatattttaaaaaataatttccaatttttttttcttcataattaggtccattgattatttccattgattatgttttatttcctttatagttatcttcttctttttcattttcgaagaaagcttcag

SEQ ID NO: 26352 - DNA, 2108 bp, Heterodera glycines
  misc_feature (74)..(74): n is a, c, g, or t
  misc_feature (155)..(155): n is a, c, g, or t
  misc_feature (160)..(160): n is a, c, g, or t
  misc_feature (236)..(236): n is a, c, g, or t
  misc_feature (388)..(388): n is a, c, g, or t
agaaatgagaaagttatgggggctcaaaaacccgtaaagtcttatgccagttttgttatttttattaattcccncaactttgcatttggatctgctctatccaatggtatatcttttaagacgttctccgacttacagctgggaatgttaaatcncaatnccatgcgcactttgattccccttttccctttattagctcaaaagcgaaaatctagcagtttttggtgaaaatcctntaacaaattacacccaaactttctaattcaccgacggcgcctatcggcatcgccagatctcccttgtctccaaaagttttggaaaaagtgcgctattgtcggcgatttacatgacttatccccttcataaaattaggtgatgatcccccccncccggttcaccccaaaacacagccgcagaaacacagcagagacataacacatcctggaaaaaattaaaaaattttcatgaaaaaatcttaaaaaattattcttagaaaattcaagggaaaaaaataaaaaacttccagcgatttttttgaaaattttttttaaaattttttcccggctgttatgtctcggctgtgtttcggcgactgtgttttgtcatttgtcctgttccatatccccccccccctccagactcgttcgtaatctaccagaacccctcccccttttaacgtatgattcagttcacaaattaaggcgaggctatcgcaatcccgtacttttgttgcaccccctcggcggttggacaaaggacgatgacgtgccattgaaggcatgttttgggggcaatttattttttaattgtttttgtttgaggttcgaattgcgcaacacgaagcagtgttgaaggagaatgttttggacgctgattgggtaggatttgggcagtattatatattttttaagtcttataaattgctcaaaatttcccattttttgtgaactcagaatcagccggttattggcccggttgttatttcgcacctttagactgttttggccatttttccttctccgatgctttacgcagggcccactgaggtgcaatggcacgcccgagcaagattggcatgtggcgtgaacgcttacattgtcggacgcgatccggcaggcatacaaaatccacgtactggcgattatttgtacgaaccaagccatggcgcaaaagttagtcaaggaaagattgtggcgccaccggcaccgctggatccctccccttccccatagttttaaataaacacccgcaaaaaagtggcctaaaaaggaaaaggcgtctttcccccgtaaatttaggcttctacccctcccccttttttaccactattaacttatgtgtcgaccaacatcgtcaatttttattgcattactattccttaaaggttctctcaatgactaccggtttggtcggcctggagataatcccatttcgtgtcgcagcttacgattcttttgcgggagccatggcattttacgacccaaaccggcacgataatttcatgtttatcagtggaactatgatgagaaagttagcgagggaaggacgacagccaccggagggatttatgcccccaaaggcgtgggaagtatgacgaagaaacttttggtgtttcataacgaattatttgctaaacaggtactttcgaattactatcgtactcaaaatggaaatgagcataacgacgccccaacggaagacgcgcggaagaacggcagcacggggaaataaaggaaggaaatcattaattttatttattcgccagttcaaatcccgccattttgtaaattgttcaatgtcaaacgctttgattccccatttaattctctgttcatcttttaaacatccaagtttcgcaatgtaatgtacataaatgtcagctctgaaaattttgctttgtcagtcctgtacattcaggttacccgcacttttgcgtcccggacatttgcggcccgacatttgcgtcctggacatttgcggcccgtttcttaagggccattttcggacatttgcggcttcgtgtaacatattcattatccaattttttagaatcgaaattcaaaaaaaaacgataaaccaactgtacataattatttccctattatcca

SEQ ID NO: 26353 - DNA, 1330 bp, Heterodera glycines
caccttcataacaagtttgataaagtccaaatgcaaaacaaattatttcacttcatttgaataatttaataatatcaaaaactgtcatatgttgatcaatcaaaattcacgtccccccgcccatcagaaatttgaatttcccctcatctgtcacttcgctgaccaatcaaattccccctccccctcggctgtcactttttaaatcaatcaaattttatgtcaaaaaaagtacaagacaatttgaaaccgttcaataggtttgggtccccccaattaattaattaattgacaccccaccccacaccctacggctgaccaattagtgccctcttgactgctgaccaattagtaccccccccccaattagtgactaattgacacccctccccccgccacctgtcacttctaattagtgtcaatctacagaggtcccgggtgtgttactactactatcggtcactagaaatcactattttggcgtatcgtcagtcatcatttattaattttgattcacgtttaggtgcgtcggctgcgccataaactcagcaacgaacacaagggagtgactgtggacaccgtggagcgttaccagggtttccagcgtcgggtgatcattgtcagcactgttcggaacaacgaaaaggaggacattggctttttgatgtcggacaaggttgtttaatccagttctaaaaacttggtgttaatttcaacgcttagcgtttcaacacaataatcactcgtgcggaagagcttttgatcatcgtcggaaatgccaaagtgatgatgagggactcgtcttggaaggagttcgttttgaaatatcatttttcctaccaaaatgaattaatttttttatccttttacaggatgatcgactattgccgcaaaaacggtgccacagttgacatgccatcggaagcggagcttttcctacactgactgatgggggcccaaagaccgaaccgacgggcggggatatggacgattatcgctttttaattttaaagaatgtattccttttcttcaccgctttatatcaaattttctctcattggtattttttgaagaatgcataaacaaaatcgtccccattttataatacataattaccaattaatcaattgactgcctggcaatcatcaagaattggtgtcccgacgaaaaaaaatgttaaaattttggcaggtattttttctaggcttaaaaaatgcgccgatcacgaatctgagctcagattttgaaaatcattgatttttatctaagatttttcgtcaactacttgatttttttcaattttttaaattatttttaaaaaaattttagcaat

SEQ ID NO: 26354 - DNA, 1272 bp, Heterodera glycines
accaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgactcatgctgatggagcattctcaaagctactcattctttttcatcattcattttacaaaaatgtctccaaatgaatgttctgaccgtccctttcaacaacccgacaatgtacaacagccgcatcgacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggacgagcccctgccatagaagccgcgcttcttcaacgcgccgaacgtgaggcagaaattttgcgcgaatatgccgagaatcaacaacaatgagaaggggccattcagatatcatgtcgtatgttatttttcttattttttttttttattatgatgataaaaaattttacaatgcagaactgcggaggagaatggaaatggatgatggggggggggactaaaactcgcgcacccttgaccgatttacttcaaattttacgagccgtcaactcacacccccttaagctgaacggcgaaagaattttgcctctagcaccattttgagcggtagattcccgacgccccgccccctcgcgcaccccaagacttgcgcagcaaaactcgcgcaccccttgtccgattgacttcaaattttacgggcagtcaacccaccaccccataaactgaacggcgaaagaatttcgcctctagcaccattttgagcggtacattcccgacgccccgccccttcgcgcaccccaagacttgcgcagcaaaactctcgcaccccttgattgatttacttcaaattttacgagccgtcagttcaccacgccctaagctgaatgaggggggtccgcgccgacggacggcggaatgatggggggggggtccgtcgaagagaggggtcccgccgccctggtgg

SEQ ID NO: 26355 - DNA, 757 bp, Heterodera glycines
tctgtcactgtcgaaatcagccactgtcgggaatgtcggaaaacagcaaaataaatgaaaatagttcactgtcgaaatcagtcactgtcgaacgaaatcggtcagtgtcgaattcagccactgtcgaaatttcctggcacgttcaatcaaattgccctctaaagtcttggagtaaaaactcgcaatattttaaccactaaagaatcaaatagatttgtttttctcgccttacgcaaccatttcgaaatatttcgccggcgtttgtggcaattcgacactagaaaagtgattttgttggttttagaaccttagcgtccaagtaatgaggtacaattaaatcctaatttatgattaaaattccgcatagagttcaataaataattttcattgggagaccgaaattttttgattgtacaccgtaaccctttaaagtccaatggcccaaataggacgataatccttggcaaaattagcctttcagtatttacgaaccttttctgctgctaatggctacctttaaatcttcagcaaggagaacactgtgctgcgggcgggcgtcgcaccccagcgcgttttcgtcattccgaacgccattgactcggcactgttcacgcccgatccggcccttttcgcgtgccaaaagcgcacaactgtggtggtgctcagccgactcgtctaccggaagggcgccgatttgttggtggaagtgatcccggacatttgtgaacggcacccaaccggtgattataattaatta

SEQ ID NO: 26356 - DNA, 1643 bp, Heterodera glycines
gcgagcgcctcttggtttgggatgcgtttggcagccacaagagcgagagcgacgaaggtggtgaagggattgggagtggaaacagtttttatccctggcggctgcaccaaattcatgcaggtaccaaagcatccttctcattaaaattcacttttcttccctaggctcccgatgtctcgtggaacaagccgttcaaggagcgaattcggcatttctacaacacttggatgtccaatgatgcagaaaaagagttcacaccggcaggcaacccgaaggcaccagcgcttcacatggcacttgactggatccaccgatcgtggcaggaaatttccaaagccgtgatcatcaaatcattcgagggtcagtttaaaaataaaaatgcctacgaaagacgccgaaacttttaagtctgcgggttgactacgccattggacggaacaggagacgaaaaaattgcttgcttcaagccggaaggagcaattggaccgattgggatcaaatttttgcgcgactttagagcaaatgagacgatgaaagatggacgaaatgatcacgaagaagccggcctatctgatgatgatgatgtagagttggatgcagtcggagatgttgatgaatttttcgtttgttaagttttttttatttactgttgatttggttttgttttttgaaaaaaattggtgccaaacaatttcttaaaattctatttatatcccatgggggataaatagagactgggggattatttttcgaactcctcagaaagggggggataattggagactgcgaaattaatagagactgggctataattagagcaaatacggtatgcatgaaaaatacataaaacccaaaatatgcaaataaaagtcccgatttttatacgcaaacataaaaaagaaagtgtttttcctattattaagagcatgaagaagccaggaaaaaatatgcatttgcatgttttttgcagtcctgataatgacaaattaaaatgacaaattgcgaaatttttgatttaaatgaattaattagtagggagggatacgatttttaggcaaaagcctattttttcctaacaaataagctccccgtggcctgaaacgcacgaatgtgttttttcgggctgttgttaagctacttttcgagttattagtgcctattttctaggcttttatttttagcgcctaaaaagcctaaaaatttttgaaagagcctattttgcctattttggcgttttgtccaaaatttgttaacaaaaatcaataaaaacgaaaaatacacccctacacacgatcccaaaaaacgagatgtgtaccaataaatagagaatgccagagaaaaacattatctttttttctctaattttttgtctccttttggcgtactatctaatattttcattattaggaaaaacaacatttatttcgccacatataacttttccggcacaaattcgcgcactacatgccaaagaagggccagaagcggaaggagtggaaggaagctgaggatgggctcctgctgcttgcccagcttgggacacatatggcttacaaacggatgaaggcgactctgaggctgatcaacaggcgatttgacactttccccacccattgataaaggtacagtttttcagaattttt

SEQ ID NO: 26357 - DNA, 818 bp, Heterodera glycines
gaccaaattggggcgtgccaacctcccctccccccccccccacttggcttggccttcaaacccggcaatccctcggctggcgctaataaggcgggaaaacaatcgccaattgaattagcatcggaagaagccaaagacggacagcaggcgaatgaatgaatgccttcaacaatctctttgtccaagatgacttgagcccaccctttcgtttgcttttgtttttcttttggttactgttactttgccaacgattatttgatgagtaaactttcataaattacgatactcacaatcatttcaaaatcaattggttaataaattatattagggtttatattttttgataaaaaaactgccaaaatgttagtttttaggttcttaaaaaccccaaaaataggtacaaaaatgggaaaaaggtgccaaaaagcttcaaaattaaggtgtaaaaaaccgaaattttaagtaaatttgaaaaattatttggtcacttattaaaaaagagtataaaactatttaatttcactaataccaaaattcctaaacacttcttattttaggatttgggttttttgtgatcgagaaatggtttttatttattattataattttgtgtttcgaaattcaattgttaaatttaaaaaaagtctcggtctcgggatttttagtctcgagtcgtagggttgagtcttggtcagggaggtcagtctcgagaaattttcagactcgaacacactattatcggtactcccgaaccttaaataattattttaggttaaaaaaataattaaaatataattttttaaaatatttttttatta

SEQ ID NO: 26358 - DNA, 1752 bp, Heterodera glycines
ctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaactccgatgctaatccgttccggagagcctcttcaaaattttttccattaccctaagagctgcggaaattgtgaattaattctcagaaaaatggttatctctaattaggacaattttttatgtagaacctcgattctaaacctgttggaattattggcatggcaacggacggatggattatggaggagagggaaaggatggcattgccgggcgcggggcttgaccgccggcgcagggctacggacagccgaccgaagcgagtggacagtcagacaatccgtcgacgttaaaatggcaaaaaatggtcaaaagaaacttttaccgcactcatcgcccaccaaattagcctttcacttgctattaattgtcctcaacggtaaaatttcggcctcaccgatgggtcggtggaataaataattttgaaaagaataattaaataattaattatttctttagccgaaagaccaccgacagaattcatcgtccaaatgggcaattttaatatttattttattaaattatataatttatttatttattcatccattctttgttatcttaaacagaactcggcatcgaccgtgccgaggatgtgggcgcaaatgctgggcaaatagcacgccgtttagagacaatttgtgccatggcattttggcgagcgatgaaatcgcatctttttgggagagggccaattgggggcgaacgaaatggcgccggcggggaaaaaacaaaaactgtggcgaaatgggacaatgagggggagaaaggcgcagtcacgctattcccttttcgagttcgagtgagcgagtggatgtgaagcaaaattgggggacaaaaacctaaattatctgccgagggatggttaatggaaagaaaatagtgaagtggtgaaaaagggaacagtgaaatttggagagagaatagagagggggagcgagaaagaaagagagaggagagggaaagaggggagagaaagaggtagagagaggagagggaaagaggggagagaaagagaggggaaagagagagcgaaagaaagagagagagagaggagagggaaagggggagagaaagaggtagagagaggag

SEQ ID NO: 26359 - DNA, 1206 bp, Heterodera glycines
  misc_feature (63)..(63): n is a, c, g, or t
  misc_feature (95)..(95): n is a, c, g, or t
attttacctaaattcatcagaacctaaggcttctaaaataaaacgaaaattagttacatatgntcgaaaggacactaatttcagcgaattattcnatagtgttgcacaagtctataacaaactatttgccatgctttctaaaggataaaatattactagtttttgctccaagattctatagggctaattgtatcgcgagcgaatagcctaatggcgaaacctgcataattaaacgaagcaagtagtaacagaaaagcttcgttgattctgagaggcgaatctcgccaaggattatcgtcctcttttttgcccttggaccattcggggttgtagtgcagaaagaaacaattgcgatttaccacctgttaattgctttttgacccttattcataattttaataataaattagaacttaattttacctaattcatcagaacctaaggttctaaaataaacgaaattaattttatattgtcgaaaggacattaatttcagcgaattatttcatagttgttgcacaagtctataacaaactattttgcatgctttctaaaggataaaatattactagtttttgctccaagtttctatagggctaattgtatcgcgagcgaatagcctaatggcgaaacctgcataattaaacgaagcaagtagtaacagaaaagctgtgttgattctgagaggcgaatttcgccaaagattatcgtcctcttttttgcccttggatcattcggggttgtagtgcagaaagaaacaatttgcgatttaccacctgttaattgctttttgacccttattcataattttaataataaattagaacttaattttacctaattcatcagaacctaaggttctaaaataaacgaaattaatttcatattgtcgaaaggacattaatttcagcgaattatttcatagttgttgcacaagtctataacaaactattttgcatgctttctaaaggataaaatattactagtttttgctccaagtttatatagggctaattgtatcgcgagcgaatagcctaatggcgaaacctgcataattaaacgaagaagtagtaacagaaaagcttcgttgattctgagaggcgaatctcgccaaggattatcgtcctcttttttgcccttggaccattcggggttgtagtgcagaaagaaacaattgcgatttaccacctgttaattgctttttga

SEQ ID NO: 26360 - DNA, 1800 bp, Heterodera glycines
  misc_feature (73)..(74): n is a, c, g, or t
  misc_feature (102)..(102): n is a, c, g, or t
  misc_feature (143)..(143): n is a, c, g, or t
gtaaaatgagttggtaatgccccgcagcacaattaaaatgagcatcatccatgttttgctgactcgtaaacgnntcatgaaaccgacgtttctttctttatnttcttcctataaaaataaagcaacaaaaaaattattaattntaactttttttattttcgtaaattttctctttaaaattaaaaaaagttattaattaaaagtttgtttcacccttttctgctgttcctccattttgccctcttcaatgttttgcatcgtttttttgtgcaattcgtcttcataaacgagtgccgttggaaacggtgccaaagcgacaaaagcaaatgccatcagtgccatcgctgtgcccatcacaaaattaggcagcataaatccgccaatttcatacaatgaggcgccaaaaattggccctgagatttggccaacgccttcaaatgtttccaaaatactctaaaacaaattaaaaagcatttaaaaatttattattttaaattaatattttaaggagtgaaatttttattattaaatatttaattttcttacgcctatcaacgacacgtgttcaggaaaaagttcagctgaaagtgtgaaaatactcagcacaaaaaatgtccgaccaacagcttggaaaaaacggatgaccaaagaacacaaaaagaaagtcaaattgctgtgcaaaaaggtgagaaacctaaacacaaatttaaataaaaattaataaataattaaaaaaaataacacacccaaaacaaattgctgacccggacacaagaaaaagtgcggtgtaaaatgtaaattttgttccaatttttacaatctaaaaatggaatttattgtatgtatgtgcctttaaaaaattatatcatttacataatttccgataattggtgccatgaaaaatctgcttaattggtatatgccgatcactaggccaatatggcctcgatcaatgcctcgagaaatggcctaaaaatagaataattactcgcccaaatattttaatttattcaaaaaatattaattagacaataactatttacttctttggggtaaattgtttccatgcaattaattgtaattgtgttaatgaatgttgcggtcaaaaatacgctgaccaatgtcagttcatggccattaagcgaattgagcagtgatttggcatattggccatagcttttcattattagcataataatataattgtattttcaaattgatttctgccgtctgtccaaagaaagaatacaattaattaatgggacataattacttcttaaaatgaacgcctaattaggaataacattcacccaactgttcgccaatttatgaccttattaattaatgtcagtatcagccgcaccaaatctttttcattttaatgtgggcggatcccaaaaaagtaatcggatcacatttgaaacgatgttctcgagttatacaggggatggatgatggtaatgaagatggatcttgcaattaattttcgataattgattcatcaatcgctttgctactcatccgccgctctgatcataaaaggaacacatgtgatctgaggagcagccgaacagaaactatcaaaaagtttgtttttggattttgtgattaaaataaattatagtttgatgataattaggtacttttccgttttggggccaaagtttgattttttttttttaaatcagcagcgggcgcgaagaattttatattaatctccgctcccattgcataaatatccaaaaccttggcgcagaccccttcgaagagatcttagatcaaattgacgcatttatgcct

SEQ ID NO: 26361 - DNA, 964 bp, Heterodera glycines
tatatcatcatttaaataataaaaattaaaacaaaattatttaagctaaatacaaaacacattacaataaaacagcaaaaataattaaaagaaaaaatatataaataaattttaaatttgtgaaatggagtaaatatttttattataactttagacataccgtattttcaaaaaattttcactaataattagtcgaaaattaatccccccgtctacatttattccccatatctaataatccccccccccatctttctgaggaggttcaacaataattccgccgggggggggtgggataattagagatatacgttattataaaattttaaaaaaaagttaatcgattatttttttgatttttaacaaaattttaataactacaatgaattaaataaaatcttataaaaacaaaatagtgatgcgattcattacaaataaatagtactctccttgaattacttaaataaatttcattaaatataataattaactaaaaaatatttacaaactaaaaaatatttataacaaatattttttttaatttaataaataaaataaaacataaaatataattttagcaaaaaaatcacgcgatatttttatggttatatatttaatatcattaaaattactttatttaattattgaaaaagcctttttattataatttttaatatccttataatttatatatttttttattaaaaattatataaaaaataataatataatcattttatggcttccttttaattttgacattttcttttttttcatgacgaggccaattctatttatatcaacagttggtacatattttagtttttatttattttcataacattttttagcaagttaattttttcgttttcaacatgattttatttgaaaaaatgaaatatatttatattaggaatttattataaatttttttgcataattgaatcaaatgactattattctg

SEQ ID NO: 26362 - DNA, 1036 bp, Heterodera glycines
  misc_feature (1020)..(1021): n is a, c, g, or t
tttttaattttcaaaacaaatatatattgcgttaaaaaaatgcaaaaaatcaaaagaacagggttcataggatataaataaaattaaatatactattaaatataaatttctcaaaaacctaaaaaatatgtataaaaaattatttttgcatgcataaagcaagcagtttagtgaataaggttttttagtgaacatattctttgatctcttattatatactattatcattaaattaatatttatagtaattaattaatttttatatagaaaacaataaaaaaatatttattttctgcaatttacaaataaattcgacctttaacagtttataaatttaattcaaattaaatacattctaatttctattggctctggctaaatcaaacacagaaaaataaataaataataatgtagttgcattaaaatgttttttttgctaatgaaatattaaaaataataaattacttaattaataaaaatttaatttttgattaaatggaaaattattcatttaaaaaaaattaataatattactttgtaaaatgaaaagaaaaattctaaaaaaataatttagcaatattaatagatttattattataataatgttaaaattaaaattccctatccccgggaacatttttctttcttggttcatcaagaagcacaaatattaatacattttgataaaatccgggcactggttagaccatgctaagtccaaatatattctttatttgtaaaaaaatactattattattcattagttaaattgattgaaattcttaaacaaaaattatgttcgatcaaagcaagaactaaatgtaatgaatggaaagaatattgttattaattcaaaaatagatttcttttaaattaaagtaaaaatggcttcttagctgataataaagaaatacaaaattaataattttatttttaaagatttatttttaagttggcattgctttccttataatagaatgccataataatattaagaaaaattatttatttacaagaccnntgcaggcccatgcaa

SEQ ID NO: 26363 - DNA, 978 bp, Heterodera glycines
agccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctgacgcaaaagaaggcagatgacgcggaaaagccaccacattttgttgatccgcatgttccaacgaaggctcaggttgaggagacacagccacaccttgaattgaaggaaaagtcaatgaatgttgtggtagtcatcagttaaggagccacaccttgatctga

SEQ ID NO: 26364 - DNA, 2067 bp, Heterodera glycines
  misc_feature (2015)..(2015): n is a, c, g, or t
ttttgtattttttatgcctttttcacattttggtgcctttttaggtgcctatttgagaaattttcgtgcctaaaagtccggtctctaataattacacattgattcataaaatattttatgtgtccagcaaaataagaatattaattaggcggacagttcgtcagaaacttaacattcagtttgatcatataaagaactattttttaagtttaatatagccaatcttaggaaacgcaaaaaagttcgctctgaaaaaacccgcgaccgatactctcgagcatcactaattagtaccctcttgaagaactccagcgccgaagcttttaaagtgaggtcgagttttttgaaaaaatcaaaatttttgacaaacttcaccaaaaaggaaattataatcgaatgaattataagacagaaaagtttaataaaagcgaaaagataggtgaccattattagcgcaagtgtgaaagaaaattatgtggtgactttaattgttggtgacgtgaacaaccagcaatgctgctgctggtatttatagatagccgtcccgtccccgtggacgaggccgggggtggggctcgaactctaataaaatttacagatcctaacgattttacccaaaagcctcaaatcctaatttcaaaaaaaccatcattgacctataaaaaaaccacaaaatgaggataaatcctcagatctgtaatggtaaaaaattaaccaattacagattaacaaaaattatttctcaattaaacaaaggtttgattggtctttgacaattgatcactgatcagaagaaatttccgcggtcttccggcttcgtgtcgcagcattttcgcgcattgcaatggcaattggtcttcgccttataacaatagcaaatgtcgtccaaatgcatttgcttcccgcactttttacagacgaatttcgactccaacgccttaacgaaaatttaatggtaatttaatattagttttacaaaatagtcgtaagaatctggccgtaaatcttattggcaggtctgccaactgaaaattccaaaaaagctttgaaaattgaaaatcaaacccaaaaattcctaatttttaatagaattaaataatcgaaaattcaatttgatcataaagccaattaaacaaacacaaaattttagggtagccaagtttcttgtgaagaagtcggtgaacccatgaaatgaaagtgtacttttttgtaggccaacatcatgtcgtccagcgcataattcccggcgattttgaccaaatggttcagcaaagacaagtcagcttaatgaaaaatagcatatttaaaatcaattccaattaaataaaagcatatgaacttaatttttaaatttaaatcgtccgtgaccttttgttctgctccaaaggatggagcgacccacattactaatttaataattgatgagtgcgaatgatcaaaattaattaattcttttaaattgccatttttttttgctgcactcactccgtcccattgctccgcgtatctcagcaccacttttcgggagcatctgaatcagatcaacaatctcctgacagtcgcgctttttgagaaccacactgaacggctcgaacaccatgtccatttgatggtccttgggtttttgattatatacagtacagtgtcactattatgcccgctgtaaaatgctataccaaatgcccaatgacttggaaacatttaatatcgtaggaaatttttacaacgaattttcacttgcctcgtccatcatgctgctgctgttcccggagtggccaaggagcacatctttggcattcgtgatcagcttagataaaagaaatttcagttgatttttaaaatatttttgaatttagattaattgtttagttacagtaactcttgtcactggtcctaccataaataatttgtcgctgcattggttgtttttatccgggtgaatgacacggacaagctttcgatagttttcgctaatctcctcgggaagggcattttgacgcacgcaaagccattcntcctgactcttaagggcgataagcaaataaaataaaacgtaataaaagttca

SEQ ID NO: 26365 - DNA, 1608 bp, Heterodera glycines
acagagaaagggtgagaagaggcaacaaacagagaaaccgctagagagagagaggagagagagagagatagagagagggagagacaaacagagaagcagagacaaagagatagagaacgagagagaaaagacaaaaacgttttcgtcattcgcactcaccgtaaagagtggttacgcaccgaaacggcgttgttcgggatcagaacgtgtggcgacgatcgccaaagtttcgccccgtttcctcggcacagccaagcggtcacctaacaaaagatccgatggcttttctctctttgctccttcggccaacttttcgcttcgccttcctcagccgatgcttttgcctcagctgaatgtccaattcctctcggaaacgcatggcatccaaaagcgtctccaattcggcggatgaacgcgaacgactaatggaacggaccataagggcgaaaatgacgaaggaaaactgagggagagagggggaaagatcaatcggacgaacgaacggcggagggacggaccatcagcagaatggcgatggtgtacagctaaagtgatcggggttagcaaggagcaacgggacgaaggccatgatgatcagaccattcggccgacgtcggaatgaaagtccatcgaattgatcggccgaaactctgcctttgcttccaaaggccgacttctgacaaatgtatttgcccgatcaaaacattttgcatttccttccaaacccattaatagcacaaaatgactccaattttgccatacattggcaaacatttgctccaattttgtcgctttcgtttcttcgacttccattttggctcaaaaacgcatttttatgtgataatgataaaaacgttgttgataaattgtggaaagagccgaatagaaattgttttactgtgtcgttgttggaagagaaaagcttcatttggcaaattttgagaataaattttgaaagggagaagagaggagaacggcacactttcagggcaaacgaaggaaaagaaatcaatggacgagagataatgacagataatgaggtatttaggaggaggggggggggagagggaacgaggcagacgagggaatggcgggcggagaaacgatggcacggcacaccccccggggcgaactctgtagcatttgacaatgaagccaatagaaaatacaataattgaaaagcgaaggcagtaattaaaaaatgaaagaaaagaaaaaaaatgggttggcaaaattattagcgaattgaacaccaaaaatggcaaaaaattgcaaattggcacagcgggaaatttacaaagtgacagcaaaacaaatcaaacgaacgcaacatttatttaatttattttttaccgttcccaacaaaaaatcagagaaacaaacggccaaaagagagaaaagggacggcgacagcaaaagcaaaacccaaaaaaacattgagaaaagaaccaaagggcggcggatcggacaaataaaagcgatgccttttcaggtgccgaaatggcaggcgaaagagtgaataggcccattcacattgtgctccccccctcagcaaataaaaccttgcaaattgccatcaattaacaaaatgaaaaatggcaaatgctc

SEQ ID NO: 26366 - DNA, 1535 bp, Heterodera glycines
  misc_feature (1490)..(1490): n is a, c, g, or t
acgcacacgtggaccttccctctagggatgtggttcagcataggacctgctcctcggggattgtggttcggaaaaggacctgccccgtcgggtgattgtcgtccgaaaggtttacaaaggtttccttatcgttactggccaacatccggtgcgaagctggtcccgcactttgccaagaccagtggacttgtctaggtagcgaagctcccaaagcgcgaagcgctttttcccagctaaatagccgacggttcacgcacccgctagttactatatatgttatattgacaaggagtttcgttgctaaaaccattttctcccggccgaaggccgggagcgccctgaaagtagtggaagggtcttacaactttttgaggagcatccgggaaaaatataggttttcaggtccaagggccaactgagtaccagggactgatttctcattttttcgtgcgtttgacggcccctaactttttttgtaaaactcgaatcaaaaagtgcccgctgtgagggcactccaccaaagtgtcctctaaatgctggtattttttaaaattttttttgatcaaacccctggcctgcaaaaaatggcaactgaagcgtgctcaaaaagtacacttcagtaccaggtgaataccgcgccagggtttgatctgagcggggggtggccagcgaacttattgtagagctttggaagctcgattttttgaaattttaaaatttcgaaaattttcaaaatttttcaagttaggcctaaaaaacggttttcgggtttttgaattttatgattttttaacgaattttcccgggaaaacgaagaccacttccaaaacatagtttttcgagctctatcgattggtaatttttttggaaaaatttcgattttttcccggaaatagaaaaaattttcggcctcagcgggacatttgagtcctgggcccataactcgtcaggggttgattttagcgaaaaattgtcttagaacatttttgtagagcattttaaatgctatcgaatggtgtactacatgatgtaaaattttcaaacattttcgagctaggccccctagaaattttcaaaaatttttttggggtcgaaaaagggtgtgaaaaatatttttctgggctattttgatgtgctgagcacgaatatgatgtttatttttcgtttcaaaatttttggaattttttaaaaattctttattttttggcaattttttggcccttggaaatttgggctaatattggaaaattcatatctagcctaagggttgaccaattttgagcaaataaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattntattttacatttttatcacatttttaaaaaaagatataaaaataa

SEQ ID NO: 26367 - DNA, 1325 bp, Heterodera glycines
  misc_feature (58)..(58): n is a, c, g, or t
ctagggttaggcaaggggctatataaatgtcgtattggtattcagcgaccccgaaaanccctaaaatagacccattctccggctttttatgagttttttagacttttggacaattcgtgggtttttactcttttggacaattcgtggcttggacaattcgtggcttggacaattcgtggcttggacaatttgtgggtcagcgcatttttcatcgcaaatttcattcaaaatttgtgaaattttcccggcaccgccgtaccctcctccaagttcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttacttggttaagaattaaaaaatttagcctattaaaatatttagaaatttttttattatattgtatattttttgaaaaatttccgatttcttgcaccgcaaaaaagtgggtttgaaaagaaaaaaatagtcaaatttatgaaccgttaataatttgatttccgatcaactttttaccgtcggatccaatcgaaaaatcttagtcgacccatcagccccttttaatgcatcccgccagctgctaaaaatttatttttcagcattttttgatttttggaaatttattgaatttaattgaaattttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctagtgtaaagtaagaataacccaaaaattttcaaatgaatttcctgtcaaagtcaaatcaggagtcccacaagggtcggttttaggacctattttatttttaatttacattaatgacttacctgaaaaaattccaaaagaaatctcaattaaactttttgcagatgatacaaaaatttatcattgctattcaaatgaatcccaacgtaaagttttagaaacagccctaatttcagtcttttactgggctgaaacatggggcttaaatttttcagtaaaaaatcttccgtcttatatttaggtaaaaataacaaaaaaaataccgtacacaattaaaaatgcaactattcctgaatcaaaaattatccgtgatttaggcattctaatcgataacaaactcaaattcgacggacatgtttcaataattctccaaaaa

SEQ ID NO: 26368 - DNA, 1090 bp, Heterodera glycines
  misc_feature (17)..(17): n is a, c, g, or t
  misc_feature (104)..(104): n is a, c, g, or t
aaaatatgaaaaaaatngtaacttaaattaaaaaattttaaacgcattaaattattactattaattacactacatttaatattcgtttttaaaattcagatttntacatttactcaattccttgatataatgattactggattttgtgcgcgaaacattctaattcttgcgaggtcagccaagtactttgtgaccgtaaaatggttaatgaaattagtttgcacttcaaaaaaatgaggtttgctcctgtcacaaaaaaaaacgtaatttttaaaatatatcgtaaaaaaaaaaaatgttcatgaaggattgttttagagaatatccgctattgcatgtactataacacaagtctgtatgatagcttttagtaaagttattacgggttttatttgacagagatcaaaaataacaacatttcgaccccccttggagtaaccccctgtctggaaatgtcttcctgatcatttttgtagagttcgaacaatgttcgacttttcgaccttttgttcgaactttttattttcaataacccagggctcccagtcactgtacaaacatttaaagtctcttttgaggtcttacaagtgctctgtgagcgaaaataacaaatgaaatttgttcgaactccaaaaagtgggtctaaacgtcgttttggagcaaaaataacaacatttcgaccccccttggagtaaccccctgtctggaaatgtcttcctgatcatttttgtagagttcgaacaatgttcgacttttcgaccttttgttcgaactttttattttcaataacccagggctcccagtcactgtacaaacatttaaagtctcttttgaggtcttacaagtgctctgtgagcgaaaataacaaatgaaatttgttcgaactccaaaaagtgggtctaaacgtcgttttggagcaaaaataacaacatttcgaccccccttggagtaaccccctgtctggaaatgtcttcctgatcatttttgtagagttcgaacaatgttcgacttttcgacattttgttcgaactcgttattttggtctgaaaagggttcccagtcattgcgcaagtatttatgacgctttatt

SEQ ID NO: 26369 - DNA, 1339 bp, Heterodera glycines
tcactcttttttctctcccactcacttctctttctctcccactcactcctctttctctcccactctctcctctttctcctcccctcactcctttttctctcccactaacttctcttcctcctcctaccattcctttttccctctaactcactcttcttcctcctcttccgccacactttcctcggccccatcctcctcctcttcctcctctttactactttcttttccattgttctcattttcctttgcctccattggatgaaaccgttttgaaactgatttgatgtcaatattttcctgcaattaaattaaatttaataattttaaaatattttattaatttcttctttgatcccaccgaatttcccccctcttcgcaatggcgtcgctttgttccgccgacagttcgttgttgttgctgctgctgctgttgttgttgaactgttagtccaagttggtgctgaagatgaggaaacatttgaatggaataagcagaaaaaatcaattgctaaattaattttaaaagagtgttaattttattattaacaatttgcgtgcatttttaatcctcacaattaaaaattaaacatttaatggataaattgaacaaatcaaaggcgaagggtgattgcagagaaatgttaagtagtgacatgaaagtgtgattggctgacgaatggttgagaataaaaatttgaaaggggagaaaagtgccgaactgacaaatgaggggacaaattgatggaaaatgggaaagggaaggcacaaacaaacaaaaagaccgaattagggatgtaagttgtgtgggctaaaaatgccaaatatgggcttaaaatatacactaaaaacttcaccaaaccatacgcataaatgttaattttcagctttgcaaaaaaatatgtaagctctaatcggtcggcactttctcgtcctttattcgactcgatgttcgagaagtagcggagggagggcattcatttgatttgacaatttgacaaatattctatcattcgaaagctgttcatgaagcaaaactaattgttgctaccaatttcaccaaaaaaagagaaaataaagaaaataagttacaatcagcaacaatgagctcaaaaaagccttaattttttataataatttaatttactataattttggagatttagttcctatccctccccttcctgtaccccctccccccccccgttaccgttcctgcagatacccatcataatttgatatttatgtttatttattaaacaattaatctttttcaattaatttgtttgtgttttcgtttttaccaaaggcaaagttaaaaaattggattatttcaccgttt

SEQ ID NO: 26370 - DNA, 1730 bp, Heterodera glycines
  misc_feature (1560)..(1560): n is a, c, g, or t
  misc_feature (1676)..(1676): n is a, c, g, or t
  misc_feature (1706)..(1707): n is a, c, g, or t
acgaaacaaattacccttcaattgaaagggaggctttggcattaatttatgcagttaaggaattctcgccatatatcgttgggtctggggttacaaaagtaataacggattgtagtgccttaacaggcatgatgaaagcgaaggagttaaaagggagacttgagaaatatcaagtaactctccaaagtttcgaattagaaattatttatcggcctggaaaaaagaataaagtggcagattttttgtctcgatataatataccgggaaatgaaaaagattgtgaaccaaaactggaagaaaattcagatgaatttgaatttcagccaaaaattttaagtgcaaaaaatattaatgaaaatttgattgccaaaaatgatggaattttgaatgaaaatccgagaataaccttaaaacagtgattgaggcacaaacaaaggtaaaggaattggccaaaattttctacattttaaaaaccggaaagtgtccaagtgatgttctgaaatggaaaagagttgtttctgattatagcttgataaatggagccatttatttcgtaaaaggcaaagaaaacatggagaaacctaaattaataatccctcattctttaagacaaaaactttttcttattttccattcagagggccattttggattcgaaaaaacttggcacgaaattaaagaacgattttattggatcggaatgaaagaagacgtgaaaatgctaatcgaagcatgtgaaaagtgccaaatgaggaaaattcagacaggccaggccaaatcggctccgagtgtcccacttgaaccatcaaatggcccatttcaaagaattcattgcgacttaatgggtcctttaaagaaaactgaaaaaggaaacttgtatattttcttggcgattgatagtttttaaaaatgggttatggccaaagcaatcccggatcagaaagcgaatactgtatcagaaatttttgttgaaattgtggtccatcaacattcaactcctgagattgttgtgactgatcagggaagacagttcacttcgggaattttaatgatttggcaaaaatatatggttttgagcatgtcactacaacaccatatcatcagcagtctaatggaatagctgaaggggctatgcgaatcatggctaatattatttctcaaatagtcaatgaaaaagggaataattgggatgaaattctgccgcacgctattttttcatacaatgtttcaatacatgcagctacaaaattttcgccattttttatcattaatttacgacagccaaaattgccaactgatcggttacttaaactcccatcccccgatgagcttgtgtccgatatttcggtctatacaagaattcagactgaaaaagcagctaaagcgtgggaaattgtgcgaaatgaaattttaaaagcgcaggaaaggaacaaagaagagaatgatcgcataaagaaagcgaatgaaagagaatttgaaattggtgatttagtgttgtttaaaaaagaagttttgggccataaatttgatcagcgttggctgggaccaatgcgttgttgntgggggttgaaaaagaaaagaaaaatgttgttttacagtcaattgatggaagcgctaaattaagaaaagtacatcaagaaaaagtgaaacattttaatggaccagcaattcttccntctaggcagtcagacgaaccattaaattgnngaaagtacgtagatgatccgaat

SEQ ID NO: 26371 - DNA, 1172 bp, Heterodera glycines
ttttacatttattcgatcaaaaatgtatcaaatattatatttttcacctcccatgattatcttttacaatttttggggagaaaaatagcaaatttagtgcaatttttattaaaaaaaaataaaatttttaacaaattttttacggcgcatttttccaagaaattttggagaacgggggaggggagtgggtccggcggtgccgataggcgccgtcggaaaaatttttgttatttctttgatttgttaacagattttcatcaaaaattatcaatttatgcgattttgagacaattggcgaccatttttacattcaaaaggctttttttgcgacatttttaaaaaaattttggaggttggacagtataattattagagtggtaaataatgagttcgattcgaatctataaaaaaatgttttcttttaatagtaaaaaatgcactaaatcttttgaggtgctaaaaaaaactttcatcgctaaaaatgtcaatgtaattgattgttgctaaactttatgatatttccaaattaaaatgattgtatgatgtcactctatgatgaatactagcgggtgcgtgaaccgtcggatctgggcttgggataaagcgcttcgcgcttcttgagcttcgctacctaggctgtgaagcgattcaaattgatcgaattggttggagtgatttttttgaatttttaaaaaattattaggggtttttagtccacatcgaggctcaagacgggcgcttcgcgcccgttttttagcttgttaggccgcttcgcggcctcagtcgggctcttcgcgcccgtttttcaaattttgttgggcttggacgggcgcttcgcgcacgttgtttaattttgtagaggccaaacgggcgcttcgcgcccgtatttaaatgttgttgagctcagacgaggtacaaaaattgttggaagatgtgttagaagaggtacaacagtgatcagaagagttacaacagtgattagaagaggtaaaacagtgactaaaagaggtaaacagtgattagaagaggtacaacagtgatcagaagaggtacaactgtgattaaaagaggtacaactgtgattaggagaggtacaatggtgattaaaagtgctacaacagtgatcagaaaaggaacaacggtgattagaagaggtacacctagtgattaga

SEQ ID NO: 26372 - DNA, 1002 bp, Heterodera glycines
  misc_feature (933)..(933): n is a, c, g, or t
  misc_feature (960)..(960): n is a, c, g, or t
  misc_feature (967)..(967): n is a, c, g, or t
aaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcacacaattaagggggagcaaaaatccaacgcagaattaaagtacaggctatagtgaagcttatccggnaaaggatcagtctccccataaatctgngcgcatncggttcagggggactggccccgaaaaccaaaaaaa

SEQ ID NO: 26373 - DNA, 1560 bp, Heterodera glycines
ccccccccccccccattcgccgcccatgcaaagcccacccccaaggattttgggcgctctcgtgcatacctctaatacagagatatttatttgcattttgaatacataaaaaaggaaacgaggttgttagggcacatagccgggaggacaaaattttgccttttgggcaacagcgatgactcaccaccacatgaccaaccattcattggcattcattagccgccgcctgggacaatggcacaaacgaaacggagtggattttaacgcgaaatgcattcggagaatgctcttagagtaaatttcttaaaagcagaaagggactcgaaattatgagttttgtcccgacactcatactccaaacttgacaattgggtgaataaattcgagaactttttcttattaatcgacacctcgagactgagaatttgtggtaaaaattgaaattatgaagtccaagaaattgttcagaacatttaacatctttgcaaacagcaaaagctaggtgcaagaaattttgaaaaacaaaaaaaaactaaaattaaattttaacactaacaaaaaaaagttttaaaaatttctgaaatcaaaaacacggattccaaattaagatatgatggccctgctggtatacctaatcaagccgttttgtcctatcctgcacctttttctttcacgctttttctcgggcattccccgatgaatccacgcataaatttcccgtttcattttattcgttgcatcgatttgcctctgcttcagaacaacaggaggcaaatccacaccaatcttctgggttggattaattagcagcatagatcggtatccgattcaaatcccaatatttacacctctccccccccattttgccctcgggggttgaaaaacggccggcggatttgaatttgtggaataatttagtcgattttatctgatcaatgcaaagagaagagaatgcaagaaatgagtgagtgacccaaaattgggaggaaaattggaataaaaattgtggaggggcattcagagaaatttagggaggcggaggaaggactgagaagggcgaccacgcggaggcggaggaggacgaattggaatcggcggaatgtgctgctgcgacgtctaccgctgctgtgggcagaatttcgcagcggaaggacgccgcggggttgggcgcgaacggggcacagcagcagcggcacagccggacgccattttcactgaacggaggcgggggaaatgatgggagaaggactaggcggaggacaaaagtgacaaaaattgacagtgacaaattggcgaaatgaattaaaaattgattaaatttgttgcaaaaattggacggaagaatgggggggggggtagagttgaggtcgagctatattgcttgggcttaagcttatactttatttgaaacttcaaaatttaaaaaaagttcaaactactctggctaatgctttatttaataagggaattttaattattttattagaaatcaaaaaagttttgagaagaatgggcaaaggtgccgtttttgtgatttctgcgaaaaaaattaaaaaattt

SEQ ID NO: 26374 - DNA, 2003 bp, Heterodera glycines
tatgttagcacatatttgggggtttggcacatattttgcacatattttggcatttttgagaaaaattgcaataaaaatacaagaaaattgaaaaatacacccctaaaaatcgacttttttcctaattattaacataattttcaaattaaaaaattttttattcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccggtctctactcattaccctcctctaaaactgtcagatgccccgggcaaaattagaaaatgaactaggcaaatgctgtaagctagctggatttgtaattgaattcaaattcatgcgagtcagccgattagccgccggagaatttgtgaagttgaatctgcgcgtcgataagtcagactgatcgctatcttcatgttcatttttccttttccttctccatttcttaacaccctgccacctcccccccctcctcctgcttcggctatcgccaattatggaattctgcttccagctaagggttctgctcccttactcatttgagccggttaaatatttgaattaagtaattaattatgtcaggcagacacataattaaatgaatgttgcgagtttgccggtgccaactggccatgccgattaccatcttaggaattaacttgttgcgattgctaaggtgtgacagcgaaaaatagcgaataaatatgcaaatgaaaaatgggatttagaaaaatgtggcaattagccagacgactacaacattgtaatgagtataaaatggtctaataatttcagtcaaattaagcatcaaaattgcattttctgatcagtttttatcagtctaattaaacaatttttaatggtaacccggtcatttacgccgccctcctttcctcgatcatttcggagcacctctgccgatcaaaccaaatcaaaaaatcatgccgagctgagcaagttgcggcaactgtatctcagagtgcacgatgctaggggagggcggcggatcgaaacaacgccacatcccaagatttttggcaaagggcatcgatttcctttaggttatttaaggtgtggaagaacttccacaaaatttgcacaaggtagtgccacgggaaccggtcgggggcagatgggcttggtcggtgggtcggggtcgaataggcgaacacacacacacacacacacacacacacacacacaattaagtaatgtttattcggggacctcaaacttgggtaattaaaccgatatttaaatgtgaacaatacaaaaaataaaaatgaaatgcgccatcaccggggggacaaataatcacaatcacagaaagaggggccgtcggggggataatcacagaaatgcgggattcaccgggaaaatccaagggggacaaatgttgggccaggagaagtgcaaaaaggtggaaagagagaaagggaccaggaaaagaaatggtcaaaagtggtccgaggatgggcaaagggagaaagagagatagagtgtgtgagagcgggcaaagggataggcattgattgcctgtaaaagcgaaatgaatgtgaattgggaatgatttgggagtgatttgggggccatttaaatatggaatagggaaagagataaaaaatggggccaaaaagtgaaattgttaaatttacaattaaaatgggccgatcactacaaattgggggagcagaagtactttggagggggcaaaattggcgaacaaacgat

SEQ ID NO: 26375 - DNA, 1760 bp, Heterodera glycines
gaaaattttttaatgtaagataaaatttaatcgtatcaggcatttggcattattatgtgttttattgattttataaaaaaaaatcagtaaaagacataaaatgtcaaatgtctgatttgatggttttttgactaacgcccattatgatggtttttgactaaagtcccaacaccatttgaaacatatcaaaaggaaactaaaaaagaaattttgtaaaaattgaaaaatatgtacatagatttgtacaaaaaaggaggaattatatatgaaaaattatataaaattgaactaattgtgccaaaatatgtggaaattgtttttttctttttttttaaatttttataagaaattctaaaagttctaaaaaccataatttatcggggaaattttaattataagtttggttgcacaattgtaaatcaaacacatttcgtgcttttcaggcgttaaaatattttaattgtttatcctcctaatcattgccagggcttttactttttgaaaaatcgattgttcgggggtggggtgtattatttgaaattaagtagtttcttagagttgcattttattttattgcatttttcaaaataattttttattcccaaagtgaaattgcaagttctcgagcaaatcacaacttaattaaaaaatattaggagaagtttcaaataaaaaaataaaaaataatctttaaatcattaaaaattgtgaaaacaaattggtttcaagcattttttgattttgagaacgacataaaattttagaattttattgtaaaaaaaatttttaatgtttgtatttgattttgattttttttcgtattttatttttcgattttcaacaaccctgttttatagccattagttttgcctgagcgcatcagtatgtcacagaaattatatgaataattctgtcgaattggttttgtgtatttatgaatagataaaatttcgtttttctttttttgttttagttacattttttagtattttattttaacgattcgcagcaacaacccttatatgtaaagaccggctttttagggttttgcctattttttgcgggtagtacttgatgagagaagcacgaaaatcagattttaaaaaattatttcacttttgtaatttttgtgtataaagacactgcgatttttccaatttttagcacctttttgggatgggcgcttttagcacctaggcattttagtatctgttttgcactttttggcacctaaattttagtacgctgtttcagaatttttggcacctaaaagatccggtctctacttatatgtaacacttttttattctattacttttatttatttagttaattatttgcaatgcaatcagcttcttttgctgcttatttaatcatcgttattatagttcatttttatactccaattttaaatgcaacgccatcggagagttaaatgatacgatgattaattaataatcaaatttagttaggtggactataacatgttaattgcttttatgagaggccatcagcaaggtcaattcagtgaatattcatcgcacaaatttgaagcacaccttggcattgtgcattttaacataaagaatttgcaatgtgactcaatttcggagatatttgaagaatatgagcgacggagaatgccaaacatatcacaaaatatttgaacattctgtacgaatatttgttcatagaatacgtcggcgaagtgcctacagtggagctctaatttgtgttacaagagacatattggaaattga

SEQ ID NO: 26376 - DNA, 1014 bp, Heterodera glycines
tcctttttctgggaaaaacttttcgtgaaacgtcgaaaaattttccactcgcatcagaagcagactcaaattcttcaacacacaatataaaaatattacgcaagaacttatttttacatcctttttagaaatgctacataaatttttattgtaaatagttacaaacaaactttttttcacttccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaataccaaagattaaaaaattcttgtttatgccccactctgctttggctggccatacctcgccagagagtggagatagaccctttgttgatacatttggaaatgtcgagcccgcctagcgcattcgaataacacaaaatttgtttgcatttgccaccaaacaatccgcttatgacgcgccgaatgaaaattcacaaaaatttggcaccggaaaaactgcattttttcatgggccagcataataaagtaaacccaaaatgtaaggaaatttaaattggtcatgagagatgtttagttttttatttgtcccatcctttttctgggaaaaaacttttcgagaaaagctgaaaaattttccacttgcatcagaagcagactcaaattcttcaacacacaatataaaaatattacgcaagaacttatttttacatcctttttagaaatgctacataaatttttattgtaaatagttacaaacaaactttttttcactgccaatttctaccagttgccaaacaaaaaggcgatagttaagcattgagatataaaaaaatcgtctagaataattatctcaacaatttgtcgggaaagctgaataaatttctgttgcaataggcatattggcacaagacataaatgtagagcaggcacaaaatagaggaaat

SEQ ID NO: 26377 - DNA, 1079 bp, Heterodera glycines
catcaattattttttcagaatgtgatcagggtacaaaaaatacgggtccataaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccataaatgggtgtaactccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtacaaaaatgggtgtaactccgcttggagatgcgttagaaaagaaagaaaaatatgttcggacagcttttgaagagctgcattgaatgctgcagttgccgctgctgtacgcccaccagttgctgagttagggtcgagagcggcagaaaaaagacaaa

SEQ ID NO: 26378 - DNA, 1441 bp, Heterodera glycines
aaaagtcagattttcgaaaaattttaaaaacaacaagcgttggcattttttcaggttaagttagtcctttacaatggagaaggcctgcaaaatttggaaagattatatcgattttagtgcgctaagttcgatgaaactttttaaaatataagcctaaactttttggcctgtttaaaaaggaattaaacatttttaaaatatttattcatctcccttttgatagaaaagcatcagagtgccttaattaattttttttaaataaaaaaatttgactagaccaatcgaaagctaacggtcgacctaatggaaaaaaatccccgaaggagagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcctgtttaaaaaggaattaaaaatttttaaaaattttattcatctcccttttgatagaaaaagcatcagagagccttatttaacttttaattaacatttggtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaacttttaaaatataagcctaaactttttggcttatttaaaaagcaattaaaaatttttaaaaattttattcatatcccttttgatagaaaaagcatcagagagccttgattaacttttaaataaaatttggtgcgtttcagagcactttctaaaaaatacttatgaattaattttgcaaaataataaataattaatgaaaaagtcagaatttcgaaaaattttaaaaacaacaagcgttggcattttttcaggtaaagttagtcctttacaatggagaaggcctgcaaaatttgg

SEQ ID NO: 26379 - DNA, 2078 bp, Heterodera glycines
ggcaccgccggaccctctctcctcgcccattcaccaaaagtttttttgggaaatgcgccgcaaaaaattgttaaaaatctgattttttgtttgagtaaaaacctaagaatctgtgtcctactgatgaattgggggttgaatgtttttttttcttcaaaaaatggattaaaaaattgccgggtttttacaaaattttgcccgaattatgtgtttttgccacagttaggagtgtaaatatttttgctttttccgtccaaattattttctactaaacgaaagcgaaacgaaattgctgacatctatgagaccggcagtgcaaaagattgttcactgttttccatttttttcgtcagttccaattcggcagtgaatattttcgtcagtggattcataaaattataatgtgcttcatttttggttaaactatttaatacagtatttatcgctttttgcgtatggtacttctaagcaaaataaaatgattaattgtgctttaataaatgatttacataaaaagaaattgtactttaaaactgttgaatattattagtaaatttacttctccaacttcttatctcgccatccttcccatgcgttctcgagtgcctatttgcatatttgcttagtccttatctagtttttgcaatgcatttggcacttggactttcacgcacgaataacagcgttgaaggctggcatgcaatttggaatgcccatcttaaaggaaatcagcgactcagcggttttgtccggaaaatgattgaagatgatatgcggtcccagcgaattattgattatcagattgcgcctgctgatggaataagggggccacacgcaaatgggaaaatgataatggcctgggaaatctcgggaaggaatttgcggagaaaagatccgaggccaaaggggaagttatcggaaatccacttttcaatatctcagatctttgcataaacgacttatgcgcaatgattttggaaacagggattatccagataaccaaaaggaaaaattctaaggcagatctcggcatcatgatcatacatatactctttgcttggagaagaaagattggaattattcggctgtccatgaagactttttgccacatttgctcccatgaccactgtgaaaagcattttcttctttttataatgatataaataaaattatttatttttttgaaaatgtgtatgtcctcaaaagtcgtgtccccaattgtcgggatcctcaaatgtcaaatcctcaaaagtcgtgtccccaattgtcgggatcctcaaatgtcaaatcctcaaaagtcgtgtccccaattgtcgggatcctcaaatgtcgggtcctcaattgtcgggatcctcaaatgtcgggatcctcaaatgtcgggtcctcaattgtcgggatcctcaaatgtcgggtcctcaaatgtcgggatcctcaaatgtcgggtagccacgctttcgccggtttgggcccccttccacagaactctcagaatttcatgcacatgcaaagaaagacagccacccttttttttgtttggctttacatttgtcaattcttcatttttacatattttattattagataatgattatggaggatcaatttattacttggagtaaaagcatgtgattaattgccatgaatttttgagggcattgccatccatatgcacatgtcagcattttgggaaagtaatttaatagaaaagcatttatatgtttataaagaaattttttattattttaaataaatatttattatataattttatttaaatatttatataattgcttttgatgttttgcatttttctaattccacttttattcctcaattttaagctcataatggcatttttgcctcttttctcgcgccacttttttccaaattattcctttttgcttttgttcgccactgtttccatcggtttggtgccctccggcgccgttgttcaaactttttggaagaatttgtttcagaatgaactccctcaaagtgaccgatcggcccaaaatttccagctggtttgccgaattggacgagggcgatttcgtgctaaccgaccgcatgtccgcagt

SEQ ID NO: 26380 - DNA, 1155 bp, Heterodera glycines
gctgcttctgatgcgattgaaaatttttcagcttttctttaaaagttttttcccagaatttatacagctttcccgacaaattgtttagataattattctagacgatttttttatatctcagtgcttaactattgcctttttgtatgataactggtagatattgggagtgaaaaaaagtttgtttgtgactatttacaataaaaatttatgcagcatttctaaaaaggatgtaaaaataaaatcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaaatggagtttttccggtgccaaatttttgtgaattttctttcggccttgggggcaaatgaaaacaaattttgtgttatttgaatgcgctagccgatctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagtaaaaaaaagtttttttgtgactatttacaataaaaatttatgcagcatttctaaaaaggatgtaaaaataatttcttgcgtaatattttttacattatgttgttgaagaatttgaggctgcttctgatgcgattgaaaatttttcagcttttcttgaaaagttttttcccagaatttaaattttgattttttttttacttgaatcattttaatatttaagagtggtttagggcctttttttttttgattttttttttaaattttttttttgaaagattttttgataattttttttttaattttaaaaaaattggtttatattccagttcttttttttcttt

SEQ ID NO: 26381 - DNA, 1084 bp, Heterodera glycines
tgagcggtgaggaccgcaaatttggcacttttttccccgtagtgatttgttccagtcgccgttgataatgcagtcggtgcagatgatggtagccgctgcaaagttaacttcatgctcgaaccggttctccaccttcttgtcctgtgtcgcctcaaagtcgtatgcgatgatcctgtatgacttaattcgttgttgttttaggggctggatgaaacatttcgtacaggggttcatcccgtcgtcgtcgtcttcttttatatgaaattgcttgcaaagtttacaaaactgttccccacatttatgcccaacactcccatgaaccttaatgttataaattaccccacaatcttcgcagcgctgaaatttggtgcacaaatccttgtggaggtggcgctcataacagctgttgttgtaaaaggtgttgttacagtgatcacattttttgacgtatccttgttggggctcacatgaatagtcgactcccacctcacggcacccgtgacagagtgaagagcagtttgatgaatgtgcgattttcttgtagtacggcgactcgcaggagaggcagtagttctttttgttgaaaaattttgaaagagttttgatgccgtcaaagtggttgttgttgtggtagagaagaatgggaaactggtagtcggtgatatcggatttggtgattgggcgcatctggtaatcattaaaaataaatattttgtactcaccgggatacttgacgttccacaacccttgcacttgatgaatgtatacttctgcatcgtattctgtttccgttgtcgggatacccgcctcgcggagcagttgctgcaccttttgtcgtaaaaccgttgtttggttgttgttaatccatcgccatctattttcggtaattatcccacgtttatacaaagagtagtagcgcatcagttccagcgcgtaaaaaagacagtagttgtcgttgttgttgactttgaaaatgtgcgattgtgaggagacaggtggtcgcccttttccctttgttgtccgttgtcgcggtagtccattggtgtttaggacagtgacgggaattataaagggagcaccatat

SEQ ID NO: 26382 - DNA, 892 bp, Heterodera glycines
tcctatataaagagagcattttccacttccagtgctcactttcacctgaaaagcctggatttccggcggagggtgggtgagccacgggtggttagtcccttcccccccccccgttctgtgtcgccgaggacgaagatgctcgacgccgctgccaccacactatgggtagagaaacagagagagagagagcgagagagagagagtgaagacacaatgtgtgttagagaaaagtttttttggacttggaaatttttttcctctataaagtgtaagagaaagagagagagagcgagagagagagagagtgaagacacaatgtgtgttagagaaaagtttttttggacttggaaatttttttcctctataaagtgtaagagaaagagagagagagcgagagagagagagagtgaagacacaatgtgtgttagagaaaagtttttttggacttggaaatttttttcctctataaagtgtaagagaaagagagagagagcgagagagagagagagtgaagacacaatgtgtgttagagaaaaacctctaaagacagaccctgtctctagaggtacctatcccctctgcaaaagagaggaaaggcgcacgcacagcctccgccggaactccaggctttccagctgtgcgtgactaactgagcagactgaacaaaataaaatatataaaaagaaaaaataaaatttaattttacttaaaatacttaaattttacttaaaatacttaaattttaacaccaccgagagttgtacccacagccgtgtgtgccaatgggacgtcaatggacgccaattggacttatttggtcagctgtgggaatgccttaaccgacgggtggcatcgcgtcaattccacctaataggcgttcgtcggctacagc

SEQ ID NO: 26383 - DNA, 960 bp, Heterodera glycines
acgcagccacgcccttggcttttattcctacggacatcactcgctagtccatcactaagcattaggaaattgttggatgggacgcagccacgccttggcttttattcctacggacaccactcgctagtccatcactaagcattaggaaattgttggatgggacgcagccacgccttggcttttattcctacggacatcactcgctagtccatcactaagcattaggaaattgttggatgggacgcagccacgccttggcttttattcctacggacatcactcgctagtccatcactaagcattaggaaattgttggatgggacgcagccacgccttggcttttattcctacggacaccactcgctagtccaccactaagcactaggaaattgttggatgggacgcagccacgccttggcttttattcctacggacatcactcgctagtccatcactaagcattaggaaattgttggatgggacgcagccacgccttggcttttattcctacggacatcactcgctagtccatcactaagcactaggaaattgttggacgggacgcagccacgccttggcttttattcctacggacaccactcgctagtccatcactaagcactaggaaatagttggatgggacgcagccacgccttggcttttattactacggacaccactcgctagtccatcactaagcactaggaaattgttggacgggacgcagccacgccttggcttttattcctacggacaccactcgctagtccatcactaagcactaggaaattgttggacgggacgcagccacgccttggcttttattcctacggacaccactcgctagtccatcactaagcactatggaatagttggacgggacgcagccacgccttggcttttattactacggacacctctcgctagtccatcactaagcactaggaaattgttggacgg

SEQ ID NO: 26384 - DNA, 1767 bp, Heterodera glycines
  misc_feature (1707)..(1707): n is a, c, g, or t
catatgccgggaaattttcaaaatttttcgagctaggccccctagaaatgttcgaaaatttttttcggacgaaaatgggggtgaaaaatatttttctggggtaaaataaggtgctgagtacgaatatgatgtctattttaagtttcataatttttggaattttttaaaaattctttattttttggcaattttttggccctcgggattttggcctaatatttgaaaattcataacaaatcgaagggtggatcaattttcgtgcaattatattataaaaatagagaaaaatcaggagaattttatgggatttatttgggatttctatcttaaaaagaaaacaagttattccagaatttctgaaaattttcgatttttcagaaaaaaattcataacccccttctgaaaagaaatttttgaaaattaaaatactacaaaaatccgcaatttttttctttataatataaattttattttacatttttatcactttcttacgaattgttacaaaaataaaaccgattttgggattatggaccaaaggggtgagcataggatttttgagttgaaaaattttttcaccaaaaatcttcaaaaaatatgtctttaggggttatttgggcccctgatcacgaatacgtaatcagattttacttttgacatgtttaagacctcagaatccctgtgtgattgggattctgaggcacccttatgaggagggggggggggggcggcaggttcggacccggacggtatattatttttctatgcatttttgggttattttcactgtttataattaatttgaagatttgttttaaattatttaaatttatttttttttttaattttagaaattattttttgttttattattattaacaaaattattttaattaaatttaatttttcttttgaaaaatagatttatttttaagcaaaattagatttaaaaatttggatgcataataattcatttcaaaataaagtaaaataaattattccgtttattaattaaaaaataaacttttacattttttattattttgtttttttaaaatttttaaataaacctaattctataaaattatatttaaaattatgaaattatttttgtacatctcataacaagttagacttttgtacctcttctaatcacttttgtacctcttctaatcacttttgtacctcttttatcacttttgtacctcttctaatcacttttgttcaaattttaatcactgttgtacctcttttaatcactgttgtacctcttctaatcattttgtacctcttctaatcacttttgtacctcttctaattactgttgtacctcttctaatcacttttgtacctcctctaatcacttttgtacctcttctaatcacttttgtacctcttctaatcacttttgtacctcttctaatcacagttgtacctcttctgatcacttttgttcaaattttaatcactgttgtacctcttttaatcactgttgtacctcttctaatcacagttgtacctcttctaatcacagttgtacctcttctgatcactgttgtacctcttctgatcactgttgtacctcttctgatcactgttgtacctcttttatcacttttgtacctctttctgaggccgcgaagcggccgaaaaggcccaactaatttttaaaaacgggcgcgaagcgcccgtctgagcttaacaatnttaaaaacaggcgcgaagcgcccgttagagcaaaacaaattttgaaaaacggcgcgaagc

SEQ ID NO: 26385 - DNA, 857 bp, Heterodera glycines
tttaggacaattttctatctcgtaaccccgatgttaatccgttccgcagagcctcttcaaaattttttccattaccgcaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccttaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccgtaagagctgcggaaattgtgaattaattctcagaaaaatggctatctctttttaggacaattttctatctcgtaaccccgatgctaatccgttccggagagcctcttcaaaattttttccattaccctaagagctgcggaaattgtgaattaattctcagaaaaatggctatctctttttaggacaattttctatctcgtaaccccgatgctaatccgttccggagagcctcttcaaaattttttccattaccgtaagagctgcggaaattgt

SEQ ID NO: 26386 - DNA, 1322 bp, Heterodera glycines
aaaaacaatatcatgtgcccaaacgtccccctgcgaaaatttgaaccctatttttgcattttaaataactccacggaaacataaatttttgccaagaaatttttatacccaaaaataataagacaaataaatgtaagacaaataaatacggacaaatgccatgaaaatttagaaaatttaaataacaaatgctatacttaaaatgctctttcccacaaatatgtaagcaacaacaccaaaatggtggaaggaattcttcgccatcactggccgtatcagctaaattaaatttaaaaaaagattatggttaagatctctataattattactttctgactccataaccataattactttacccattagattcgtttccatgtgtttgttgtatctgttgggcattcatttttctacgcgttggagtatggggattaccacctttagttttgtctagaatttcaagaagttttgactaatgaatataaattttattacctttttgtttttttagcgctgacttaggtttgtttctttcatcattatcagaatggcaatgaacgcctgcagcacagaaactcaacaaaacgaaaaggaacaacacaattttgtgtacgttcatgataggaggaggagaagcgttttctaaaaaaataattaaataattattctaatcccaaaaaaaaattggctaaaaagtggtttcactagagaccggaaatttcaaatttgcgtatcccgctgttttaaatgtcggacggtttagtcctgttgaaggtggacacttcagtaccgggtttttcatgatggaaaatggtaggcgcacccctaattttcgagattttgtgaaattttgattttgtggaaacagattaatattttgaaagaagtgaaggaatatgtaggctgctggtccatagaggctcttaaatagcaaaagccgagacattgccaaccatcggcgaattaatccattcctaaacaaatttttatgaaaataataacaaataaaaatttatttgcactttttcgtttgtgtgcactttatcatatggcgccaattcaatgccaatgagaaggcatgagaatggcacacgacaaaaaatttattcaaaatcaatgtcataggatggcataaagaaaattctgtcggtgatttgggtttttcttttttcaattgtacatatttgtgaattacaaatagaaaaatacattacccattgtacgaattcgctgagatttgcataatccgaaaatttagtaagttttgaagcagcattagacactttttaaagggatgaatcaggggacgacaccagaaggac

SEQ ID NO: 26387 - DNA, 1990 bp, Heterodera glycines
gattagaagaggtacaccagttgattaaaacagttttttatgtgaattaaaaaaggtacaacagtgattagaagtggtacaaaaggattagaagaggtacaaaaatgatcagaagaggtacaacagtgattagaagaggtacaacagtgatgagaagagtgattagaagaggtacaacagtgattaaaagaggtacaacagtgattagaagaggtacgacagtgattagtagaggtacaaaagtgataagaagaggtacaaaagtgattagaagaggtacaaaagtgataagaagaggtacaaaagtgattagaagaggtacaacatggtatagtgcaacagtgattaaaaagaggtacaactgtgattaaaagagatacaccagtgattagtagaggtacaaaagtgattaaaagaggtaaaacgtgattaaaagaagtacaacagtgattaaaagacgtcaaaagtgattaaaaaggtacaaaagtgaattaaaaaaggtacaacagtgattagaacaggttcaacagtgattagaagtggtacaaaaggattagaagaggttcaacagtgatcagaagaggtacaacagtgattagaagaggtacaacagtgattagaagaggtacaaaagtgattaaaagaggtaaattgattaaaagaagtacaacagtgattaaaagacgtcaaaagtgattaaaagaggtacaaaagtgaattaaaaaaggttcaacagtgattagaagtggtacaaaaggattagaagaggttcaacagtaaatagaagaggtacaacagagattaagaaaggtaaaacagtgattagtagaggtacaaagtgatcagaagaggtacaacagtgataaaagaggtacaacagcgattagaagagtgattagaagaagtacaacagtgattagaagaggtacaacagtgattagaagaggtacaaaagtgataagaagaggtacaaaagtgattagaagaggtacatcatggtttaaaattaaataaataatgaaaagtttttataaaaatcgattgcattttaatttaaaatttttttataataaaatactctttttattcattaaatataattttgaaaattaataattgaatatttattttgaaatgaaattcattttttataaattcaaaaaataaataattaaattaaataaattaattaaataatttataaaaatcttgaaattaattaaaacattaaaaataacccaaaaatacaaagaaaaataatgtacaccgcccgggtccgaacttcgcctatatgaaattctttaatcaaacaaaaaattaattttaaaaaatttttcacaaaaaaataatttaatttaaattaaaaaattaattaaataatttataaaaatcttgaaatgaattaaaaacattaaaaataacccaaaaatgcacagaaaaataatgttacaccgtccggattcgaactttgcaccacccccctcaaaatgatgcctcagaatccccaatcacacagggattctgaggtctgaacgatgtcaaaagtaaaatctgatcacgtattcgtgatcagcgtcataaaatacccctaaagacatgtttttggaatattttcggtaaaaaaatttttccacccaaaaatcctggtcacccccctatggtcccgaaaccaaaaatcacttttatttttataacaattcgcaaaaaagagataaaaatgtaaaataaaatttatattatagagaaaaaaattgcggatttttgtagtattttacttttacagaatgtcttttcagaagggagttctgaatttttttctgaaaaatctaaaatttccagaatttctggaataactttttttctttagaagatagaaatcccaaataaatcccataaaattctcccgattttttgctatttttaaagctttaattcacttaaattgaccggtcctccattgagttatgaattttcaaattttaaccccaaa

SEQ ID NO: 26388 - DNA, 1102 bp, Heterodera glycines
ccagaaagaaaatccagaaaattagggtcgtcgctattattccgaaatgtgggttggagttcatttgagtgtgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatgtgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctattattccgaaaatgtggttggagttcatttgagtgttgagcagaaaaagagatagacgttttttcaaaattttcagagccaaactcgcccagaaagaaaatccagaaaaattagggtcgtcgctactattccgaaaatgtggttggaattcatttgagtgttgagcagaaaaagagatagacgttttttcaaaattttcagagccaaactcgcccagaaagaaaatccagaaaaattagggtcgtcgctattattccgaaaatgtggttggaattcatttgagtgttgagcagaaaaagagatagacgttttttcaaaattttcagagccaaactcgcccagaaagaaaatccagaaaaattagggtcgtcgctattattccgataatgtggttggagttcatgtgagtgttgagcagaaaagagatagacgttttttcaaa

SEQ ID NO: 26389 - DNA, 1436 bp, Heterodera glycines
caaaaattttaattttcgattttttggtcgaattcggatccgggatttggaattggtcgaaatggaagccggattcgcgatcagcgaccccgaaaacctatagagtggcttcttttattctgaaatgtaaaaaaaaatatatgcatatggggcttaaactaccacagagccgttaacaatcaccataacacctttttcttcatcttattattttacttttattttcagattgagaaacggcgtgaggcggtcagaaaacgaatttgcccgtgctttttgagactcaaatcggcgattgacgaccaatacaacgaaaagaaaaaggttgtcaagcgagagcaaaataactatgaaaataatacgacaaaaaatcatagactgatgaaaccataactttgatgttgtcatatgacaaaactgatagtgtatttttcgctcattatcagcacctttgacaactcatgagtgaaataaaaaatcgtttaaatcgggcattttatattatctctaccattaccccacaaaaataaataaaacgtaaaaaattaacacccccgcctttcacagaaattggacaccgtccgttctctccgtttacgcgcgttggagcgcggtcgggaggccgaattgagtgcagcgcggctgaatttgcatgagttagagacgacggtggtgcggcaccaatgcgaaaaaatggtggaaggtaaaatggagcaactcaaagcggagacggaagcggtggaaggtgtgcaattttatgatttgggacaacacttaccgaaacaccgaacccatgaataatgccttatttcttcgaactaactcgaaacccccttaaatgtcgttttgattaattcgcttttaatttcgaattccctccagttttaccggtgaattgttggttcaaagactacgtactctcaccgcattcttgaatttttacaatttaataaccgtaaaagccttttcagaaatttctacaagaacttttcaactcgaatttgacaaaatgcaatgatgagtacaaatctcaatcgatgaacaaatatttggtggaatgcgaagtgagtgaatgagttggttggaaaaatcgattgcagcttattcctccacctaaaacctgtgtcgtggttgaaatgggaatgaaacccgaacttaggactttcgagcacctgtcgtttggggcttagaagggaaaatatgcccggattcggttacccgacgtttgcgcccctggacgatttagagtttatttgaatccattcgtgagcctgaaacgagctttaaattaaactgattgaggagtgattgtgatgctggtaatttgaattagtatttttaaaatcacgaaaaacgtttagaaagatggagttttgtgtaaaaagatgggagacgagaattaatggcttaataaaatagaagaaattaaattacga

SEQ ID NO: 26390 - DNA, 2412 bp, Heterodera glycines
gacataaattatcccacattgtgagaaatttaaatttattcagtattttcgagactattttgataaaaataaaataataattaattttaatatttcaattcattgatacttttgtcactttgttcctaccaccaaatttaagaaatttcaaaaatactcgcaaagtctgcttaagataatgacactattggcactggcctaaaataaatcattattgaaatcaaaacaacaaaaaaagtgtattcaattttgactcccttccatcatcattcacatcccttttattattcattgcaaaaagtccgcatgaaaattcaagtaaatagaataataatactggtatttaagtaatgacccaattatgtatttgaacaatgtcatttatcacattaattaattgttcgtttagtgagtgctacacgggattaggcctggggcggtcccctctcctcatccaacctgctgccctataacttagcaaatgtgtgccccctagtggacccccaatcacttttccgtcggatccggatcccgaccaatctcccccccccccttcccgttacgtttcggggtatttcaccttataataatcatttaccacaacggaataaagaatgttattacattgaacatcttaataggggaaatgttaggccatcacattcatatttattattttctaaaagaaatcctgtcctttttattttctcataatgataatcgagaagaaaaaacaaaggattctttgatcattcactcattgtgtttggccaattatccatcaactttgtttggccagccgtgtcaatatgtgggtggatgaaagacgagaaaaagtggccatgagggtgcagtcgagcgcgggatttcactataaaggggagcattttcacttcggcgtcctttcactttccaaattcatgattaatttctgatcattcatatcacccaattttgatcagcatttgagcaaaattaaatgctataatttctgacaaaaatatttttttgctaacaggtaattaataaaaacatattcaatgtaagcctgaaaaatatcaatttaaaaattttttgtttttgaaacgacataaaaaaataaaagaaaaactataaataaaacaaatattgcaaataaatgtatgtagtaggaagactagtttcggccataccgattttccggtaacggtaacagtaaaaactgttaattaccggaaccggttttttaaccattttttcgaaacttgattgtttatggtaaggattaattcgataaattttaccttgtcgaaatacatgtaattttgaggtcatgactcggtctcgactaatattaatcagttttttaattgaacggcacactttttggataattgcaaaatttagcgcattaataatgtacaaattattcgctaattactttaaatccgttgtgggctttctctttgtgctgtgttgctgcttggtcattatgatgccttccatgactttggcttgttgttgcgactgttgctgctgcggcggtggtggtggcggcggctcgtcatcgacgctggccgtcaatgtcaacggcacaattataccgttgccgagctcgggaggaggtttggacgcgacgacttttaattgaccctaattatccattccacaggtggcggcggtggttgttgcgattgttgttgcggtggtggtggtggtggcggtggcagcaacgatgccgcactgttggcagcaatcacagctgcaaccgcgtcctcctcgggtcgccgtcgtcgacgacagcttggcacactccctcaaacttttgcacaacgttcggcacgtacagcaacagcggcggcacaaggccaggttctaatccgataatcggacagggatggtttgatgtgggaaattttggcgccaagcgcttagtttgttaatttgtcttggtaccaatggaaagaatttaacaggatttgagtgtaaaaaagtctaggtggcccaaaaatgaaaaaaactcactttttctggtttttttcgccgcaaaaagatataagtaaaagcgtttaaagtttcttgcgcagaaacttcccgttggcctaattgaattgaatcattaaattatagggtaaataaacaataaatttgcgattgaaattttttgttttacttttaccgacaaaaattgccgaaaaattttattgggcaaattcatcccggtcatccattccatgttatggggtttctaaacgtagtgttgatttttaaattatttttaataaaataaataaaaatcatttcatttaaattttaaaatatttaataataaatgaaaaaacaatttgataacaaaaggtacaaaattcttctgctctcgaaggaggagtccaatgcaattgttgttgtgagaatggacaatgtgtgaaatgt

SEQ ID NO: 26391 - DNA, 1076 bp, Heterodera glycines
gtggaccatcagatacaggctaaatttctttcaccccaccccaacatttttgcgtttattggtggcattcgtgaggaaattgtgcgagttaatgcaatttcggtcaagttggattgcggctaagaaccagcactcgtacagtcgagcggagtaccgtcaggcaaacgaacgacttttgaccctcattggacgttactatcaaatggacacggaaaattttttgaaagccacttctaaattcgttaaatttcgtggtgttgatccagtgcggcagcaaaacgaggaaccgattgaagatgattaaacactgaaaaacgaatatactttattacctttagtgagggatgcgcactgtgcccccagaccaactatgcaccgtttatcccggatggagtttgggagggaatggggaaaagccaaggcgcctttgaccaagccccgaacccccaaacgactcattgactgttaagatgtatttattcattcgatgttggatttaaacgaagcgagaaatcggaataataattgaagtctgttccatcacaactgactgactgatcactggggaaagagaaatacgaagagaatgggcggagaaacattacaatgtgaaaaggaaaaacgtgtgaaaaggataaatgtgattgaattgataatggccaatgggaaataattaaatgagggaaatgcgtcgaataatccttacaactcccccctttccttaggatcgtccccgatccttaaaagaaaaatgaagtgaatgaatgaatgggtccaaactctcggcttcgcccttcgtctctccaatccgaacttccacggccaagctgcgcattacaataatgaacagcggtccaccttcatctcagatggatggcatgggaaatcggagaaaagcaaccaggggtcattccggtttggggatgagatgtaagagcatgatgagaggagagaaagaatgggccagagaaagtgtgaggaaaaccgacgcatagtaagaattttttgaattgggggaaagaaaggccattaacaatggggaataaaaggaaaatgaatgataatttttaaataga

SEQ ID NO: 26392 - DNA, 1349 bp, Heterodera glycines
taacattgctttaaaaaatattccttaatgaacgatcaacaaaaacaaattttccaatgtataaaatcaaacttagaacatccttcagaaaattgtaaaagctgtttttatatcgacggaccaggaggaactgggaaatcttttgttcaaaatgctttatttcattagcacgtggtttttcaaaaaaagtaactaatatggcttttagtggtattgcggcaactttattgaaaaatggacgaactgttcacaactgttttaaattaccattagatttgaatagcaattctttgtcatctattgaacttaggtaattctaaggaagcgaatgaaattcgccaaacagatgtttttatttttgacgaagcacctatggcaccaaaatatataattgaaatactaaataaaaaacttaaagaaattcataataatgattatatttttgggggtaaaattatgatattaagtggtgattttcgccaatgattacctattaaaaataaggcaaccaaagccgaaatactagatttattaatacaaaaaagtgaattatggaataattttcaaatttttcatttaactcaaaatatgcgttctgaccctttaaaaataggaaatggtaataacggtgatacgtttttacatcttcccgaaagttgcgatgtcggaaataatgatttaattgacgaaatttttggagaaataataaaaagaaaggtttttttgaaattgtgtaattactgtattttagctccatataacagagaaattaactgttacaacgaaaaagttttgtcaaaatttccaggagaaaattatatatttaaaagtattgatgatgcagagagtaaaggcgctcctattcttcctgaaatactcaataaactcgaaacaagtagtctcccgaatcatgaacttaaactaaaaataaattgtgtaacaaaattaattagaaatttaaatgttagtgcgggtttatgcaatggaacacgtcttcaaatacttgatattgggaaaaatgtattaagagtaatgattttaacaggtgatagaacgggtgagatcgattttattccaagaataagtttaatagaagataaaaaatttccttatgtacttaaaagacatcaatttccattaaggttagcattttgcatgaccattaatggagcccaaggacaaacttttgaaaaaattggtattgatttatcaagagaggttttttcacatgggcaattatatgtagcataatcaagaacacgaaattgggaaagaattaaaatcaaatattcaaatgaaaatatagaaaaaatcgttaaaaatattgtttggcaggaagcattgtaaat

SEQ ID NO: 26393 - DNA, 1027 bp, Heterodera glycines
  misc_feature (45)..(45): n is a, c, g, or t
  misc_feature (131)..(131): n is a, c, g, or t
aaaaattccagacaatagtatcggcgtcatatgctgagagtgcgntggaatcccttgactgtagacagaaaaagagatagccatttttccaaattttcacgatcaaatgcgctgagaaaaaaattccaganacaattagtatcggcgtcattatgctgagagtgcggtggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcatta

SEQ ID NO: 26394 - DNA, 972 bp, Heterodera glycines
actcgtcgcaccaattccccttccatagggagggacccgcgcccaaatgtctcctttttgaacttcaaaaaatgccccccccccttcggctggcagcaaataaaacgcccaaaattcaaaggagaataaaatgaaacaataataaataattaaataaataaaagatgtattttattaaggtataaaatcaacaaagcaacagtaaaatgtatcattagttttcaaattatattaattcaaaaataaattcagaatatttgattttatttttacttggtttgccaatttgtctttttctttttttaaatcattttttgtctcttactttggttacttttcccccttttctctgctttagctgtggcagccgttgttctcgccttcctttaatctctgtagaaaatgaccatcccaatgtcccaatgtcgttctattttgcggcgctctctcgctgtcttctccattctctctctctctctctctcaccctctctgtctctccctctctgtctctccctctctcactctttctctctcaccctctctgtctctccctctctctctcaccctctctgtctctccctctctcactctttctctctctccctctctgtctctccctctctcactctttctctctcaccctctctgtctctccctctctctctcaccctctctctccctctctctctcaccctctctgtctctccctctctctctctcgctctaactttcttttattcctttcttctcattatcatatttatcaatcaccttaaaaatgagtggtttcagaagaaaaagaaatacaaaaagacctgtgctgaactgttgagctgctgctgattttgttaatgaaatttttggacttctgacgatgagagggaggaaaatagagagaggggaaaagaaagaaaggaataaagggagaacagagagagaggagaaagagacaaggaaagggagggagaaa

SEQ ID NO: 26395 - DNA, 2227 bp, Heterodera glycines
ggaacaattttgagaaattttccacttcttatggggatattctaaaaaattaggtcgattcttagcgggtgcttttttgttctattgcattttatcgagaagttttccaaaaaaaatgtcgaaatagtgaaaatagtgacaaacgccaaaatagtgatttcgataatcgatttaaaacgacccaaaacgatgagaaaaatggaaattagggtgcttggcattttacaaataagaaaatcgggtactgagtgcccaaaaaaggaacataaaaatggcataaacaaatcatggagagaaaattgttggcattggcactatttccgagctcaaattttagaaaaacattccaatttcaaagaaaataaaaagttacaatactttgttaaaaagaattcaattagataaaaaaccccattttgcagatttatgctcttttggttgctttttggctttgccactttttagggcatctccatgttttatcaacaaaaattgaatttttaaggtaaagaccggtttaattttgtgataaaatttacatgatctcctaattattttaaaatattgaaagatttgtgaaattaatggactaaaaattttaaaatttaaaaaattataaataaaagaaaatatacatatttcaaaataatatattgatgaagaaagagcaaaataattatgaaatcacaggaaggaaatcgaacggcatagacaaatcaatggaaaaatggttggcattggcatcatttcctgacaaaaaattttggaaaaacatttccaatttcaaagaaaataaacgatttttggaggatataaaagccaaaaaaagaaaagcaaaaaacataattaattaccttttcaaatcattcaaaaatgcgcgccattctcttcctggccatggtttgcttggtgatggctgttattcttgagacaggtggccaaaattaattaaaaatttaaaaatattttattattttagccaactcaaaggcagtgaaaaaagacaataagaaaggtataaataaattgaaaataaatattaattggaatatgcttttaaaggagcaattacaacgccagcaaaaggaaaagcggcgccgaaaggagcagcgaaaggaggtaaagcagaaaagagagagggactaattaatacaaattaactaattaatcaaataattaattaaggaattaaaaaagacgcaaaatcaaagggaaaaggaaaaaaggacgccaaaggcaaaaagggtaaggattttaatataaagcgaaatttaaacagttaatttttgaattttagacaaaaaagctaagccagccaaaggaaaaggtgcccctaaaaatggtaattattattaattttaaatgctaattaaaatgattgaataaatttagataaaaaatccccagcggcaaaagccaatgacaaaaagagcccaagtaaataattaattatatttaatattgtgccaaaattgccaatttgaagccaaaccaatggcagcagtgaaagccgtgccaaaggcggcggagaatgctcagaagggaccgtcgagtgcggaagtggtggcggaggaaaacaacttggacactgaggcggtcgacgacttgggggcggaagagtcggactttgaccaattggcagaggacgaactgctcgaggacgacgccatggacggcgaggcggacgaatgggaaggcatgggggaggagacggagatggacagccaaatggcactctgatggccaactaattggacaaattacaaacggaacaaaacgggacaatgacacaaaatattatttatcatttttggcatatcattgaaaataaatagaatttattttgcatttcagtaaataatggccaatattctgaaaaacttaatgggtgtcgaaagttccatgtggagccttttaaaacacaaaattccttcacagcaggcagcacgcaattaggattacggaaatagcggcgttttgtagcccgtcattacggataacggaaaacggttttttttgtgatttttccttaattataatattagtttttttttaaaattcaaaccaaattgttcataaattcgtgaactctcaaatatctcattctttatcaatttcgctagcataattacaacaaaatcatttcaaagttttaggcgttaatcttcaggaaacaaagaaacccaagaaggaattaaagcagaattggttttggagccatggattt

SEQ ID NO: 26396 - DNA, 1224 bp, Heterodera glycines
aaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctataggaaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatctattttttcaagtgtccgtttggggtactcaaacatttatggggagcaaaaatccaacgcagaattaaagtacagactatagggaagctattcccgaaggattcggtctccccataaatct

SEQ ID NO: 26397 - DNA, 1890 bp, Heterodera glycines
  misc_feature (1848)..(1848): n is a, c, g, or t
  misc_feature (1853)..(1853): n is a, c, g, or t
ttttcattttttaagacaaaacttttttaggggtttcgggggtcaaaagattcaattttagcatccatttcgactcattcgaaccccgaacctggactcgaacaaaagttgcgatttcaattttcagtaaaattcacatttaggtaccgaaaaaaatgccaaatttcgtgcaattttttcagcctgaaatttcgaagctatctaacgcgccatactagtatttaataataataattttaaaaaagctaaaaacaattagagtgagtgaataattgatttttgtttggtacaaatgtgaattttgttaaaaatgaatttgcgactttttgttaagggcctcatttttcaaacatttaactgattgttgtgagtgatcaaacaaaactcattcgtcacatattcctaacaaactacagctgatgaccgatcgcaaagcacgcccgggcccggcacatccaaaattgcggaaggcgtcaaaaaccgaagttcaaaacgtagtcgacgacgtgtcggcggtgggccccatggcggtgccggtgaagacgatgaggactacccatacaagccggacgaacttgccttcaacaaaacgtcatactttaaagtcagtgccggacggacacgattttttgaatccgagaaaaattgcatctcttaactccgaagttttttggaaattattttttaaattttttgtatcacttatttttttattttttgcaatttaaaattccctaacccgaattcgaacaaaaattagatctttttttttccaaaatatgcgtttttaaattcatttacatttttgatcgatttaacgcattaaaaaaaattttttttggtttatataatattatttcccgtcaggttgaaaagctgttggcacaatttggttggggccgttgggctgtgctgaaagcattttctgatttgactgaacatgaactggaacacatcaccaggcaattttcaatttccttttaccccaattgttgatcattgatcagggggtggggattttggtaaatttaaaaaatcacagatttcatgtcttgacattttttctggagaattccacctgtagatcactgatcagagtgccgttgccattctcctaaaattgattcaacaaattattgggtagttatgcccattgattttgacaggacactgttgttgcattgtgttcgcgaatttcgtggcgatgagaagatccgtgaatacgtgtgggcactgatcactccgtcgcatcgcacacaaaaaaaatcggcaacaacaaaaattgatccggatcaaaagcagcagcaggatgaaaaaaagacagcagcggcaactggggactcaaacagccgctaccaccagggatgggccgctttgcctgaatacaatgtatgtcgtctaatgctcatctggaatcatatactttcacgtcaaatctaatgatttttatgctcacatttcccgggtcatctatgttactaaatctatgatttttccaaccggtccctcttttcccgtttcatctggaatcatatactttcacgtcaaaccgaatgatttttccactgtcactttccttggtcatctatgttactaagtctatgatttttccaaccggtcccttttcccgtttcatctggaatcatatactttcacgtcaaacctaatgatttttccactgtcactttccctggtcatcgatgtcacgtgaaatctcatgattttccaaccggtccccgtttcccatgtaatctggaaatcatataattccgcgtcaaatctaatgatttttccatggtcccatttcccgtgacatcgatatcacgtgaaaactcatggttttacaanccggntcccgtgtcatctttttgatgaaatcatatactattt

SEQ ID NO: 26398 - DNA, 2324 bp, Heterodera glycines
tttcgtttttatttaatttctttcttttttttgaaagtcctcctctgttcttacgaatccaaactgtgcttaattataattgtggactttatttatgggctttttattcgggggctttccgcggagggcctaagaaattattcatttaattattcaaaaagaatttattccatcgcaaaacgccaataaaacaaaaaaactttgataatctctctgggaaggaaaatattttaataaatttacaaatttttttaaaatatacatttaaaaattatttcatcaagactgaatagacagtagtgccgaccgaatgtttgggcattgacacttttttttaccagccgactttttcttttggcattcgatgctgtcaaaacaatgcggtgccatgccatgccatgccatcattgtgtaaatgagggggcgggtggggaatgccttgtccgtacgtctcttccgtctttcttttttctttccggcgccctttaaattttttaattaaatgcgcagagacgcaacagaagggcaaaaacactgaagggattggcacaaaacattcatttctttggcattaacagatgataagcttgtatagtttttttcgcttttaataacaaaaaaaataattaatttaaaatgaaaaatattttgaaacgcaaaaaaatgcaataaaaaagaagtaatttttggaaattctttaaacagagaattacttaaaaattgacaaatttacaatttaaaatgaattaggtatattttaaaacgcaaaaaaaaaatatgaaataaaaaaaataattttttggaaaaattttgacagaaatatttaaaaatacgagcggaaaaatgttttattactttttaaaggtaaatattttttgaaccaattatgataaattcactcctaaattcctttttttttggcttaaatggtcaaaaatatatttttttgaaaaaaagaaggcaacaaatttataagtagggctggaatttttttgcggcttagttatggcgagagaagtcccaaaaatagcattttctccgaacaatttttgatttagagcgacttataaaaacataaaaacacatattttggcgttttggcacataaaaacatatcgcacatatttgggctattttggattttttagcacatattttggcatttttgagaaaaatcgtaaaaaaatacaagaaaatctgaaaatgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgacaaagactgatattaaatatgattttttttttttgagtaaatacatttggtttttccaatttttagcacatatttttgcattttttaacacatatttaggcctttttttttggtttttagcacatattttattacatatttcaggatttttagcacataaaaatcccagccctaattattatatataatcacagcaataaattttggtcattttcagaaaggcaacgaaaatcaatcagaaaataaataacaaatttaaacaaattccccagtgaatgagaaaagtcactcgtataacctttccttgcactaaaaaagtaggaaaatgcattagcttttttgattcccttctctttggccaatcaattacaatgccttcaatttggccattaattctgtcagttcggcggtcacattcgtattcagaagcaccgcatcggtctgttgttgctgttcctccgtcgttttcgtgttgcaattcggcggtccattggtcctttccccgtcactttcgccggcactttgcgatggcaatgcttccggcagttcgtaggccaaacggacagagtccgagccgatgccaacggtggccgaatttgcgggcaaaagattctgtcgttcctctggcaactgttgttcgacgatctcgatgcctttattttaagctcgattaatgccataattggttgactgacacaccaaattcgttgttctcatggacaacacccgccggcgtcgacgacttttcactgtttttcgtgtgtttttcatccttggcaatcagcgcctgtttttcctttagattaatttttttaaaatttttaatggggttatttaatataaacttggttttttttattaggaacaaagaataattaattttttaattgggggggggggg

SEQ ID NO: 26399 - DNA, 1813 bp, Heterodera glycines
  misc_feature (1747)..(1747): n is a, c, g, or t
  misc_feature (1796)..(1796): n is a, c, g, or t
ttctccctttactatcttcaaaaaacatttagccatacatgcaattaattcatttttgtacaggagctcattttcgggatagtgtgttaaaattcaaatttatttttaaaatatttttttattatttttttggctttcagtttttttcataattttttaaaagtgcctgtcctgcccccaattcccccccccccccccgggtcgattctcaagagttcaaaatttcgggttctacaaatttttacagaaaaaacggtagtagaaatggcctccaattaccaagggtttggttttacaccattatacgaaaaggaagaacccgcctcgttctatgtagacaaaaagaaaatcgaagaacgggttagtctctctaagccattcgcacacatttcattcattgtcgtcatttctgatccaggctaagctcggcgtcatgctcggcgtgtaccttccgaccatccagcacattcttggcgtcaccatgttcatccgtttggcgtggatcgtcggtgtcgctggcgtatcgcacacttttctgatgctcttcatttgctgcctttgtgtaactttgcgttctttcaattcactttttcacgtgtccttcagacgtttctcacctgtattagtgtgtcagcggtggcgaccaatggcgtcgtggaaggcggaggagcatattttatgatatcacgcaatttgggacctgaatttggaagtgcggttggcattctgttctatctggccaacactgttgcaacttccatgtatttggttggaggaattgaaattcttctggtgattcttccggtcaacccattgacttttcatccgtaaattttcagttgtacctttgtcccgggatgacaattggcggtaaaaatgcgcacacggacactggtgagttacatcagcacacggccaaggggccaaaggaagtggcgacagaaatcagcctgggggagggcgacgcaaattccccccttgaaaagtcgcttattttagtaacacaaatacttaccctcgacaggtttcttggggatgatgtccaacaacatgcgtctgtatgctacttttctgctcattgttcagttcaccatcgttgcaatgggtgttcgttttgtccaacttcttgcacctgtaacttcttcgttttctttcccctaactttgtccccctaatttccctaaggtttcgctcgtctgtgtcattctctccgttttggcttgttacgctggtgccgttgaaaaaacgatttccggaagcggacaacagtatcttttgaggaagctgtacacttcaaatcattgcattcagagtttgcatgatcggtgaccatttgcttcaaactgatgcagttttgaaaggcgtgttcaaaaatcagtccattcccgagggagtgtccgtctgcgattattgcaactcgacttaccttttagacctgtgatatattttttcttttttaaaattttcgacaacctttaagggttatcaaattttctgctaaggacaacaacagtcaccttctgaatgcctcctgtgtcaatggatttcccggttttgccactgacactttttggggtcagtgatggtaaaattttttaattcccatgcatttccctcaattgttacaggcaatttcaatcctaattaccccgactttcatgaatacgccgtaggaaagaaagctgacgtttccaaggaagtcttccaggatgtcaagacgtaacactttgtccctttgctgtgtttnccttcattttcagctctttcttccttatcatggccatttacttccccgncgtgacgggcattctca

SEQ ID NO: 26400 - DNA, 1132 bp, Heterodera glycines
ctcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaggtacataaatctagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacagtttcaggaggcgcccggtggttggttattggagcccagaaaaattgtagattcagaattttaatggtaataatagaagaggtacataaatttagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaggtacataaatctagaaataagcatattgcagtgattgggaagaaagatttaagtgattaaatactgaatttttggggccatcaactcctttgtttttgccagagtttgtgtgccacaaataaaaaatgcgggaatagaggaagaagaaccaaacaaagatgaacgatgaaaaacactttcaggaagcgctaggtgattattggagcccagaaaaattgtagattcagaattttaatggtaataatagaagaagtacataaatctagaaataagcatattgcagtgattgggaagaaagatttaagtgattaaatactgaatttttggggccatcaactcctttgtttttgccagagtttgtgtgccacaaataaaaaatgcgggaatagaggaagaagaacaaacaaagatgaacgatgaaaaacactttcaggaggcgcttggtggttattggag

SEQ ID NO: 26401 - DNA, 1284 bp, Heterodera glycines
  misc_feature (34)..(34): n is a, c, g, or t
  misc_feature (79)..(80): n is a, c, g, or t
gagatagccatttttctgggatagagtataaatntaaaaatttccctcaaaaataaaaagtctatttgcgcaccgcctnnccctatcatgctcgagagcatttgtatgtgtataaatttatcaaaaaaagagatagccatttttctgggataacctctaaaatataaaaatcctctgtgaaataaaatggcgattgtgcacagccttccgtctcatacgcaagcgcttttgtgaggtataaaattctctcaaaaaaagagatagccatttttctgggatagagtataaatataaaaatcctctcaaaaataaaagggcgattgcgcacagccctccgtatcatgcgcaagagcatttgtgtgtgtataaaatttctcaaaaaaagagatagccatttttctgggatagactctaaatataaaaatcctctctgaaataaaatggcgattgtgcacagccctccgtatcatacgcaagcgcttttgtgaggtataaaatttctcaaaaaaagagatagacatttttctgggataacctctaaatataaaaattccctctgaaataaaagggctattgcgcacagccctccctatcatacgcaagcgcttttgtgtggtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatttaaaaattcccctcaaaataaaaggtctattgcgcaccgccctccctatcatgctcgagagcatttgtatgtgtataaaatttatcaaaaaaagagatagcattttt

SEQ ID NO: 26402 - DNA, 1110 bp, Heterodera glycines
gtgcgcgtgtgtgttgagcatggcattggtggaaaggcacggaaaggcgacggcggacgaaatccgcacggaggaaacgacggcatttttggaagaggtgcccaaatgtggaaccagcatttgatggcatccggtcaacgcgttctttctcattgtcagattatcaaccaaaagtcctgttgggctgttcaatttcgtgcgctttacgagcggagtttgttggaacggcaaaatcggcgcagaatggagagggcgtgtgctcaactcgagtctcttggcaaagtgttggacaatgccacgccctcttcggttggtacaaatttctttgccgatcactcttatcaattcctatcgatatctgttccattttcattcccactccatgatttttccctttaggtcaccctctcccatcgtttgtgccttctcttcgcctccaatccaacgcccttttggacggtgctcaaatggcatgccgatgtgctcctttcgctcggctgtgtctctgatgcccttcgcattttcgaacggctccaactttgggaggaaactgtccaatgctttgtgagtcttcgtcagtcggaaaaggccgaggcattggtgcggcgtttgttggaacagcgggaggaaccgttgtacctttgtttgttgggcgatgtgacgggcgacgcggagtgttaccaaaaggcgattcgggtgagacgcgaaaagcccttttttggtgcatttgatttttacattttacaaaaaaaggggggtccggacgatccgtcagtggacaatccgtcagtggataatccgtcagtggacaattcgtcagcaaattttttatgagcaatgatcaaaaattttaaaaatgattgttaaatttaataaatataatttttatagatcttaacatttctagttactttatagtttaattaattgacaatttcgagaaattatcatttaattcttttaaaatggttatttcatatttttataaaataacacaaattattaattcacatttttagcgacttaaattaatttcacatgattttaaataaatctgagtgttttaaaaataaatttgcttatggattagttactgaagtattgtccact

SEQ ID NO: 26403 - DNA, 1685 bp, Heterodera glycines
attgaatttattgttctcttttttctctggaacttatggaacattgctaatgtttatgtcaatttttttaattatatgtaaataggaattcatttttattaaaaaatgaaatgaattaaatttcaaaattaaggaaattaaattggttttgaataatttaaatggaagcataaaaataaagctattttaattcttaaaaacttatattttaaataaataataaggtagcttaaaatattcaattattttttaattaattgtttatatttttttataaaagatcaattattatttgaattttattgttctcttttttctctggaacttatggaacattgctaatgtttatgtcaatttttttaattatatgtaaataggaattcatttttattaaaaaatgaaatttatttcatcttatttttaatttgtgtttttcgtgttttttgattatgaaataaataattatttttggtttgtaaaaatcaattttttttttttataaatcataaattaggaattatatattgttttcttaaatgaattttaaaattatagctatgtatatactcttttattttgatgccttttattggggtattgtttaagttcttgcataatacccaacaattttatttttaaaatcataacaattcaagtaataaagtaaatttaatgaatctatgccagattattccactatattagccctaattttgaccaattaattaggggttttactttgacatcacaaagttatggccccgtgaattggttatgaaaaaattacaattttcagagaaaagatttatgcatattttataagggctatttgaatttacttgctccaaatttaactgaatctttttggcccataattaaatgtaaaacaaaattatcgtaccgattttcgtgaaaattcacctgaacttaattaaaattatttttaatgctataaatttttcttcttttttttatataaaataattttacttttattttttctttggttcagtcagcagatggagtctctctttcccgtgtataattagaaaaattaactaaattcccaattactacaaatttcatttgttgcaattaatgcactgccaattcttttcgctgtcgtgtgaaattggcaatctgttggaggaatgtctcgaatattcggagataaaattaagataaaatttgactttatatttatttcagtgattacattgaaaaaatttttttttggctgaaataaggagaattcttagaaataaggacaaatacgatctctgatttatttacaactctaaaaattagctgagatttaaataaaaatccttatcttttctgagatttttttttattattttgtgtcaattttatggtttttgttgtggaaatttgcatataatgattagggatacataccattttaggtttttacctgtattttcctgagctcccattgacctgaaaagcacgaaaaacatgtttttttgtggttgttaagctacttttcgaagtttttagaacctattttcaaggtttttattttttgatcctaaaccctaaaaattcaaaaaaaaaactattttaaactattttggcgttttgcctgaaatttattaataaaaatgcaataaaaacgaaaaatacatccctaagaatcgactccaaaaatttcggaaaaatac

SEQ ID NO: 26404 - DNA, 2412 bp, Heterodera glycines
gaagcggacgagcaaatggtggcgatgcgcaatgagacagggtcgaaaaagacagggaaaactgaacacaaatgaacggtttcagcgcaacgaccggtggacgtggacaattggacgtacaaggcgaggaacgtggtgctgttcaaccatttggcggaggccccgctgacgatgggcgaacacatcgaaagggccaagcagcgcgaaatggccatcaacagagaggccacccgtttcggcaccgaggcgatgatggcacaacgaccccagcagcaaatgatggcacgtgtcacccttcagaacattgccaaaaatgcgggccacattgacatcaccggcaagctgatcggaatagaggccaaaacggtcggattggtggccacaccgacgccggcgccaggtgagtgggcattgtatcacgacccatgggtttggaattgttttcgttgtttttactagagcatcactcattctttgaggaattgacgactcaccactgatgacctggggagagattgagggcactccgttccgactcgacgcccccgacattcagccgtcgctggaggatgcgcccgcattccgagtgagtggccgactaattgtcagcaaccgacacgaacagaattcggaaccgaaaaatcccaaattttgtgcaaaaattcgattattcctttgtccctaaactttgttccattcatttttcagatccccgaagtgccaattagggagaaaatcgctcaaggaattgccgagcaaattgcgtctcgttaccataacaaacggaagagggcaatggaccaaatccaacaaatggcgccgtaagaggcggaagagatgcctttaattccgttgaattgtagaaagacgccaaaattcaattctgtgcgctcttccggcggtcgtttggccacaatgtctcctgccgcccgcagtcttttgggcgataaacttggcattcgactgggcactgatcggatcaaagtttctccaagtccgagggggtcagttgaatatttgttgtttaaatgtcgtaaaatacaattaaatcctcgaatttaagttcggcttcgagaacggtcttcagcccggcaatttatcagatgatcaaagtgaagaatgagcccaagtcgggcgcaacgacgcccaaacgggcggcagcgacgccgactttcgagcaggttcatcagttacggacgacctcctgagggtaatgacgacaatcgaagcaaaaaagcgggtccattttatttagaattccttcacctggtccttcaacactaatcaaaaacaaagaacaaagagaagcgcagcaaagaaaaggtaaataatgtcaacaaaaatcagaaaaacattcgaatggctttaagtttcggaaacggaagaaacccagcaaaatatgggaaaaaggccatcagctgcggatttcttctgatgtatgaattcaaatctacatgttctcctagcaagtgaaaaagtgacgtattttcaattatgtttttcccatttattttttcaacgaataaatacagtgatataaataaaaatttatttgttttaaaattacaaatgattgacttattgttgaatcagtccacctctcaccccttcccaaaatgataaatgtctttttctccgccggacgctttcagttcattttgctccaaatgctgcctcgtataaacctgtaaaaaaagctgacgaataaaaaaaggaaataaaagagagacttggatgaccggcaatcccatggccacgcacacatctggccactgcagcacgacacggagtgaatgtttttcagggaaaatctcgcggattcgctcccttccgtcggcgccggagagagcgacgaaaaaacgaacattgtcgggactaaacaaagaattacaaaaatataagaacactaaccgaaattggtgttgggagtcccaatgagcaggcgaagaaaacaccttaactttgcaattgggtttattttattccgtccgtttgcgctgtttttcttattttcacctcctcaaatgcctcggccaacggaatgtcttccgcacattcggacacaaaatcggtctgtcccttttccgggtattgcaacagaagcggccaaatcagtcgcgcacttttggtgccctcgtccaccagtcgaaccatcgaatgctgaagtgaaaaccaaataaattgtacaaccagcaaatgaataattagtcaattgcgaccctttcgagtgggccaaacgaaatttgcaaatgttggcataattcgtccggctcgtccaccggtggacaaaggcgaactccccgcgccctaagttcttctattaattttgtattgcgccttcgttcgagagtttcctagaaacaaaaaaatgatgatactaaatgaggaaatagagaaatgaccgtcttctct

SEQ ID NO: 26405 - DNA, 1618 bp, Heterodera glycines
ttgccatttttggttgggaataaaatttaattatttgaccactttcaatggccaaatcgaataaattaaataaaaattgttttataatttcctttttcatttttctgcccaccaattcgccccattttcagtcatttcccttcactcagtgccgaataaatggaacaatttggcgaaacaatggataaaaattagccgaaattgttgtccatccatccattgaccatattttgggacgggtaattaagggaccggcgaaaacgcaagaattatttgaagggccaaaaagaatggaaaagcgaagggaaaagggaaaaagggtcggagctgaaagaagaacgaaaaagtgcaagtgatcatcaaataaaagcaaataataatccaatttaaatttaatttaatttaatttaaataatattcgatacataattaactataataatacataatcacataaacagaaaagtaaatcattcattcataaaaatttcaattaaatatttttaaatttatatcatcatttatgaacaaaattttatatattatgccaattttatattttgtaatattaaatttaatataaattaaataatataataatattgttattaaaataatttattttgctttttatttggtcacttgcactttttgtatttcgtctcagcatgaaaatgtccgtaggattcattatgcgatggatattcgcttaccatccgccttttgcgcctccgtccgaatgcattttctgtcccacgactgatgctgctgcgactgcttggacacggagaccaactcgaagcagaactgctcgtgaatgatgtcgaactggcaaaaacggacgaaagaatgggctcagtgaggagatttcaaacttttgtgcacggaattcgtagaaaatttgtcgggatattcctctggtgaaggccaatgaatgatttttgcagaaaagtgtcctccgaatttggcacgactaacaaaaattcctaaaacaatgaaagaaatttttaaaaaagagatataataaatacttccaaatagagcatatgttcgtcttcattgagctcgttaaacggtgctaataatcgcaagcgaaagtcaagcaactcaataatttttggacaattggacaaagtccaactgatggaaagggcattttggcaaaatgggaaaatggccgaaacagccggaagatgaatttgtatggccaaatttgggggatttatttgaatccattcggaagacgaagtaataaaggcggactaaatgaaatgaatgttaattattaaaaataatcagccggcggcatttcttttgggttactcaccggcagggaaagccgatacaaaccgggcgcaaaaaaatgccaacattcgaattccatccgaattcgcttcgtcgcccttaaaattttcctgccaatcgctaaaaataaattagactttttaatcaaataatttttttttacaaaatgtgcccaattgaaagattttcaacgaattcaatgaatgccgaaattccaaatttgcttcaaaaaaacattcgacggagaaattagtctctaaatattttaaacaattatatttatctgccaaactcactgaataatttcgatatt

SEQ ID NO: 26406 - DNA, 1181 bp, Heterodera glycines
gttttcgtataattcgaaatatccccaattccgaatacttttcagattggctcctggtcctatcaatctgaatatcttcggcttgttgttgatgagcgtgacgtgttccttggtgatttctacgataaccaggaatggctgctggtaaaacatttttatccaagaaaattgtaggcatactttgtaaaaaaaaaaattttaaatttttcatagaaaatttcaaataaaaaaattgtcgtataaaaatttcaaatgataaattttcttccacactccccccccccccgaaaaatgtcccctctgggcgcagaggtggtcaaagaattgagctcctccaactgctgctgtctgcccgaggggggggggataaatttcaatgaggtggcaaaattttgaaaactccgaccaaccaaaaataaaggaagaaaaaagcctgttaaaaaaacaaaaaattctttaaaaaattaaaattatgcctaaaaactcattttaaaatggggaaatttaaataaaatccggcgccctgaggatatttttcaacgaggtgatgaaaaccccgaccaaccaaaaaatgaagaagatataaactgttagaaaaggaaaattttaatgtccaaaaaggcatttaaaatgtgggatttttttttgagcaattaaattaaaaatccgccaccaccgtggcgatatttttcaacaatttttaagtgtgtgacgatgaaaaaaaaatgggacattctccgacacacagcgggagagcagcagcagaagctcgccgccatcatcgcccaccacaaatataaataattgaaaatagaaaagtgtcaggggatgggaaagaattttttttttgcagtaattttttggaaaatttgagcgtaatcaattatttatttatttatgcatgatttttagtgggttttttgcataaattatcaaaaaataattatttttccgtttttttattcaaataaattttgaccatcaaaaaaatgaattcaatttgagtgaaaatttattattttttaaccaaaataggtcaaaaagaataatttcggcgaacggaaaagaacaaggaaaggaccaaaaaacaatttgcaaacaaatttttcttctccaaatttggcgccgtgggaaaaaaattaaaaaaaaaaggggctttaacctggttctaattttaaaaa

SEQ ID NO: 26407 - DNA, 1126 bp, Heterodera glycines
ttttcatctgttctcttttgtccgtttttcccctcggaaaaaagacattttccgtataaaattcaacaaaaaagagagtgtattttgtttatttttaacggaattttcccgtcaaaaacggtattttatacataattcaaagttaggcacctaactggactttggcttacattttctctgatttttgccatgaaatttgtcactttgttcgcccgtcgttggcccctttcgctttctgtcgccgcttcgtttggccgcgtcggtgcgacgcgcgccgcttcgacgctgacaattcgcgacgcattaaaccaggcaagtttttagggtttttggtcatgtattcggcatcgtttcaatcaatttcatgggttaccgaacccgaaattcgaccgtaaatcggattgggttttaaattgataattttttattcaaaccgtttcgcgcaagtccgaattttgccattttcatcgtccagcaaccccgaacagattccgtgaaatgatttcggtaacacaaaattaaagcgtgccgaaaattttgtttttccctcggtgccatttttgcagatttttaagtgcttgtgacataccatcatgcatttgtcgtattaaataatttctcatcgtcaacagcagcagtgtctcaatccgtctccactgatcgctcccatcgatcgtcggcgatttgcgacagtcaaaaagaaacggcaatggaacagaacggcacaacaatcggaggatgaggaggacgacgaagcacaggaggaggaagaagaagatgaggaggacgaaggaatgccaaccgattgccggaccaaagaattcacaatgctttcgcggaggtgccgaaaattgggggggggcatcaaaataaaaactatctctattggatgaaattgccaaaaaaaaacggataatttttcggcttcgaacccaaatgggaccaaatgcgcacaatttccaacattgacagtttccgatagatccccagaaacattatacaacaaggcactggttggggggaatagacaaaagcccctctttttggcattttctttcttctggatttggggggggacttaaggcccccccccccctcccccgaaattaaaaaaaaaatttttttt

SEQ ID NO: 26408 - DNA, 1581 bp, Heterodera glycines
cccccccctccccgaaattaaaaaaaaattttttttcaaaaatttttcaaactttgatttcgttccccctcccccggagccaagggtttggctaggctttaaacaaaaccaaaaaacaaatttccgagagtcacgacttttctgttttccgcaatttgtgtgcatattttccagcttttttgttcagattggacactgtggtcggagtggcactcaaaacgagcataaggtgagaaagtgcggcaaaacaaaaacaattctttcttttgtgtttcccattcatttcagcgcacttggcaattggattttgcagggccgcgttcgggtcaatgaaacggtaggaaaacgtaaaaaaataataaaataaattggccaattggtttaggtggtcatcaaaaaggcgcacgaggtacgatttttttcaattttgaaaagcatttattcgctaattgaacgatttggacgcattaatcattcacggacattttattgggccaacaattgaacggaattgagcaaaatggagttgaatttcaatttttatatccaaaaaatagtgaggggtgaacaaataaatggtcaatgaccaattaatttaccattgaatactttttcaaaaaattttgtttttagtaatctttggtttcttcaaactttctacgaaagtatttacaattagttcccttccggaccgagactctcgggaattgaccccgagactatcaacaaataaatactcatttctgtgtatcgcacagatagagcagggcgacttggtggaagtgtgggacgcgccgtacgaggaaaacgcgcggcttgccacggtgcaccgtctgcgcattgtgcggtgtcgttttgaccaacgcaaaggctatgtgatcaaaacgaagtgttggcccaattacataatggagaattgggtcagtggagatgaagcggaggaggagggagaagaagaagcacaacaacagcaggaagagggaagggaagacgaagcggaaggaacggcggaggaaaagggcggaagaaaaagtgaatgaagccgaaagttgtgacgacgaaattttatattttatttgctaaatctaataattgcgaaaatttaattgtaaatttgggtgctttgagtaatatgtggagggggaaggcacgaatcgcccggcacagatgacggacggggtcgaactcgcagctctcggtgttttgtcccctattttattaataggtgaattcatcgaatcaaaattgtaaataaattaggtaaattgcaacaatattaaaaatcgatgcgccattgcagtggaaagaaatgactccgatttatattattgtagcgagttaagctgattaaaataaacaacaaaacaaaaaggaaaattaatgatccttgatcgttgtattttttaaattagtgcttaattaaatgttttggcgttacgtttgaccccattatgaagagaatgaatcaaattggtggtccgattgaacaataaactaaccattaaaattgaatattttttgttcttccttacaaaaaataaataaatgtacaatttggggccattcaataatatagacatt

SEQ ID NO: 26409 - DNA, 1662 bp, Heterodera glycines
tcatattcatctaattgccggcttctattggcactcgggcaaggagcgtccgccaattaagaaacatcggcctcagaacatcggcaacaacaacaatcataaaaactcaacagaatgggcaccggcagagatttgctggcctccgcgcgattttgccggaggcagcggcggtggccgcagcaaaacgccgcacggtggccaattaacgccgccggcgcagcgccaaaggtccgccggccatttgcaggtggccattgcctacgaccggccgagttgggtgctgaccattcggctgatcgctgcccacggactggccacctgtggccaacagatgccaaatccgttcatcaaagtgtatctgttgcccgagcgaaagtgcgtgtggtgtgaaacaatttaggcgttgtttcttggcattttgtctcatagaagcatgcgagacaattcagtgcttagcgaaaactcagtcccagttatcattatggtcaatcgaagctgtccatatccagcgaaatcgccctgttttatccaattcattcccgtaaaattttgcccctcgtttttcgtagatacaatatcccaggactctgtcttttgaaaatttgactttcaacattcctgatacatacaatatgtaattttggttaaaattttttgggtctccgaaattttagccaggccctagacgaatcaggctttagctcccgacagtttttgatcataccgtagtccccagcagtggactcaaaaacattttttaagagtgtccaacaaacgtcgtactaaatacgtgccggccagctgtaatccagtttgggaccagcttgttgaggtacagcacagccatggtcatcccccgatttccaaatcgcttttacagtattcaattccacccaaccaactggagaagcattacctggagtttacggtaatcgactatgacagacagacgacggacttggacagccgaatcattggccaagtgcatgttggccttaccggtctgctggcatttttccaaaaatgtttggtctttttttgcctccttttagacccctcatcattgaccggaatgcctcgatggtagagggagggctcggaatttacgaaaaaaaaccattttttttgtgccaaggttggccctccaatgccctgcggtttcttctgagccaatgcgcggcaattcgtccccaatggacacacccttaaactatcaaatgctgccgaacaaaacatattacaatccgggtaattggtccataattataaagctaacaaaagcattgcgcaagttacggtactctcgagtgatggtaacttgggttacgatttattcatttttaatccgatgttttttttttgagtgatcacaaacttttgggactcggactaacttaatcccagtcaatttcgagaatccgtgctcaaaaacccccaaaattcttgacgagtcttatgacgttcagattccctactaatccgtccaatgctaatttgcccattttagctgctttggatttgttggacggatatccggccattgcctgacccaaaatgggctgctaattgctcactccgtttcgcatcgatcactaccaccacaattgcttcttgcttcggttgttcatcgactgtgtgatttgccaatttgatcagccattt

SEQ ID NO: 26410 - DNA, 996 bp, Heterodera glycines
ggatgcaattggagacctgacggacacattgttgtccgagtttgaccacccgcttcaactgcacacgccacccgacgacgacgacagcgaaggtgccctctcccccctacactcccttcccctccctctgcccaaattctgtccgtcccgggtaaatgccactaaatatggtccttttccctttcctttaccactcactttttatggcattttctcttttaatcccttcgcccccttcattaatctctgctggtcactttttatgtgctgaaaaattaattaatagcctccgtttaagagaatgtttcgtccgcggctttggctggtgccatcgttgggggagaaacgcgcagtttggaccggcactttgtcacttgtcaaagggaacggcacaacggacgaacgaagggacaaacggcggacaaagacattgtgagaaatgaatacttattaaactggactaattaaggataaatgaaatgattaatctcaattaaaatttcaaattcccatcagtaaaaaattagcttatctttttttcacattaaatgatcacattaaatattgccaaaggcacaaacatttaaacaagacattaattacttccgctttaattattttttcttcttttcagagttcgcccggtgttgctttgttggatccgtcatctctccacaattcgtcaacttctgcccaccagcgattcgcggtatttgtggagttttgaattttaacttaaaatttgatcaaaatttgatataaacccgaaaatacttttactaaattcggccgtcctcggccaatgaattggggggggggagcgaaaaaccatccgttttatccgtttcccttagcatttatccgtctctgttagcatttatctgtccgtctgttctatcgatcgatgcttttcgttgactgattaatcgcttaccaaccatttttgcatttgatcagcgaaatcactcccattagtgactaatcaatctcttaaat

SEQ ID NO: 26411 - DNA, 1180 bp, Heterodera glycines
aaaaaagttaaacaggatgaagtaaatgttgttttttacattattaagaaagatgagatagtacgtaaagtgagagaaataaagataaaaagtaaatgtgacagaacgccaattttaaccataattattagggctgggatttttgggaatcggtcgttttggcgccgccgttttggcgacgccgttttggcgccgccgttttggcgacagagtcgttttggcgccgccgttttggcgacagggtcgttttggcgccaaaaaatcagagacgcagaaataagcggcagacaagcgcctcttcaatttggtgcacaattacattccgtgaacccgaacaatgataacgatcacaattaccacattaacccaaatcaaaatcatcatatcatttttgaatttcttcgtggcgtttcgcgcaattatcatatgaacccatgaattttcttatttgtcttctttttgtttgttattgttagggccccgacttttagtgacgaaaaatcccaaaatagttaactaaaatagtgacgaaaaagtgccaaaaaagtgacaaatagtgacataatttttagccaaaaattgtgtaaaattaatttttattcactgatttcagttgcaaatgaggtacataagtactcaacatttttaaatcaaaatttgcaaagaaaaaaaaattttgggggaaaattttaagaaaattttccaattcttagtggattttttgaaaaaaaattttaggtcgattcttaagggtgtattttttgtttttattgcatttttgttaaggaattttgccaaaaaatgtcgaaaaagtgaaaaaatagtgaaaaaagccaaaaagtgaattttcactattttaagtgacaaaacgccaaaatagtgatttttagtgacgaaaaatgacgtccaaatgaaaaattttttacgcggaaatgcgttttttgagctcctttcttcaaaacaattgagcaaaaaaaaagttttttcactaaaagtcgcggccctagttattgttatttacatttttatgaaaagttttaatttttaaaaattgaaatcgatcttggattcacaattttttaattttggcttggcgccaaaacggcagcgccaggcgtcgccaaaacagcggcgccaaaacggcggcgccaaaacggcggcgccaaaacgatacagactc

SEQ ID NO: 26412 - DNA, 2504 bp, Heterodera glycines
  misc_feature (2426)..(2427): n is a, c, g, or t
caatgatattttaatgccctctttttaaaaaataacaggaaaaaagcaagaaaatagccaaaagcctaaagaagtcctcttttatgttatacttagtttgtgccaattcctatttttatgaattttttccaaggcaatgatattttaaatgcctctttttaaaaaataacaggaaaaagcaagaaaatagccaaaagcctaaagaattcctcttttaagttgtacttagtttgtgccaattcctattttatggaatttttaccaagccaatgatattttaaatgcctctttttaaaaaataacaggaaaaagcaagaaaatagccaaaagcctaaagaagtcctcttttatgttatacttagtttgtgccaattcctattttatggaatttttaccaaggcaatgatattttaaaggcctcatttaaaaataacaggaaaaagcaagaaaatagccaaaagcctaaagaattcctcttttaagttgtacttagtttgtggcaattcccattttatggaatttttaccaaggcaatgatattttaaaggcctctttttaaaaaataacaggaaaaagcaagaaaatatccaaaggcctaaagaagtcctcttttatgttgtacttagtttgtgccaattcctattttatggaatttttacaaaggcaatgatattttaaaggcctcatttaaaaataacaggaaaaagcaagaaaatagccaaaagcctaaagaattcctcttttaagttgtacttagtttgtggcaattcctattttatggaatttttaccaaggcaatgatattttaaaggcctctttttaaaaaataacaggaaaaagcaagaaaatagccaaaagcctaaagaattcctcttttaagttgtacttagtttgtggcaattcctattttatggaatttttaccaaggcaatgaagacgtaaataatgaataaatatattttaattatattaataaataattcctgtttatccaaatagttttttaaggtgcaatgtcgtttcgtgaaagtgctatgttcaagatttggcacttttactaagcgcaagcaattgttggcaaaaatttttaattcgtccaaataaatttatttcggcattacaaatgctgtcacaaatgagataatataattaatgtactgaaggaatactcgagaattcagaaaaaataaaaaatgccatgaatatcaaaataattcgcgagcattttagtctaaatgaatgtgatacacataaacgtaacatgaagcaagtgattttctccctaaaaaattcgaaaaatttaatagaccttttcttcaattagttaaaaaattttcattatttattgtttttcaaaaggattttgagtcttttaaataatttcttcattttttaaaaatttttgtaagggcagaagaccagcgacgattgatgaaatttgcacaccgcaaaagtctccaaatgcaatgctacaatgaatggcggaaaaactgatttaaacggcatttttaaatcattaaaattaatttcgcaaatatttaataacggaaaaagtcataaaatgagaaaaacaaaatcatttaaaaatgccaataaaatatgtcaatgctaagaaaagtgaatgttgaattagaattggagcaattgcaagtcgatcgaatcagtctgccttccatctttccaagaattgattgatcagacggatgtgtagccctgacgcttggcacgcgcacgcccgatcagataggcgaccagcacaatgacaaccaggccggccagacaagcgcccacaatgatctattatgggtagagaaagcaatcaggtgcaattagaggagcgagaattttttaaaaaatttacttttttttaattaaaaaaggagcatttttaaaaatttcattttttaaatgtaggtgcatttttaaaaaattgatggttttttcctgaaaaatttcttaaaatttgcaaaaaaaaaatatttgaccaaaataattacagcaaaaaatctgctaaatgccatccatacctaatgttttaggaaattacaatgggaaggaacaaatattttttgtcaggaaaaaatcgggaaagtccaagggcaggatctgttttctgctgctgttcctggattatacagtgcgcaacgaaatgatatgtttcaaataataagaaaaatttttaaaagccaatgccagttgaaaaagtatggaaataaaaaatggcaaaccggaatcaaatcggaagttcgaacatccataagacatggttcggtggctgaaaaaagttataaatttgtatagacaaaaacaaaggttcaattatgttccctcccagcgacaaatttttttttttctgaatttcttagagaggttttttatatgtattttttttctaaatcttttcttatttttttacaatgcacgannaaaaaatttagaaaacttaatcaggtttttcaaaaaaaaaactaggaaaatatctctaaatttagaaactaaaaaag

SEQ ID NO: 26413 - DNA, 1022 bp, Heterodera glycines
ctgaccacagctttttgtagagctcgagctgctctttccaatggtctattcccggtctcgatccatgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattctcggtctcgatccgtgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattcccggtctcgatctgtgccgaactcacaaagacattaagagaaattgaaaatttgtttttcaaataagggaaattgttctacaaatttggaattttctcagaaaataaaaccgctcctaaagtgccgattttttctgaccacagctttttgtagagctcgagctcctctttccaatggtctatttccggtctcgatccgtgccgaactcacaaagatattaagagaaattgaaaatttgtttttcaaataagggaaattgttctacaaatttggaattttctcagaaaataaaaccgctcctaaagtgccgattttttctgaccacagctttttgtagagctcgagctgctctttccaatggtctattcccggtctcgatctatgccgaactcacaaagacattaagagaaattgaaaatttgtttttcaaataagggaaattgttctacaaatttggaattttctcagaaaataaaaccgctcctaaagtgccgattttttctgaccacagctttttgtagagctcgagctgctctttccatggtctattcccggtctcgatctatgccgaactcacaaagacataaaagagaaattgaaaat

SEQ ID NO: 26414 - DNA, 1719 bp, Heterodera glycines
  misc_feature (1673)..(1673): n is a, c, g, or t
  misc_feature (1702)..(1702): n is a, c, g, or t
tcaaggcgatacactcattgtaccatcaggtgtgattatacacccaaattaaattccattaaataacataaaataatctaaatttataaaaattaatgttttaattgctttttaaatgatgtagaaattccttcatttttattaaatgtaataaataacggatttattccacagcaaaaatctatttccattaaatatctaaatgaataaaaaaaaaaaaattaaaatttataaaattaaaccattttaaattatttttttgaataatattcaattttcccgatttttagaaaaattatctataacactaattattttacaccaaaattaatttcatttaaataacctaaaaaataatcaaaatttacagtaattttttcacacctaaatttatttcgattaaataacaaaaattaaatatacaaaatttataaattttattgcatttgcattttacttttacataaacgaataatcaaatttcaaattcataaaaatatagccattttaattatttttgattaatgctgaatttacttgattttataaaagctcacagataaagggaattatcccaaaattgattttgcttttaataatatttgttaaacgtttaataatgaattgcatatatcatcagcacgtttaattattaataattacaattaaatgacttaataaaattaatttttaattttttacaaaatttaggcctaatattttttgtaaaaatgtaaaaaaaaaaaaaatttttttttgtgaattcaggatggattcattctgtttatacgcccgtcgattcgcttgtttttgttggcaatttcctgcacagttattcaattccaatgcaaattcgcatttcacatttggaagatcgcattcaagtgaattatatttgctagtgtcaaataatttaaaaaaattttcattttttatatttatttatgtcttagaaaaaacccattttgtgagttcctatggccccattacaggctaatagagagcaaatttagagctatcgaatgatataagaattaaaaatttgttatttttgaataaagttttatgaatatttttccgccaaaaaatttccactttttggttgttttatttgaataagcgacccaacacttttgacactagcgcctaaattgttatcagtagaaattttgatgatttattttcgtattttcagccagaaaaaaattaccgtttcccgcatttcaaacaaattttttgggctttcattgctcaaattgtgcacaaagccacacacagaatttatcagaaacaattgccagaggaagcacacaatagtcaaggatacagattttctgcgccaaaaaatgatcaaacggcaatgaattttgtcaaaattgatgatcaatggacaagggtcagtgtcaaattgtttaatgcttttatgtttttttaggtaaattatgattaaacaaatgggtaagatcatcggccccgaaaatttaggccatttttggtgtataccacgacacttactgatttgatcaaccccggcccctatttagttaacctcttataaaccccgatcccgacttttctcaccccgcagaagagtcggggcggcctgaacaaatcaaaaatgttacaattaaaatattttggcaagtacactgtgagctggataaagctgttanaatttaattgttattggaaaatttattanaagtttgatgtgatcaa

SEQ ID NO: 26415 - DNA, 1097 bp, Heterodera glycines
acgatgattgttgggtaacgcgattgatgtgagcacaaatattacaattttaggggattttttaatcaaaaaaatatataattaaaaataattagttgaaaatgattcctgcggcccttttatttttgggttgaacaggtccggttatttgcacaaaaaccgagtctaaaacttttaatcagaaatccccggtattgggttcaaccgggtattaaaaataaagaatttatcattttttacaatttctttgtctcgaattaacaagacttaataaatgttttcatctaatttgaaagcaaatcaattcggtctaaaaatatgaaaatctaattgttttgcttaagggttcatttacatttaacccaattcaaacaatttacgacaatgaggacagtgcgcaatttactgctacaaaaaattacgatattagtaagcaaacaaattattgcaattattagattttataaaatcaaacttaatttattaattaattctaagctctccagattatactaaaaaataatataatattttttacagattttcttcgttctctcccaccgctggtgatcaatgggcttttcccacttttgagatatgccgaacaattgctgactttgaagtatccggaagtaattgaaggcatcactcgacctcatcacttggtgcaagagtttcgggtgagaaaatgcattttataaatggcatttttcaaatggcatttctcaaccaagaaatccccgtacacatacatattaaggcacttcttgagaaaatccgtgaacttggtctgcattctgatcagtgattttgaagcgattcaaatgagaaatttcgagaaatgtaacagttaatttgttgctatatttttaaaattaattttaaatgcaattattttattttttcattgtattcaatttcattaattttaattttttttttatgatgatggcgaatgcttgaatgttttgtggacgtttgcgtgaatatagtctcgttgtaaaatatttttttggcaaaaagaaatttaaaaacgatttttgctaagttttttggaatttttcatttgctaaaattttttggcttttttattacat

SEQ ID NO: 26416 - DNA, 1482 bp, Heterodera glycines
  misc_feature (135)..(135): n is a, c, g, or t
  misc_feature (1342)..(1342): n is a, c, g, or t
ggcgttcgcgcccgtttttcaaattttgttgcccttggacgggcgtttcgcgcccgtttttaaaattgttggtccttgacggccgcttcgcggccgttttcaaaattttgttggctttggacgggcgcttcgcgnccgtttctaaattttgttgttcttttcggccgcttcgcggccgttttttaaattttagaacagatacaaaagtgattagaagaggtacaactgtgattgattagaagaggtacaactgtgattagaagaggtacaacagtgattagaagaggtacaactgtgattgattagaagaggtacaactgtgattgattaaaagaggtacaacagtgatgagaagaggtacaaaagtgatcagaagaggtacaacagtgatgagaagaggtacaacagtaaatagaagaggtacaacagtgattagaagaggtacaacagtgattagaagaggtacaacagtgatgagaagaggtacaacagtaaataaaagaggtacaacagtgattagaagaggtacaaaagtgattaaaagaggtacaaaaattgaatgcaatttattataaattttaaaaaataaattaattattccttttattaattaaaaagagaattttgaaatgtacaataattgaatatttaaattaatatgaaattaatttttataaacaattaaaaaaaatatgaaattctttattaaaagataattattattttttacataaattcttttattattaatttacaacaaatctttaaatataaattgatacaacagtgattagtaaattcattaaattaaaatgaaaatatttttaacaaatttaattaaaaaaatacatgaaattctatcaattaaaaaaataattaatttaaacttataaaatttatttatcaaaaaaaaattaaattaaatataattttttatttattaactcaacaaaatattttattaattaaaatcattgaaaataacgtaaaaatgcacaaaaaaataatgttacaccgtccggattcgaacctgcccccccccctcaaaatgatgcctcagaatccccaatcacacagggattctgaggtcttaacgatgtcaaaagtaaaatctgattacgtattcgtgatcagtggcccaattaacccataaagacatgtttttggaagatttttattgaaaaaaatttttcactcaaaaatcctgtccaccccctttggtcccgaatcacaaaatcacttttatttttatatctttttttaaaaatgtgataaaaatgcaaaataaaatttatattatagagaaaaaaattgcggatttttgtagtattttacttttctncaatagcttttcagaaggcagttacgaattttttttctgaaaatctaaaatttccagaaattctggaataccttttttcatattgatgttaaaaacctaaataaatcccataaaatctcctgattttctctatttttaaa

SEQ ID NO: 26417 - DNA, 993 bp, Heterodera glycines
tggcgtggtgcgactttttgggatttgcaacttggggacccgacttttggggaccgaatgacatttggggatcccgacatttggggacccgacttttagggacccgacatttggggatccgacacttagagaacccgacttttagggaaccgacatttggggaccgaacgacatttggggatccgacacttaaaaaaaaaagtttttcttacagaaaattcgagttttcagcttattttttcttttttattcaatatttaaagaaatgtttaatcatttttatccaaatatcttaaaaaaaatttttttgttaatttttccaactctgagaaattcaagaggtcgatgggcgcattttttactgcatttttgttaagaaaatttttaaataatgtcgaaatagtgggcaaaaatagaggcgaaatgccaaaatagaaaagtccaaatagaggggattcctaaggacggataggggcgttaaaacgaagaattttcgcgctaaaaatgtatttttcctgcttttcttcattgaattcaagccgcagaaaaataagtaaaaacctaagaacgagaagcccattttattagcatttttaacgcaaattttgcccccatttcgtaacttcccatgtctccatgctttgaaatgaaatttagagatatgtgatgtatggcaaatgaatatgtcttcatatgaaatgttattgttccgattagtttgtccatcgccaattgtttcacggcacattgggcaggtgttgtttttctgaagccttaattatttgtgtgatcacaacaaattagattaacattttcgaattcaataccctcaaacaaaaagagttgttaaagcatttaagtttttttttggcatttatcctacagaatttttcaactgctttatagtgatctggatcagggtggcatggtaacaacgggtagttcgtacggacaacatttcaatttgggggtccatacaacccaaaaattgaa

SEQ ID NO: 26418 - DNA, 1370 bp, Heterodera glycines
  misc_feature (61)..(61): n is a, c, g, or t
tttgtcggtgtgggtcttttgtctgtggatcttctgtttctatgccccttaacctaatgtntaatttatatttaattaaatgacgaatttgcgaatttttcttgcatttttggcaattgacttttgcctaaaatcccatcccatttcacataatttcccacttacattgacattgctccggtagtaagaaaagaataaatgcaatggaaatgtgtgaataagaaggcataattatttaattgacaattaaaaaataacttttatttctgtcaaaagataagcattaatttaggggtcatctgaaaacatttaactctttttttaattttgttatcattaattaattcgaaaaaagccaaaatgttaaattttcattatttgtcttcgacaaatagttaattttaggtaatggtttcataaaaatggaattgaggggtctgtggtgtcgaaggcatcgtcgtggacccttgcatttttaataaaaatttaacaagaatttcttcagatttacaaatttttttaaattttattatatccaaaaacttcaaatacttctaaaatcatttgaaaatttaacatcgtgattttttgaaattaaatttcaatttcgactctgataaaaatagttttcccattttttgagtttataaccctaactaactggaaaaaattattgaatgcattgttggtttgtgttcttgcataagcaaatattttggcaaatagttgctgttctttgtcctgctcattcatcgtaatttctttttcaattcgtctaattattgtgtcaatttgatttggcatttcactcaatgccatttccaaatactttgatttgccatcaatgatttccaaaaaattttcggcggcggttgcaaataaaaaattttctggcaccagacatttcagtgtattgataaacagatggtaaatatatttcacttaattttagatagaatttggctcagcaattgaataaaatattaaaaataaataaacataaattttcaaataaattttaataaatacaatttaaattttctgactttattttatttaacaatgaaaaatttacctatcaaaaaagttggttcactattattgaatgattgcttgtgttgatcaccattattggatatttgtgaagatgccccaacatgatcaacagcttcatacgatttattttctggcaaaatttgtttcattttttccaaattttctttgcttttgttttgatttttattgtcttctaaagaattatgcaacaaacattctttttcttcttccaatatttggtctaaaacttttaagcatgatagtgaaaaatggcttcacataaaaacaattgcattttcaaaatctcggcattc

SEQ ID NO: 26419 - DNA, 1133 bp, Heterodera glycines
acaattacacatgaccaatgggtttttccgccgaactctcacttgttgttgaccgatgtttcgctgatacggcattttctatcacgtataattcatccaaattcttaattactcaattaattcacgttttcgaatagatccccacgagaaattcgagctgatcgtcgctgatccgccgtggccaaatcgaacggtgaaaaggcaaagaacgtgcgtttggttacgattttgctaggtaatcctttgcatattttaaatttaagttaccaaatgttcaaagctggtcggttttctcccgacaatctttttgatcgtctcggccaccttccaattccccaactgcttgcggacgatggtcttttctgcatttggctaacaaatagcaagactgctcgtgaaatggcacaggaactgctcgagaaatgggaattacgcagattggcacaatggcattggcttaaggtggggggggggtgtaccaaatacgatacgatactatttaatggtcaacacccaatcattgaccaaaggcaacaggaaaagtggccacttggattttttaaagcgctaaaatttttgattaaactaaataattttcctaattggatctatgtaacaaaataagcattttcccggtacagatttgcaggacaggcgaacccatttgtgcctttcggcccgaacataaagtgccattcgaaagccttttgatcgcttgcaaagaatgctccgccaatgattggaaaattcctgacaacttttgcgttattaggtgcttcgaatttttcctcattctgattacaaatatttccgcagtgttccgaatgcaaatccgtcccgaaagcctccgatttctcttttgctccaacaacttggctttgttggccaagttcgcaatgggctcgaattgttcgcgcgatatttgctccccaatttcacttctgttggatttgaagcgacgaaattccaacaccaatattattttcattctgattaaatttagcattttcatatgataaaatataatttattgcttatgaacttcggataactttacgataaatgtacaatgttttttttataaatttatttgaggtattaataaaataataataacatatacctaattcaaa

SEQ ID NO: 26420 - DNA, 1405 bp, Heterodera glycines
tctttaataaacaaattttttatcacatagaaaattatcttttaaagtaaataatctattaaactaaaaatattcattatatctaaaataaactagtcattaaaaataatgaatttttcaaaagaatggttaaaataaattaaagacatatagaatagagccatcagtgataaagaacatatttaataaagataaatataccacttcataatagctaaaagtttattaattttcactaaaagtaaatagcaatattttagaaaaaagaatacaaaatataaacaaaataaaacattaaaagaatgaaaacatactttaataatcacaatatttaaaattttaattcttttttaacattataataaataaaaaataaataaatagttaatctcttataaacctaataagtttgtacatttgcaacatataaaaacgaatttataagaaaatgaaaaaaaaatattttataacttaaaatttatttatttgaatgaaaaaatattattaatgtttattttaaataaatttacttattatattaaaaacaaataacgtttattcaaaaaatttattttggtcaaattaaaaaaaccatttaagaaagataaatataaaataaagcaatgtcattctatagaaaatttattataaatatgaaaaaatataattttaatcatagaaagcaattgtaatttaaaaaatttgaaacaaaatcattacttttcaaattattatctgaataaaagaaaaaagaattttaacaatcataaaaaatcaataaaagattgaaaataaaaaaaaaattattttttgaattgattttcttaacttaacaaatttattataaatatacagaaaatgaaaaaaatacagagcttttgaaattttttcttaataatacttctaaagttgctagacattaaatgttaaataatcaaaaaaaaattcaatgatatacaatcatattaagagcttataattattatttgatctcttctgataaaaaatttaacataaaaatcaatagtaaatagggtattttagagtattataaaaacattataataagacgaaaattacacattaataatatagattacatcatatatttcataatacaataattaaaaggaaaatgaaaaataaataatgaggttaatattttaagtaaaaatagtataatattatattttttataaataagaactagagtgcaacgggaccgggaaatttgggcttaaccgggaccgggacttttttggttgaaaaaccgggactttttggctgggaaaaccggaaaaaaccgggacaaatccctgtcccggtcaaaaccggaaccttggtactcagttgtactcagttgtccgctaccaggtcccggtcccgtggcactctaaattaaaac

SEQ ID NO: 26421 - DNA, 1071 bp, Heterodera glycines
tgtcatcagttgttatgctctaaaaatgattttcggccgtttcgagtatatgtgaggtatggacggtccaaaaaaatggctatctctttttttgggaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtgaggtatggacggtccaaaaaaatggctatctctttttttggcaatctggtaatagaaatctctttggaaacaatgacagtggctgtcatcagttgttatgctctaaaatgattttcggggcgtttgagtatatgtgaggtatggacggtccaaaaaaaatggctatctctttttttggcattctggaaatagaaa

SEQ ID NO: 26422 - DNA, 1049 bp, Heterodera glycines
ggggcagtcccccccgaacccgatgcgcccagatttatgggggagaccgaatctcttcggagatagcttccctatagcctgtacttttattttgcggtggatttttgctcccccataattgtttgagtaccccaaacggacacttgaaaaaattgatttttttgtttttggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgattttttttgttttcggggcagtccccccgaaccgatgcgcccagaattatgggggagaaccgaatcctttcgg

SEQ ID NO: 26423 - DNA, 923 bp, Heterodera glycines
  misc_feature (880)..(880): n is a, c, g, or t
taaagaaacaaagagacaaacaacaccaaaattcacatcgaattgaaaatgtatgatgacagagttattaaacgataagggcatagagaaattggctggcgccgccgtcgttgatgccgctggtgtgccgttgctgctgcgcagccgccacttttgccgtcgtcgccgtgccatcgctgcctccgcaacagtcgcgtgccgtgcccattctctctcccgtccacacttttggcgcccaaaataaagatgatttgttgttaaaaatttaatgttttcgactcccgccgaaccgttgccttttggtaaatttggaaatcttaaaaaggatgaaaaaaagaaaatgcattggggatatttgcataacaacgtttttttaatttttaatttgttaaaaacatctgcagaagcttacccgaacacccagcggagaagccatggaatgcattgcgcgggtggtcggcggaagcgacgcctaatttttttgagatgaatgaaaattcgtagcattcctttttcaaattcgggaaaaatttttggttatgttaccaattttacaaaatttcgatccctgttttcgttagtaattcattaaaatagtgcctttgtcgcggtcgctgtcgtccgaaccgtcgccgtccgccgtgaccttgttgaagcggcggtgatcactgtgttggtggaagaggatgagcgggacgagctcgaagcggcggccatgatcgcggttgccgaacgagtgatctgaaatttggaatataaaaatttgaaaaatcgttagaaaatttttaaattttttctggcatgctaccccctataacaggaaaggatcgttcacaatttggtagtgtttttcagttagtacaaaagtttaatgtcctgntattaaggcaccgccaaattttacaactcaaaaatcacacctt

SEQ ID NO: 26424 - DNA, 1901 bp, Heterodera glycines
  misc_feature (1711)..(1712): n is a, c, g, or t
  misc_feature (1858)..(1858): n is a, c, g, or t
ctgggaaagctacattccagcactcaaacgggcgagaagttcagtgcaggtgaccactcgctgatgcttttgttgttgggtcagtgcatggggaacttcggcaccctttttgttgatgaagccgagctgatggaggtaattgagcactgttgtctgatggaccccgaactctgctgcaggttggcgcgaactagaacacggatgctgctgaacgtgctgctccaagtcgtccgaatcgagagcatgtggccgtccggagcggggttcatcttcgagctgctcattgccttcacgaaattttgtgaaccatcgcttaactgtagaaagagagagtgcatcattgccctcactttcacaaatatttcgaagagcttgggttggggtagaattttttcggaattcgtaaagtaacagttgtcttaggcgaattttgtccattttttgaaaatcgttcgattttgcaaaagtaatggctatacaacaaatgcaaatggccagaagatggccaaccgtccgctgattcatcccaattgcctgcctccctttttcaatctgtttagaattaaatatcattttttgcataatttgttttttcagagggtcagaacttttcatcaacccaatatgttgttgggtcatattaacttgccataggagtagcatgtgtgctaagtgattgcagttgcaaatgagctacatttcctatataaaattctcttagcaaatattgacattttttaaatcaaaaattttgtcaagaaaaaaatttgggggaagaatttttgaaaaaattttccaattcttagtggtgtatttttttgaaatttttttagatcgattcttaggggtatattttttgattttattgcatttttgttaaggaattttccaaaaaatgttgaaatagtgaaaaatagtgacaaaacgccaaaaaagtgaattttcactattttaagtgacgaaacgccaaaatattgatttctagtgacgaaaaatgacgtccaaatgaaaattttaacgcagaaatgcgttttttgagctcctttcttcaaaacaattgagcaaaaaaaagttttttcactaaaagttgctgccctagtgatcagcgaccccgaaaacttataaaaaattggttttaaaaataaaaaaaaatttatggggcgtactgcacaagtaccaatttgtcatttcctctcgtgtcgtaccccccccccccccgttcaatttcagaaacttaaaaaaattcgaaaatttcacaaagaaaatttttgaaatttttcagtattttttcaaaaaaagttattaaaatttttattatttactttatctagaaaaaatatttcttgaattttgtggtaattaaaaaacctcgaatttttacgaaacgacatcaccgcatttgactttgaagtacggcacagtggcatttgtagggaaaaattttaacgcttttaaattttgaaacatagactgactgacattcattttctatttgttatttttgcattcctcggtttttctgggatcgtttcacttttttcttaccgagaaaatttgttcaagtattaacctctgtttagtttcatttcttaatgtatgattggcttctctgctgcagtgattttttctttaattttcatttatcgcatttttggcataaaattgggcgaaaaatctttttgagctttaaaatgtgaaggacagcctttannatatttctgagttttatttaaaattattatacaattgaaatttattcgcgtgattaatcataaagcgttgctgctactcagccaatgcaattggaaccgtacaattgaagagacgattccgttcaaattgcttaatcttcctcatncttatgctgatcgtctcccccattgggcttcgcttcacaccca

SEQ ID NO: 26425 - DNA, 998 bp, Heterodera glycines
tggcaaatgcctgtggctttattttcgttgagagatcctttaggagagagcgaaagagagaaagagagagaatagagagtgaggagagagagaagagagaggatagagagagagagtgaggggagagagaaaatgggaaagaaagggaaaagaataggcaaaagggggagagagatagagaaggatagacatcccgaaagcgtaaaagcataaaaaatgaatagaggacaaaagcagagatagataaaagcatagaattcgccatctccgttgcccatattaagagaacaaagctcagctaaaaaacgtaaaaccattcctgaatttttgattaataattaacatttattttttgaatttgtaattaaaattttaaaaagttgaaccgttaagcaaaatataaagcgaagtggggaaaggtcggagacgaaagggtaagagaaaggcgacttcgtaaagatttaataattaacaacattttcaagttaatttagtgagcggacaattttttgttagatttcggcaccggcggattctctccccccccccaatgtgtgaaaaggaaaacaaaaaaaggaaaagacttcactgggccaaaattaaaaaaacgatcgatcgcaaagattttccgctgaccccccccccctcccgcccagggcattgaacatgataataataatcatcacatttattcaattatttaccatttattttgtaatccaaatgtcacattttatatatgtcctaaacaattgtctctcttctagtgggcggttctttgatcaccccctctacatttgattacgcccccggggactttctctcgatcactcttttattcatcgggcctctcccccggcagtctctgctcccgagaccgaatcgggaagaaggcctaagcattgtatccttcccccagaataaaggcgtactgttgcatactgtattaatggggaataaaggaatacaaatggccctatggtgacatataacattca

SEQ ID NO: 26426 - DNA, 1177 bp, Heterodera glycines
tcggcctcttcgcggcctcgtggtgggccttcgccccctcccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatttggtgcgtttcagagcattttgtgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccccctcccacgcccttcagagcacgacaaatatttcaacaaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttattgaattctgaaccggttgagta

SEQ ID NO: 26427 - DNA, 1391 bp, Heterodera glycines
  misc_feature (1051)..(1051): n is a, c, g, or t
  misc_feature (1380)..(1381): n is a, c, g, or t
tttttttttttttttttaaaaaaaaaaaaaaaaaaaaaaaaaaaggggggggggttttttttttttttttttttaaaaaaaaaaaagaaggaggggggggggggggggggaaaaaaaaaaaaaacccccgggggggggttttttttttttattttttttttttttttttttttaaaaaacaacccccccccccctttttttttttttataaaaaaaaaaaaaaaattttttttttttttttttttttttttttttaaaaaaaaaaaaaaaaaaaaaaaaaaaaaaaaaaatattttttttttttttttttttttctttttttataaaagaagaaaaaaaaaaaaacactctttctttttttctttttccgcgggggcgggcgggggggggggggggggggggggggggggaaaaaatttctccccgcccccccaccacaacattttttttacaaaaaaaaaaaaaattttttctcccgggggcacaaaaaacaaaaaaaaaaaaaaagtttttttgtttgggggagacccccacacagggggggggggtttttttttcccccttttttttttttttttttgaaaaaaacttttttccccccccaatttttcccccttggggagaaggtcccccaaaagctttttttttccccaaggccttttggggaaaaaacccccccttttttttttttttttttaaaaaaatttttttttcccccgttggtttttttttttggggccccccgttttttccccgtcccccccttttgggaaaagtttccccaaggcctttttttttctggggtacccttaaggaggcccccttaacaaatttttttttttggttttttttaaaatttgggttttcccggtttcgggtttttttccattgctttcccttcccgcgttcccactccttattattttggcattgctttcattccctgcagctttcttgcctctttctttccttcagttagtctctcattgctattcttctctatcatcttcgtggactcatcagatttcttctatcccttcttcacttcctnttcttcgttcgtcttcttttcatgcccttccttccccgtctcactctctgttatcttttcattgctcttcttctctgtcactttcttggattcctgatcgcttttcttcttgtccttctttttcgcttccttttccatgtttgtcttcttttcattgctctccttccgcgtctcactctctattatcttcccattgctttctttctcaggaactctctttgcctctttctctccttctgttaatctctcattgctcttcttccctgtcaccttcgtggactcatcactattgttcttatccttcttcttcagttccttttccgagtccnntgactctaga

SEQ ID NO: 26428 - DNA, 1663 bp, Heterodera glycines
aaaatagtacggcaatcttaaataagtgtcaaaatgtgtcacattttgaggaaaatttgccaaatgtttgtttggcgtaatttcaaaacatttttcatcgttaggaaagggtccgggtcttatcatcttatatttatcccccatttataccagtccgtgttattcccgggtcctatcggctcatgacactctagccccctcattagctgtcgctatagtccacctcggcacatagtcatgactcagttactgatattggccgtactccttgtcttggattcggtcaagagcatgtggcatcatcgtctcacatccctcatcccatgcgccttgctgctgctgctgttgttgttgttgctggtggtggtggtagtgttgctgctgctgcggttgttgttccacatgcacaacttgagcccattgtggtggtggctgatacgcccattccgccggaagttgcggcccaatttccaaatgctgctcgggcagaggcgggtccagttcccatggctgatgttgtgggccttgcccatgatccatgcccatcagctgcccatcatccggcgcctgttcaatcaagattaaaattcaaataataatcaaaaaaaaaagaccaaaaaaaatctcacagcgaggaccaccagcccgtcgtcctggtagttgtggatcagcccctggacgacggtatcaatttcgtcaaccaataagctgaggcgtgcacgcagttgctcacgctcgttgcgacgtctttcggagttcattttcttggggtgcgcgggcgagtgaatggaagaaataaaaagagggcgactttcccatgtgcccttgtatatgagacgggatcgtggccatctgtgtagccaaggtccgacgctgcggtgaccgatgcgaacggggtcaaattcaaataacaaagggatgtgcggcatttctgaaccggcacaaaagagaaactaatgcatcatgccgctaccggcgatgcgcttgtcacatttacgggtatattcaaacacaaaagggattcaaaaaaattaagacacacggattaatatttttaattattagaacaatatgaaatggtgattaaatgcaatgaactatttagcaaaattattagtctgttataaaataggtaatcaattcatccatccggcattgttgttatgtaccatttgtccactttcattgctgttgttgttgttgtatgcgttgctttgattattcccagtgtcaaagtgcgtgcgattgttttcgaaattgccaaatgttgagttattattagtgaagctgcttctaaagcgattgttgttgtaatcgttgtttttatttgcacaattcatgtcgctcaacctcatattaagcgaaacacacccaatgcacatgtgaaattgcacttttacccctcctaagggatcgaactcgaaagcataattaccgccgctgttgttttttgtcgaattgaacaatttttgtgagcagcaatgacaaagattgaaagttagaatatacttttttcgtaaaagtttccataactgagcgttagtattgttgacgctgttattgttgctggtgttgttgttgttgttgttgttggattcttccggcatgttttgttgaacattattaaaagtattcatttttattttgcaaaaaaaaatcttgt

SEQ ID NO: 26429 - DNA, 293 bp, Heterodera glycines
cggtgtcatctatgttactagatcggggatcgatccccttgcggccgctcgagcaggacctgcagaagctagcttgatggggatcagattgtcgtttcccgccttcagtttaaactatcaagagagggaggagagggttggggaaggaaaggaaaaaaaaaatggaggaggagaaagggtgggtggcggaagaagaaaagggtggggggagaatgagtatgatggtcaatatggagaaaaagaaagagtaattaccaatttttttttcaattcaaaaatgtagatgtccgcag

SEQ ID NO: 26430 - DNA, 1437 bp, Heterodera glycines
  misc_feature (45)..(46): n is a, c, g, or t
  misc_feature (151)..(151): n is a, c, g, or t
  misc_feature (178)..(178): n is a, c, g, or t
ttgctgaccaagtggcggtgtgtgagtgaccagcacgtcgagctnnttctcgggatctgattccacttctgcaacaagtgcttggcccctctggcgataaaatgcgtagccgggctgaatgcgtaattaatcagattaattaattgccaanttaccgattctgcccccccccccctcnccattaatgcgattaaacgctaattggttaatacacccaatttttggcccagtaatttcgattccggcacttatttttgaccaattaatggaatattgaccagttgttgttacagtaacctaccatcggatgccacggcgcaccgtacactttcaaaccgaacacctgtgacaaatggttgttttagttgttagcctataaaaaaaatatatattcttttgtcatgcctcaatttgccgatcacacaaataaatgcaattcgtgagcaattcgtacgcctaaagcaaaatagaaagaaaatatttaaaaattattctcaaaaaatttaatagtttattttaattttaagttaaaaaaaacaaatgcatgcttttgattaatcaaatcagttcgaatagtgattagcacaaaaatattaatttgttttgatatttaaattggactgagtttgatcgtcttaaaccagatgattcgttgtttggaccatattttgattcaaacagatattttcaaactgatcggatcacaagatcctataaagaccaatgtaccccttccatgtctgattgtgagtcggcactaacacgtgattgatcagatccattaaaatggacacataaatccttttgcttggattacatggtctgatcggaagaggtaattttggatcgtggtctgatcagactaggaaatgccgatttggcaaatgccatgccataccaccttgttgattcccaacatggacagcccggccaactgtcgttcgctcatctcctcgccgtcctcaaagcccagctcgtggttgccgggcaccacaattttcactttgtgtggcaatgtgcctgaagggcaatgcgaaaaatttgtgccagcctatgactcagcaattaaattttaaattttcacccaaatttcgtatttccgatgccgaaaattctccgaaatccaaaccctttggaaaaagcggtgatcaattaattatatcccatccctttgattattataatgtgttcagttttcaatagcactaatcagccgtggatcactgatcagagatcactctcgttactgacctatttgctgattgaatttgatcactgcactgacgtcgccgcattccgtgaaatcgcccgcatggatcagcacgtcactggaggagtggagagaattttttgcttgacaattatcaaaatcaaaatttgctgctggcttacccatcccgggatcaaatgcagaatttcctccaaactgaaatggga

SEQ ID NO: 26431 - DNA, 2073 bp, Heterodera glycines
  misc_feature (1974)..(1974): n is a, c, g, or t
  misc_feature (2011)..(2012): n is a, c, g, or t
  misc_feature (2052)..(2052): n is a, c, g, or t
tgattgaaatgcatgagaattgagtcccagtgactggaatgctggagaattgagtcccagtgactggaatgctggaggattgagtcccggtgattgaaatgccggaggattgagtcccagtgattgaaatgctggagggttgagtgccggtgattgaaatgctggagggttgagtcccggcgactggaatgctggagaattgagtaccagtgttcggaacgccgtagatttgactcccagtgattgaaatgagggttgactcccagtgattgaaatgcatgagaattgagtcccagtgactggaatgctggaggattgagtcccagtgatcgaaatgctggagaattgagtcccagtgattgaaatgctggagggttgagtcccgttgattgaaatgcaggagaattgagtcccagtgattgaaatgctggagaattgagtcccagtgttcggaatgccgtagatttgactcccagtgattgaaatgccggaggattgactcccagtgattgaaatgcatgagaattgagtcccagtgactggaatgctggaggattgagtcccagtgatcgaaatgctggagaattgagtcccagtgattgaaatgctggagggttgagtcccgttgattgaaatgcaggagaatgagtcccagtgattgaaatgctagagggttgagtcccagtgttcggaatgccggaggattgagtcccagtgattgaaatgctggagggttgagttccgttgattgaaatgcaggagaatgagtcccagtgactggaatgctggtgggttggtcccagtgactggaatgccggagaattggtgagatagagttccgatgattgaaatgccgagggttgtttaagaaatgacaagaaacaaaaaggccagtagaatgttaaaatgttttgcctatgtagaattggtgagattgagtccaggtgtttcgagtgctgatggattgagtaacggtgattgaaaggtcgtagaactgagtcccagcgattggtatgcagaagaatcggcgagatttattgttggtgattggaatgcaggtggattgagtgattccaagtgattggaatgccgaagaattgagtcccaggccgcgaagcggccgagccattttcggttttattattcatagctcaataatacatcgtactacctagcgggggatgcgccgaaggcgctttccccgctagttaggataaaaaattttgtatttaaaaaataaaataatattagacagcagttaagtaaaggaatttatagataagactattttcaagagaaatttaaataaattttaataggaacatattaaaaatgctcaaaaatacaataattaacctataattttaaaataattaaatttgcgcttcacagcgccaaaaaaatttttacaaggtgcgaaggataagaatctttttttcagcaaagaggtcgtgaaaaaaaactcattaaaaatgcagggaaataagaaaatacatacaatttaatacatagcagttaatttttaagaataaatttaagcaaagttaaggaaacaaaaaaagaaaacataatataaaaagaatattaatgaatatggtctattttgtgtttttaaaaattaattaattattttatttaagaagtttttcttctttcttagccaatgcaacattttatattataaaagttaaaattaattcttaattttaaaatattaaaatagaatagaacaataataccaataaaaaaatttataaagtttaataggtgcataattcttaataataataataataataatcatttttcatcaacaaaatatcggtgcgatttcagtgaatgtcgaaaacaagggtaattaaatgtgaatttaaaaaatcttaacatctataacgcaaatcttaaactaccagttctaaagccattttaatattattaaggtgcaaattaaatttaaattattaatttaattanagttttattcaaaaggtagtttataacacatctcttnnaactgatcaaattaagaaaattaatattaaattaaaatanaattactataaacgatgaaat

SEQ ID NO: 26432 - DNA, 1520 bp, Heterodera glycines
aacaattggtgtaattaaattttttatcaaaaataaaaacttctcacaaagtttatggaaaaatgtgattgataaatattattattttaaaagtttaaaccctaattataagaaagcaaacaaaaaacgaaaataaaccctgaagacaaaaaaagacataatggcattaaaatggacaaaagttaaatacaataaaaagggaaattttcaaatataaaaattcacatgatcaaaaaaggcgcttcaaatggacttacgatctcacagtcggtttggaggaggcaaaccgaggtcatcatcattaaagcgattcaaatggtcgtgctgagccaaccattcgtcgactgtgtcctcgtaaaagaaatggccgagaagagaagcgatctgaatgaaacaaactaatggcataaacacggagcattggttcatccaatggttctttttttaattttagtcagggttcggagggtttgcagcgtaaccttcccctttccctaccgtctttcggagttttctgaattcttcctccattttttccagttcattttgtgtctctttttcggtttcattactgcttatatatcgctcaatcgccgctttccatcgcaacaaattcagttcttcaatctgatattacgaattacattaggattccaccggaatcactacctcactgtaaagttcaacaccggggaattgacaatcgcagaatttgaattcaaaaacgaatggaaaagtgaatcctttgcggacaaatttggtggccgaagtcgagtgacgtacggaacagttcagaaactccttaaatatgagtaaatgtaataaatcgaaataaattaaataatttaataaaacctgcatgaattggtcggtccgttcttctcttttgttcatccattgcgaaacaaaaatcgcttgccgtgccaacgatggaatgccggcggggagaagttcacacaaaggcgtagtgtgggaatacctttgccatcccgtcaaaataagcccagtcaagcggtctttcaaatactaaaaggaaaattaagcaaataaaatagcgtactaaagcaatcgccaaccatttcattctgatggtaaagcttttggtaagaacgcaaattttgcatgtatcgctcaatgtgcacgaattgttgggaaattccgtcggcgcctttgaaggcaccggcaaaataaatgttgtcaaaaaccttaaaagaggcaaagctgaaagattgcaataaaaacacgccacttggctgaaacgttcaaaaagtccgtcggggaaataccctggccgagccacgtcgagtcttataccccccaacaacggggacaatcggagagccgagtttatattcctccggcggcgcaacaggggattttctcgaacgtgtcattccaaaccgaaacctgctcgaaaccgaattcctcctttgccattcgggcaacgctaaaatgatataattcatcatggatgttttgaaatgtttttggtaagaacatataaaaaggggagtgcctaa

SEQ ID NO: 26433 - DNA, 1599 bp, Heterodera glycines
ggggcacagcactcaaaccaacacacttttggctgtttctgtttctgttggtggtgggggatgaggccaaagttagtgacgacgacaacgccggcgggcagggggcaaggagagaaagtgcgtgcgatgatatatttgtggaaaatgcaattacacccctcttctgctggaggagaagggggaaaaagtgggggaaagaaagaggagagagagagagaagagagagagagagagagtgaagagagagagagagagagaaaagagagagaaggaaagaaagaaggaaaaagagagggagaaaagaggagagagagagagaagagagagagagagaggaattatattgtttttatttatatttttggttttcgtgaatttaagaatccccaaaatttcatggtttataaaaatttttcaaaattttaatttcacttttttcgagaattttttgcccattgataatttttttttttgtatcagttaaaagaaatcggtttttaaatgactcactgatctgattttggctataaaaattggaggagtacttctgatgctttgctattcaaatttaataaggaaaataaatgtgcttcattcaaaagaaaaaaaagagttacgtgctgcggatttgaaccaaaacactcgctcaacagagtcggcgtcagtaccaactgcgccatttgcacgacaaaaacactctttccaaaatgattcgtaaaaatttcgtggttttaataaaaaattttcaaaattttaattttcacttttttcgagaattttttgcacatttatcttcctttaactttattttaattaatttcgcacttagaataaaaattttttaccattttttgacctattttaacatatgaatgtttttcaaattggaacaatgtcaatttcctcccctatcagattgtcttttactcgatgatcagtatttccttttacttcctgagcaaaatcagcatgccggacctctaaaatccttaattaaactttcttagccaattacggtttcagaaaatcataatttattctaaaggcacacacaaagaaacattcgttgatcactgcgacaaaaagaacaatttttatgagcacttcaaaatatctccacatttcaaattggtcgatcacttcttaatatccattctttcacctctgctgatgaccgtgagttgcgttgagaagcataaaaaatagtcaattggcacgacgaattgtaacggtagattgatgacaatgatgaaactgacgggagatgaaacattggcaaaagcctaaaatacggaaatttaaaaatataattaatcagttattggtacgcactattttgaacgatgccatttttagcaagcacagacgttgacgctgaacagaacatttcaacctttgccacattgtccggacgatgtgtgaaaagccattttgccaaggcttgtccatccgatgccatggcactatgggccagcaatttggtgaagaaatcgtcacagcagatggagaaaacacgaagcgatgaagaatcgttgagaattgatgggataacttgtcgaaaacggcggaagattctgtcggataataacttgcatcatt

SEQ ID NO: 26434 - DNA, 1241 bp, Heterodera glycines
  misc_feature (18)..(18): n is a, c, g, or t
  misc_feature (45)..(45): n is a, c, g, or t
  misc_feature (70)..(70): n is a, c, g, or t
  misc_feature (119)..(119): n is a, c, g, or t
  misc_feature (251)..(251): n is a, c, g, or t
  misc_feature (1226)..(1226): n is a, c, g, or t
aaaaatcctttttttatncgagttaaaacgatgtgaatacacgcnaaatcaacgttcttccaaatccatntagcgcgagccccgggctgattaatctgaaaaggcaaagacagcgattngacaaaagtaagaaaacgtccaacttctctttaccttacaacgctcctttgttcttggatcagttgagagaagaccagctaaagaacacacaaatagccattaatcttggcacattttgatcaacactcacnccaatcgaagtcgctccatagtttcggggaaaagcgccgccagcccaagtgccgctccttgtctgacggcgcgtgggatcacagaaaggacccccgggtccgtccaaaaaggtgcgcttcgatgtccactttgccgagctgaccggcgacaatcatcggagccaagagacattctctgaagcaaagggattgttaaaagcgaccaataattcctcgcccttccctttttattgcctcgcgaggagcgaacggaacgtgcaatagtgttgcccattgactgtgaaaaggccggtgcctccgtctctgaccacaattttcacggcggaagccctcgtcttgcaaattctccagcattctctcctgccatcttcgtttatcgtcacctgcaacaaaaggacgcattaacagtttaacgtacaaaagtgagtatgccaattcacctccggtacttttgcgcggaaaagtctatttttttcacttgctccaatcccacgacgcaatgacatgataaagtcctcctcctccgcggaatttggcaattgcgaaatgtattcgagcgcaattataaaatttgcatactgaaaaaactgatcgagtcaaaaggatggggtgagggacttcgtcatcggaaaggatctcctgcatttgctgctgcagctgatccttcgtcacccattgggtgcccatcaaattgatctgtcctttctcggccggtttttctccgagaagtgccaattccatcgtttgcatcttttcaacttcgttcacttttgtctgatgtccgtcgaatgcattcacaagtttttgtgtgcgtttgtttatttccttttttgggataaataaaattaaaagcgaatggcaaattcaccgaaagcaaagaatagaatttgggtttggcagtgaaaaacagggaatgcttcggagagccggaggcgtccacgtcaatctacgggattttcgggaacacttcctccngggggtttcatcacg

SEQ ID NO: 26435 - DNA, 1200 bp, Heterodera glycines
aaaagtggaaattattgaagttatttgttaataaaatttatacagactagaaaaactttgcgttttttataaggttaatagagcatgttaagagctttcgaatgatacaaagattgttagatttagatgccaaagaaaaaagcttaagtggaaaaacgagctggcgccgaaacgggagcgccgaaacgggagcgccgaaacgcgtgggtccctcacatttatattcatgccagttcagtatggcaattttagtccgattcgagggcatcaattttttttattaatgtttctacctcgaaacatgcccattaatttataatttgtaaatttacaaacagttacggccttaaaattaaaaaaaagatcgctttgaggcattccagcagacttaaaactaccagactaaattgacccatatttcaagtgcatttaactgacaaaattcgccaccagcacacattggacagtgaactcgtgaaagcgttcgtttggttgacggatctgaacggttcgaaaaaatcttattagttgataacttttggtaaattaattcccatttattaaatattcggaaaaatgacgttaattggcactcagaataattcggaaatttattagtaatggtgctcaaattaggaaattttaccttcaggtcgcaaagagtgacgcgaggaaagtgcccactgtgctcccaagaagagccatgagttaggaagctgttcagcatctttaagaaaagcattttgacaaatatttcccataaaaaacaaaaatttcacgggactaaaatcaaaacaaaaaaaaaatattaaaaattaaatttaaaaaatattttttaaattatgccccacacggaacaaagattcaaaggacttatgatgattagggacgggatttttaggatctaaaattcgaaaataactcaaaacaacatttaggttatttagagagtaattcaaagttaatgggaaacagaataaatccaaaaatgcgttcccattaattagtttcaaatgccatcaattgcgaacactcaccgtccatccccaattgggcaatttgtcgacacccaaaaacatgctgatgaatttgaactaaacgaattttatattaacaagcaattaattgatggcattttcagtgtgaaaatgccaaaatgagtgttctcacctgaacaatgttggcgattaaatacagaaa

SEQ ID NO: 26436 - DNA, 2076 bp, Heterodera glycines
ttttcattttgtgactcttaaagtgaaacggagccgcctaccgaccccagtctgtcaaaatggtgacggacagaactgaccattccggctctgtactgctcgcccatctttgccacgtattcgccggtccattgggccgcgttttgtgtgttcaacgcaatgtattggccagttcggatgagaaattgagcgatacgttcgcttaaacattttcgtcgatatttttcaattttccttcgctttgctggtgtgctttgtaagtacctggtcctctcgcgttgctcctcgctcattctgtccacaatgtcgctgctgttgagcaccgcaaattgcttcaaggcatatacaaattcggactcaagtccgggcgccaacccgcgaggtaaaatgataccgacgaacatattcggatggtcagggcttgggttcggcatcacgtaaacacctaaagagagaattttgagcagtttaaaccaatagtaggcaaataaaaagcattttggcaaaaattacacacccaattcgttcttcagaattgccgttttgcccggttccaatgggtaggcccaggggccgacttggatgaaagcggcgggcgaagaggacgccaacggtaatgtggccgcgtctttcgcttcggtggtggcaccgctcgctttctccgtcttttgcgcttcttccggcttagtcaatttgaagatggccagcgaggagggcggagttggtgcatttgtttgatctccctggaaaaaaaagaaatgggagaccaaatttggtgacttgtcgcgattatcgcaaaccaaaaataaaatatttttggaggattttgtttcaacaaatttcagaagattgtaacccaaaaaaatgtttttattattttacttcgatcaccacaagctgaacaccgtccggcagccaatagaacagttcggcgtcggtggttgagccggcaatggcgtcgctggcagtgaccagcgaatggcgaatgttttccaccgcttgctgtagacggaaggaatttgtgtatccaaaaagagagtaacaaaaaaaatttgactttttaaaaaggtcgtagacctggacacggacaactgagtacctaggtcccggttttgaccgggaccgggaaattcccggttttctcagccaaaaagtcccgttcccggttttgcccaaaatccccggtcccgaccaaccctaatctcaacataatattaaaaaagaaaaaaaaagaagacgattcaaccccttggcccaatctataagatgatggttaaacaaatccttaaccataaaaaaattccaagagaggcacccgaagagctgtgggatatgtggctctctttattagtgggaaattatttacagttagtttattttaaataaaatttctgattggctcaaaaatttgccacatgattatcgatgacaattattttcgttattccttttatttttgttaaaaaaaggtttagaaatacttctttcgtggtcatttaaccatgagttggtggtaactcataggccgggggttaccaccaatttcgtgattatttaaccataaccacgttcttgttcccacccgattgtccacgtgcggtgctttgctgcgaatggtgtcaatccgatcggccaccatcccacggaccctctccaatccgttgcgaagtccgctcagtcgttccgtgtccaattgcagcgctttgtcccccaactctaacccgcgctcgtacattaaacatgcattgtcctaaatgagttttccattcttcgtcttgaactatactcattttgaaattttttcggttcaaagaatcacccggtcgtccacttcgtcgtagcaaaggccttgctcaataaaagcgtacgcatcggcgaagagactgtcaatgtcagccgaagccatcgaccaaagagagaaatgaataaataaaatgtaattcaaacaataacaaacagaaacagacagtaaattggcaaaaatggccttttccctcaagcaaaccaaaatttcgatttttcaagcaaatattttattccttgtaaattttggaatatataaaatgaaacatttgg

SEQ ID NO: 26437 - DNA, 2197 bp, Heterodera glycines
  misc_feature (2169)..(2169): n is a, c, g, or t
  misc_feature (2187)..(2187): n is a, c, g, or t
cagtatttgggatatttttatccacatttttgctaatttgttcggcttgtcgtcgttcctcacttatgcatttccttttttccttttcactatcatgaatactctttgctatttgaacatgggttgcacaatttggtcgtttagttggaaaatttaatttggaaaaatctaaaaaatttataactacttaattatgtaatagtggtgcgccgtgactgaaaaaacccgtgaaatccacagttttcgtaactatgaattttttgagtttattcgaatattattcaccagtttttaacaaaatcataattaaactgaaagaaataattgcattttcgcgtagcctgaaaaagttttgaaattttggttaaattccgaattgttattatggatgctaggtcgtttcttaaaaaccgccactatgggcgtttcttaaagccgccaagaggtagaaaaaaaatgtaagacatataaactcataacttcgcttaaattcaatcaaattaataattcttggtatcattcaatagcttttaatattgtctatcagaatagaaaatttttatacaaaattataaaagtttacagggatttcttcgaattatttctggcttatcctgggcttcttgttggaatggttacccactcatctgcacctccctatatttgcaacacactggtgcggagtcgttatttaaaaaaccaacaatatgatttgatgaaaaattatttataacttagctcaaaagcaaacaaatttttaattcttggtatcattcaatagccctaaatgttctctattagtctaaaaaatttcaaaaaatttcgttatgttttaaaaaagttatggccagaggaactaaaatactttgtttttcgagcatttttggccctcattatttaaaaaaccatcaaaatgggcgtaatttaaaaaactatcattatagttaaaatcaatatttcctgaaacccatcacaaaattcattactttttgaattatcacaattatacattgattttatggaataaacttttataatcatatatattcctggtattttttagcctacattatattaacatactttacaacaacaaaaaatattaatacaaaaaagattgtaaatacattttgagatgaattgcggcaaatattgattttaacttaaattagtcaaataatgttggttttttaaataacgacatagcgccaacacacttcttgctcgtaatggagcagtcccgccctatgcctcatttacgcctaatattttttagtctcgaaacatctcggctctacgattcaaatggctttgtacagtaacgaaaacttttgatttaccattctatttgttttccgataaattcaaaattttattatttcgagtgcttagatacagtaccaagttttatttatatttaagaagttattttataaatttactaaaaaacagtgtaaaaaatattgcatgcccgtattactgtgtataaatgatatccccataataacaaaccattgaatgagcctccagcagctgcagccgaagttgaagcagcattgacattttgcatattcaattcactgaccttattttgcggaagattttcaatgcttaacttttcaaattcctctgcatcttcttcttaaaaaatcattaaaaatttttaataatttactaattacctgtatacatttcattaaggtcgaataggtatttcacggctggtcgatcatttctttcttgataaaagttatatttgataaattatattttaatattaataaatgtttttatgataaattcaaatatttgtataatttaattaaataaaaaaaaattatgcgtttctttttcatacctttttcatccacagaaaaacaaaaattttttgttaatatctcgattattattaataaaaaaaataaattcatatttagaaatttctttgtgaataaaaaaattttcaaattaataattatatttaataatgtacatttttttttgtttgacgtaataaaaaaatccatatcgattaacataaagatatgtttaatattttttgtttgcatataattttttttttgctggctatattttacaaacaaattttaatatattttatattgaaaatagtaataatgctcatttaacatatcttgagattactanaaaaacttttaatttttngaattatttt

SEQ ID NO: 26438 - DNA, 769 bp, Heterodera glycines
gtgggaaaggatatctgtctacattctgtacatatatgatttattggaaataaggatttttcggttcaatccttcaattcaataaggcaaaatttagactcagcagatccacaaatttggtttttgtgcggatcaggccgaggccgtttgcacaatttgtttttgcaattttcaaatataatgccaaatgttctaaatcaaatttataatgatttccgaaaagtcggcccaattaaaccaacaaatcaatattaatagcttttcccagactaaactttagaaaatcacattcaagttttacaaataggcagattttatggtaatggtaacgatttggtgtcccgacgaaaattttttttaaatttcgtaggtcttttttctaggcttaaaaaatgtgctgatcacgaatgtatactcagattttaaacatcattgatgatttttatctatgatttttcatcaactacttgattgtttagatttttaaaattattttaaaaaatttagcaatgaatttgggggttaaaaaaatactctgatcgtgaattagagctctgattatgcatgaaccttcattttcgaaatccattaagcatcaaattaattgaattttaatataatttaaaaaattgataaaaaaagcatagaaacagcagatttttaattttgcactttttttcttaaaagtgatcagcaaaaatcaatcataagcacctgcctaaacctaaaaagataaataaaatattcactttttattacaaatataaaa

SEQ ID NO: 26439 - DNA, 1925 bp, Heterodera glycines
  misc_feature (37)..(37): n is a, c, g, or t
  misc_feature (45)..(45): n is a, c, g, or t
  misc_feature (68)..(68): n is a, c, g, or t
  misc_feature (1873)..(1873): n is a, c, g, or t
aatgagtgggttcgctcgctttcgaaagtgtctactnttcttctntaagagtgttgtctcctctgtcncctctcttgattgttgagggatgtcaaaaaaaattttttgaattttaaattcgttcgaaacacacaaatttttcaattggtggtggtgtgacttctcaagacacttaatcgctctcgagttctgactcgagaacaacagcccgagttgggtcttctcatacatactgtgtgtataccgttaccgtgtcaaatgccactactattagggatgtgtgccaacgccctcaaaaaatttcggaaattgcggcattacgttggcaatcggaagttcaacccaaaaacgttgggaaatcggcatgccgacggctcaaaaaatgccagaaatcggcatgccgacacttccctggtgactgtggttttcagtctcggattttaattttaattcctaaaaacttgaatcagaatatccagggtcccgagaaaatgtcgacaaaatccaataaaaattttatttgttgaaggagagagctgataaaaaggtcccataaattcctcattaaaaaaagttataaaatttgaaaaaattttacgatcctctctttctctctctccattttgcttgctcagttttgattatgaaatgggagtagagtgccacgggaccgggaccgggccgggaattcccggtcatccggtcccggttcccggattttgaaaagctcaggtcccggttccggtagggcaaccgggaaaaacaagcactggtaagaatggtggtctgagtgaaaaattagagatgaaaattagagttaaagggaaaaatttaaaaaatatattaatatattctttaaaagtaacactgccaagtgtgcaaatggcctagtggcttttggacaaatttaagtcagaaataaggacccgaaaaccttttggatttcacgaaatccgagaatcctctcgctgctattacataagatctaataagattttaggccttttaaaaatacagttaagtaaatgcctgtttgaatttctttcctatggaatttagaaatatttattttaatttaaaaaatagttttttgattttttagtattaaattcaaagcatttcgtattgtgggaatcggtgaagtgtaaaataaaatgctggccaaaatgaccgacttttagcaaaagttggcatttgtccctggggcaatttgttgccggccctttgggcacaaaagcattgaaaaatgttaacaatggcattgacaaattaaagaatggaaatgtggtgagaaaaattagagctcgaaattttgaaaaaagctggacttggattccgtattggacctggacacggatttcctggacaaaaacccaggaaaatccaggttatccaggcttatcatggcctgtatcccctggcatggacctggatttttttaaatttattttaaaaagcaaacaaatgattgaaaaataaattaattgtttagtaaaaaggtatttaatgacaaaaattatatttttaatttatttaataatttttgataacttgatacaaaacccaggaaaaatccaggtttccgaaaaatggcctggacctggatcgaggaaaaatctaggcctaaatccaggtccaggtcgagccctagataaaagtagcaaaaatttttagaaattttcatttaataataaaaagttggaaattgttatcagggaaaatgtaaaaaaaatgtaagtaaatcatacgaacaaatgccacttggattttacgtaccttaacctgtgaaattttggaaaatttcctaatttcttatgaaaaaaagctgtccaaaaaccaatggctcttttcatggcaaaatttgccgaaatanaaattctggaaatgtgagtgagtaagtgggtgtgtgctgctgtgtgagcatt

SEQ ID NO: 26440 - DNA, 1465 bp, Heterodera glycines
  misc_feature (460)..(460): n is a, c, g, or t
  misc_feature (466)..(466): n is a, c, g, or t
gttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcaatttttttgttttcggggcagtccccccgaaccgatgcgcccagatttatggggagaccgaatccttcgggaatagcttccctatagcctgtactttattctgcgttggatttttgctccccataaattgttgagtanccccanacggacacttgaaaaaatcgatttttttgttttgggggcagtcccccccgagcgatgcgccccagatttatggggagaccgaatccttccggaatagcttccctatagcctgtactttatttctgcgttggatttttgctccccataaatggttgagtaccccaaacggacacttgaaaaaatcgattttttatttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttaaaataatgtactcaaaacggttcagaattcaataaaaataa

SEQ ID NO: 26441 - DNA, 2303 bp, Heterodera glycines
  misc_feature (1011)..(1011): n is a, c, g, or t
  misc_feature (2240)..(2241): n is a, c, g, or t
  misc_feature (2243)..(2244): n is a, c, g, or t
  misc_feature (2249)..(2249): n is a, c, g, or t
  misc_feature (2254)..(2254): n is a, c, g, or t
cgggagtgtacacaaccaccatctttcgcgacaggtaaaagtttgaatataattattttttaaatttttgatcgctttagctacaagctgatcccgatcaagcttgccaattttgtcaagacgttcggccttgaaattgagggagtggacaacaaaaagtacttcccccacaaattcaataaggtaagggtaatttatgaaattaattaaaaaaaaatcattaaaatttaggcggaaaattacggcactgttttggacactctcccgccaatggaggactactacccgggtggtctcttccctgccgaacgcgcaaaattcgagcaatggtacgacgagaaccgggaaacagggtttgagctgaacgaagtgatcgccgactactgcaaaacaggtaaaagttctggaaaaaacatgcaaaaatattcaaaaaaattttgaagatgttcaaattctggcacatggtctggtaaaaatgcgacagctgttcttatctgagactcggcatgacatcaccgattcggtcaccatcccatccggctgcatgaagtattgggttcaattggcacaccacgacaaagagcgcgtcgccattattccacatcttggctatgagaagcgcggaaaacagagcactattgccagaaaatacttgaaggtgtgccaaaaaaaattaaatttattttaccttttcatttctctctcagtggcgtgccgaagaagagttgcgggagaatggccgagtcctccgccatgtcgaaagccctggaggggagttcaaattcggcaactacagcttggacgggatgatggagcggccggacgaggagaaaaacttggccattgaggtcaatgggtaaggaaaagaattccgaaaaggtgccaatttacccattgaaaaaggtgctattggcatggatgcccaagctgctttcccgatgatgcggcaattgtgggcggaggagaaacagccggggccctcagggcccgggacgccaaaacgaacccggntacattgcgcgggagtttgaggtcgaagtcgtttgggagtgccacttgaacgcaatgctggaggacaacacagccatgaaggcgtacttcgacaactgcccggactccggaccaattgacttccacgacgccttctttggcggtatttttgggtttaaatttgcaaaataattttgggcacaggtcgaacagggcccgaatatttgggcgcttcggtgatcaaccctgagacgggcgactggaagagccgtacgatcaaagtgaaggactttaacagtctttatccgtcgcggtaagaaatgtcggaaaaaaatgaatagttgaaaaatctttggcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtcctgccgtaccggctcaacaaccgcacgctgtttcccctctgccggacgtgttccgaaatgtacccgcgcggcttgatcgaccccgagtacaattgcaatcattttgaggactctgaaaggggtgagtttgaagcttgtaattaagcaaatattttttcttaataggcttttcgacaacagtcacacacattgagctgcaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaaattaaaaaaaattcattaacaaaaatttaagcaagcggatatccagcgtcttgtacggaggcgggcatcagcgaggaggagtcggcacggcggaagcaggaccacatcgacaaagccaaacaaaaggcccaagtccaccttgaggcggatcggatcaagcacaaccccgggctccgctacctgtccaagctgtgcctgaattcgctgtggggccggttcgcacttcggtaaaatttctttaaaaaattatgaaaaaaaaatataaaacgtacaggaatcggctcacaaaaaccgaaatagtcgaatgccattcagagctggccaaactgctcaacgaccaaaagtttgaggtcaggaacatccacccatctnncnnaaaanttttnaatcctttaatgcaaggccaaagatgagcatgtggtggaacacagcacg

SEQ ID NO: 26442 - DNA, 1302 bp, Heterodera glycines
  misc_feature (59)..(59): n is a, c, g, or t
  misc_feature (1173)..(1173): n is a, c, g, or t
ttggagattattgggacttatcagctcggtcctccgcaaacactgattcagtttatatntagaggataaggagttgaaatggtggaattccaaaaaggtgaccaagaaaattgtaatcgaatattattgacgattatcagctcggtcattccgaaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccaaaaaggtgaccaagaaaattgtaatcgaagattattggcgattatcagctcggtcattccgcaaacactgattcagtttatatttcgcgaagaatgagctgtaattttgcgaattagacaaaaatgatcataaagtaacaaatgagagaatttcacattctgctaattaggctttaaatataaactgtttaagtgttgcagacggatcaggttgataagcgccaataacctcagatttactattttcgcgaccccactttttgaattctgacattttcagctcattacgctctaaatataaacagcatcagtgttccggaaggatcgatttgaaatcgccaataacccccaaattacaatttcctactgtaaacttatacagattacatttggatataagaaattgaaatattgagaatatcacaaaagtgatcatgaaaattgtaaattggagattattgggacttatcagctcggtcctccgcaaacactgattcagtttatatttagaggataaggagttgaaatggtggaattccanaaaggtgaccaagaaaattgtaatcgaagattattgacgattatcagctcggtcattccgcaaccactgattcagtttatatttcgcgaaaatgagctgtaattttgcgaatagacaaaatgatcataa

SEQ ID NO: 26443 - DNA, 1193 bp, Heterodera glycines
ggcgaagactttcctgtcgttgttcccaggaaagtggtccattgccaccgtcggttgaccacacgcattcacgacgagaaagtgatggttagtgcttagtttttactatttctaaacaagttttcattatgacatatttggtaattggcaacaaatttaaaaaatgagtttgtttgcttttattttgaagcaatttgctcaaaactgtggtgtcccgtaaatataaattttttctgtccggcgatccaccgtcttttttatggtccgtctaacttcttaaatgcatttctattaaaataattcattgtcttttttcagtttttcgtcactgctacatacagaggctattgtcctgcccacgactctttcctgtacaaatcttggcttggcatgctgaatttgacccgtgcccaactgaacgacggagtgccggaccaagaacacccgaaaagggagcatcaatcgccacaaaagcaatatcatttggacgtaccactagaagaattgcctcagcgattaaaaatgtggattgtgccgtccggggccggcgatgtcaatgctgatgggtactttcaggtcaagcgcattgacgcacggatatgggtgagctatttgaatttatacctaaaaagcgtcacttcacagcacgttttggtacattcgtaaatttttgggcaacaaatcgtcgttttttaatttataaattaatcaaaatttcgatatttacccaatttttactgaaagtttcactgcctgtcaggtttccaatgagccggaatccgattcggatagcagcagtgtgaacggagatgccacaagcaacggcaacaacaacaaagtgccattgtcgcattccttcgcggcatggtttcacgaaatggtcaccaccttccaccattccaacatcctgtctgatgaacgaagaacgtccatacagcaatttgttgacgaactgcaacagggctttcgcaccgagaccggcgttgactcgttgcaaattaaactgttcggctccgttctatccgggttcggctccaacgactgtgacattgacttgtgcctgatcaacaccggcatcaccaagcaggaaaaagtgcagcagaacggggtcatctctcaagaggtttgaacaaaaaaatgttatgagaggggcacaaacgggaagagctcgtttctcccccggctcattttca

SEQ ID NO: 26444 - DNA, 1110 bp, Heterodera glycines
gaaagaaattcgggaaaaaaatagggttcggcgctatcattccgaaaatgtggttggattcttcagactgatgatcagaaaaagagatagacgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaagaaattcggaaaaaattagggtcggcgctatcattcggaaaatgtggttggaattcttcagactgatgatcagaaaaagagataggcgtttttccaaaattttcgacatcaaactcgcccagaaaaaaattcggaaaaaattagggtcggcgctatcattccgaaaatgtggttggaattcttcagactgatgatcagaaaaagagataggcgtttttccaaaattttcgacatcaaactcgcccagaaagaaattcggaaaaaattaaggtcggcgctatcattcggaaaatgtggttggaattcttcagactgatgatcagaaaaagagataggcgtttttcccaaattttcgacatcaaactcgcccagaaaaaaattcggaaaaaatttagggtcggcgctatcattccgaaaatgtgtggtggaattcttcagactgatgatcagaaaaagagataggcgttttttccaaaattt

SEQ ID NO: 26445 - DNA, 1254 bp, Heterodera glycines
  misc_feature (45)..(45): n is a, c, g, or t
  misc_feature (1245)..(1245): n is a, c, g, or t
ccatgggctgaatttggtccaatctggggaaaacaatcaccggcngagttcacttactggggaaatcaaacacagacgccgagaaaaagagaaatagttcactggcgaaatcactcactgcgaaatcacatttgccaaaatttgattaatacccgaccttttttagtctttacgaaaaacattttcaaatatccgttcggcgcccagctggcaaaacggtctttttggcatgccattgcccgccgacgattttcttcaaattaaattgtaaggccatgagcggaaaaactttgtgcattttttgagttattttcaaaaattttcattgaaaactttttgaattagagaaaaaagctcatctcagtagcaacttgcgcagaaaattttttatacaaaaaggcattcggacgcaaaaaatcagcaaagagagcagttcaaagacaaacaaatagcatcaatcaacacaattcagcataaaacctaaaaatgatcggtcatttctcaaatggtcactcattctgctgatcactgggcccaggagtcgagaacatttttccgtcgctttgatctggcggagaaagcggcctaaatgaagcaaaatttgaaatagatgagaagacttttacaaaaatagagtcaggaacatagaaaataactcggaccagggtttaagagatggaccagcaggacaaaactaaggactgaagccctgttttaacatacctacctagttttagtgaccttaaccgtatacgggtccgtatttttcctggatacggtttttacggagtaaaggttttccgggttttaatccgtaagtcagtagtccgtatggatgccaagtctgtaaccctggtccttatccgtattttctcaaaatcacgctctctagtttcaaccatcagtttttgccatttttaaaaaaaaattctgggaaggacccgcaggagaattttttaacagatgtaacattgaagattcacgccaattttgattttatatacaaattatacatatatataatcattagggtcgggatttctagtgaaaaacttttttttttgcccaattgttttgaaggagctcaaaactcatttctgcgttgaaattttttcatttgaacgtcatttttcgtcactagaaatcggcgggtccgtatcgttttggcgccgacgttttggcgccgacgttttggcgccgacgttttggcgccaaatatataataaaaaaaagaaaaacacccanaatttaaaa

SEQ ID NO: 26446 - DNA, 1368 bp, Heterodera glycines
  misc_feature (1313)..(1313): n is a, c, g, or t
aaacaaacagaaagaagaaaagataaaattaaataaaaaataaattcgatgaaattcagacaaagaaaacactcaacgaatttggcaacaaagtgatttcggcggaatggaaaaagttggggaaaatgcgaaagctgtattatggcattggcaatttcaagacggaccagcaacgattttacgaattgctcaccgaatgcatttctctgctgactgaaacggacacttccaacgtttagacttttagactttgttttcacataaattgttgagaatttataatgcataaaacagagtcagtgcaataatattttcttattttcttttaattttttaaccatttccaaaaacataaatatttatttacctctgaataattaaatatgccattttcttcttccattttcacagtgcataattatccgcccagatttatatgttttacccttttttcgggtaattagcatccagtgactgtcgcgaaagatgtccttttttcacttcctcagccaaaaaaaatttctgccctattttcaaacaaaatttcggaggaaaatagagagtactggttgaaaattttcaaaaatttcattttattttcccggcggcgcctacggacaaaattgaacgtgttcaaaaagctttaaaagaaaagtttttttttaatataaattagaagaaagaagaaaaattactgattttttaacaacagcttttaaaattacaaaagggttcaccagaggcttaatgcgggaaaagtttcttttttcggcagaaaggcccaggggcctttttttacttttacgagtaaaaagcgccacactatcaaaacataaaataatttttcaacagattagtaaatttacactaatcgtctgtgaattttaacatttcactgcatttactttttattttttatttttacggtatttaattttgtattttttgttccaatttctttatttttttgtcacatcataaaagagcacattaatgtgcctttagttgctcgataaattaaattaaattaacatgaaatacattttgaattattttcattttattgcattttgttgtgccatttccttaggcaattggtaaacaaaacaggaaataaaaaatcgtgtcaataattaatgttattcccatgtttaatgcccatgaaaattgcatgacagcaattaattataattaattacatgggtttaaaaagcaattagtgaaaaagaaaaagaaaaattataaatcaaattcattaaaaaagtattttttttaaattaatcagtctcctaaatgataatgttccataattnttgttgctgtctataatgacaattttatttgtccttttaaacggcacaaaaatta

SEQ ID NO: 26447 - DNA, 1322 bp, Heterodera glycines
ccccaaacggacacttaaaaaaatttttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattactgactagccaaaaggttcggtgccgtgatgaaacgaaccaacactgcttaccccgcggcacccggcacggtcccccgaag

SEQ ID NO: 26448 - DNA, 2128 bp, Heterodera glycines
ttccaaatgaaactcaaagcttaaaattttgcacagaaaaaaaatacaaaacgagaaataaataccaaaattagaaatacacctttaaaaaattgagatccctaagtgttcctctattagcctgcaaaaattttgaaaaatttgggttaaggttcaaaaaaattatggctgttcgaacaaatagttttttgaatttttatttatttgcgctcgtacgaaaacgactccgacccctccatttaataatatttctgttttgaaaaccaagctgtatcgatgaaaaagcgtgtaagaattgccccgatagattattcgaaggttgggaatttcatgggctttgtttgggttggaattaatcgagtggcgggaaaggtcagtgattatttaaattaattgaacacattaattaattatgacaaaaaaggaaacgagcgagccaccagcagttgaattgccaacgattaaattggatatacatatttatatgttgtttaaaacaaactatttcaacagctttctaacccatagaaatctttaatttttccattgaattgtttaagaaacaaaggcaaaaaaataaagaaagtataaaagaatttttggccaaaaagcagccatcaacatttttaaattgcgtataaatctcgcaaaaatgaacaaattgtttataaattagagtccggaggaactctcgactcaaattttaatttagaaaataaaaagtccacaagaaataaccaagtttgtcaggttttttgtaaaaataagtacagagttaaatcatagaatagaaatttctgcctggataaatatttttgggtggaagagacgcaccccataatcttgtacaaaattctctatctgttgcacattttgatattatttttttattatatataaaatggagattaaattattattttttgggtcatcgttttgcctttaattattattttatgccctcgccaccccatcataaatataagtgaaccatgccatctttcttcatttaactcttctgcaattacttttttgttcaataagttcccttttaaatatatatttgttaaagaattgttatttaaaaaagagaattcacaatttggcaatttgtgattttagtccctcaaaataacccggcaattcaaatgttattttggcttgttccaatttcataattcgaatattatttttactggggtttgttgctcatcagtaaaataaattcattttaaaggtttgttacaaattttgaacatgggggaaagtttattttctgatgatctgatgggcttcaatctcgatttccattttcaaatttccacaaaaaatgaactaaaccggaattttaaataatttatctcatttagtttccaattattttattgcataaaatagataaattacgaatttcacaattgtttataatgtcacaatcattggttgatctgatgaagcatttgttgagcacgggagaagacgcggatgtttattttttggtgggggacggagacggaaaagaggcgagtcttcttcaaatttgaaatttttttattattttttaaattaattttagtgaattgtcctttttttgtttgatttttacttaaattttaatcctcttcagcttttgtcagcacataaactgattttgaagcacacttctgaagtatttgcggcaatgttccgttttgatgctaaaaatgaaaaagcggaattcggtaaaaaatattaattataataaaatcaaataattaattggtaaaattgcaatgtttctggatccaggcctaagaacaacgggaaaatggtcacataaatcaataataaaaaaaatcaatcagattctactaattatattaattagttttcaattaaccttgctcattaccataattatttctcaattagcctctgctaattgccccgtggaggtcactgatgttgaagtggcagcgttcaaagtgatgttgagcttcatttatacaggcgatttggccaaattgaacggatacatgcaatggcagtgctttacgccggtgggataatttttttatttgatttattaattatttttttattagccaaaagtacacatccctggctggtcgagcatctttgcaagttc

SEQ ID NO: 26449 - DNA, 1593 bp, Heterodera glycines
tattcaaaacggaattttccatcaacagttagagtactcacttgagcaatttcgttgtcatggtggggaaatttgagatcaaatccgccggcgtgaatgtccaatttgtccccgcaaatggccccactcattgccgaacattcgatgtgccaaccgggccgacctgaacagaaaacaaattggaaaacaggtgatgtggaataaatgacatacctttgccccagggactttcccagaagggctctccgtctttggaggctttccaaagcgcaaaatccgacggcgagcgcttttcctacaaaaactgcaataaattcgacaattaattaattggggaaaaaggggtgcagttgttgcgcactttcaaattgtccactgtcacgctgagttcgccttccccctctcgcaaatgtttttctgcactttctgcatcagcatacgcctcggggaggagttttgcataggaatggttgggttttgatgcaaattgggcagtgttaaaatacacctaaaaggaataaaattgggtaaaaagaaaggccaaagaaacatttataaaaggatcactgtagagatcaaatgcattcaaaaaaaaaacttactgatccatcagacacataagcgtatccgttgcggatgatttgctgcacataatcaatgatttcgggaatgtactcgctgaccctggtcaacacgtccggctcaagaacatttaacgcattcatatcgcacaaaaattcattttcataccttaaaaaacatgactcaaataaaggcatattcggatttccttactttctggccaatttcgcgaaaatgtcgtgtttagtgaccgtatttccccgggtaacgtccaaccaatcggagagcacttccttcgcactttccaacaatttgcgcaccaaaacagtgcgaacatcagctgattgcccattgtctggctgggaaatacgcgttttgaattgaacgagatcagtctcgaatttggcaatctgaaaatttacggattagaaattggaacaatcaaataaaggcaaggcacagactcgaataatccgacacttaatttttgaagtgttcaaacgaaataatctttaaaattcggcttccactcactgaccgtatccacaaaaagttttcttttgtcggtgtcgggttcaatggatgcctttttgagataatgctgcagtgctgcttgaagatgttgttccaattcctcaaatccaaccgaatcaatgccattcaaatattgctcaaaaagaaagttttggcgtgcccttaaaaaggcaaaacaaataatttttaaatatatcattaaagttcgtttatccaaaatttaggggaatcggaaaagaaccttttgatgattttgtcgtcaatgtccgttacattcatcacatagagcacgtcgtaattaaaataatcggtcagcactcgccttacaatatcaaaggacagataagctctcgcgtgtaggcatatgggtaggaatcgtacacagtcggtccgcaaatatagcaggtctcgttatcagattaaaagaaatgattaatgttctttgcttccaatggaaaatcgcccacaatgcctttt

SEQ ID NO: 26450 - DNA, 1123 bp, Heterodera glycines
ttaaaacgaattcgttttggttggccattatgataccgaataacattcggaaattatggaaacaaaattggagaaattcgaataattttttgacttcaaattttttcccagttttcgaataattttacttcaaattttttcccagttggttttaaaatagtagtttggttcagaatttttccctctacaaaaaaaaaattataatagaattttttattattaattcgaaatcgttaatttatttgacaaatccaagacttaaaattgggagaagcatggggctgtggctgaggacccaaaatggggccccattggggaattaaatatgatttctgaaaaagtccctgaaatgtcgatttttttctttccatagcttcttgtagagctcgagctgctctttccaatggtcttatcccggtctcgatccgtgacgaactcaaaaagttatgaagtgaaatgtgaaatatgttttcaccacacgggattttttctgaaacccatcggaaccaaaaatctagggtttggtataagcgttttagaaattgcggagaaaaaagcttcgatattgagaaaccaagtcaagtccagaaaagaatattttaaaacgaattcgttttggtttggcattatgataccgaataacattcggaaattatggaaacaaaattggagaaattcgaataattttttgacttcaaattttttcccagttttgattgggttttaaaatagtagtttggttcagaatttttccctctacaaaaaaaaaattataatagaattttttattattaattcgaaatcgttaatttatttgacaaatccaagacttaaaattgggagaagcatggggctgtggctgaggacccaaaatggggccccattggggaattaaatatgatttctgaaaaagtccctgaaatgtcgatttttttctttccatagcttcttgtagagctcgagctgctctttccaatggtcttatcccggtctcgatccgtgacgaactcaaaaagttatgaagtgaaatgtgaaatatgttttcacacacgggattttttctgaaaccatcggaccaaaatctaggggttggtataagcgttttagaaattgcggagaaaaa

SEQ ID NO: 26451 - DNA, 2050 bp, Heterodera glycines
cctcgcgccataccctatcatattccgaaaagagagccaaaaattgaagaaacactgccacggcaccagcaacctcctcctgctgccccacaagtgccgcctgttcccccacctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgcacaaccattggtgcgaagcaatttgcgaacggccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcagccgaaaaaatggaaatgatcaacaccactcttgacaagctgtacaacgatccatcctctcctgctgcgtttgccggtgttagtgcactgtggaaggaggcgcggaaaaagttaaaacaactacggaaaaaggatgtacaacactatttggagggacaccgcacgtacaccctgatgcgcccccggcgggtacgatttccgagagcaaaaactgttgcagcagggttcatgaccgacgtccaagtggatttggctgactttcaagcgctttctcgtcacaatcgcggtcaccgatacctgctggttgcggttgatgttctctcaaaatgcctgtttgttgtcccattcaaaaataagaaggccgaggagatgttggaggtattcaaggagcttattgagcaaatgccaatgatcccacaccgtatcttctccgacaaaggcaccgaattcaaaaacaaattgctcaaggaattctttgaggagcatgagattaagaagcatgagcccgtgcattcgtacttacaccccgcttccgtaaagatgaatttgtgcacatgagcagagagaagggccagttcgagaaggggtatttgccaaactatggagacgaaatcttggaaattgacgaggtgctgaaggcggtgcgccccatcagatacaagctccgggatgatcgtggtgaaaaattccggggcaccttttatgagcaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataaaagcgtttgaatttttgtgtatttctcatcagttgaataaatccataatgtcaaatagtttctttgtgtttttgcctagcaatgtgacggattatccggacaatcagcctaacaaattccgggtccggcttccaaaacctttgcatttcaacgggtcttgggtgtgtgggctgcacagcattagctacccatactcgtggtcaacaattggtacattggatgagcagtggatagacatccacttcacggatattggggttcctgaagaagacaaacaccgcatcgtacgcgtgccggtcccaaggtcttcacagaatcgagttgaacagctgagagactttttgacgacaacgctgagaaaccatgccaatgctaaactaaagccactcccgcgagaggaagaagcggaccgtaacaggacaaaaccactttactctccgccgcctgcaaaacgtgcccggagatctctagcgctctcttcgcctcccagacatgaagaagctcctgcacgaccactttgatcgcctcctttgtatgacgagccaaagctgcaaaaaacacaaaaaacacccgaaa

SEQ ID NO: 26452 - DNA, 1567 bp, Heterodera glycines
ttgccattttcatccgctttcatcatgtcttttattacccccggcactttcacgttccttttaaaagactatggggaattttcgactggacattttgacccaaacagagcatacaacccaaattcacttgcagacctttcgtaatggcatttattttgcttccattatctttcattttttctttgtagtcaatggagaaaagagtttctggacggccgatacggatccaaacaaccaacccctccttccacccctcgtgccccatcacccagcttcccaatcccggtcattgttggtaattttaatttgttttttggattttgcaaatatctatcttggcaggaaatcgtccacaggatgaaaattgtttgggtttccacaaatatcttgtctgattttttctattttagggcggcagatgttccccgatgacgatgggtacgaatcggaagatgatgaaattctcttgccacctccgccgatccccccgcaacttggccaccctccaccaaatgttccggtaatttcggtttcgcttttcgttgctttttctcaaatttccgagtgcttttttcaggcagttcgtgttcaaccaatgcatgttgggcagcagcggctgccgctgagagacttgccacaattcgaggaccatccgcaaaatgtgccggtaattttgggtcgattttcgctgcgttttctcaaatttctgcgtgcttttttttcaggctgttcgggtccaactgatgcaacaaccattgccgctgagagacctgccgcaaattttccaccctccaccaaatgtgccggtaattttgggtctttctttcgattgctttttctcaattcccgagtgcatttcaggcaattcgtgttcaaccaatgcagcaacccgtaccaatgagagccgtgccacaattcctccaccctccgccaaatgcgccggtaatcttgagtctcgttttcggttgctttttcaaaatcccgagtgcattgtttttcaggaaatgggtgtgggaccaattcatgatgggcaacaaccactaccactaagagcgttgccacaattcgcccaacctccaccaaatgtgccggtaattttggctcgtttttttttgttgcttttttttaattcccgaatgcttttttcaggccgttcgtgtccaaccagttcaacaaccgataccactgagagacgtgccgctatttgtcaacccaccaccaaatgtgccggtaattttggctcgcttttgttactttttttcaagatcccgaatgcattttttcaggtaattcgtgtccaaccgatgcctcaaccgttgccgctgagagacatgccgcaaattcaccatccaccgcgaaatgtgacttcaattcggatcaaattgtggttgctttttctcagtctctgggtgtttcttcagggaattcatgttcgacaaattcaacgggaatacgcagtaccgcaatttgcccatccgccgccaaacttgccgtatcatccaccagaaaacgttccggtgagttgggtcatgtttttcgtgcgttttccgtattttcggatgctttt

SEQ ID NO: 26453 - DNA, 1108 bp, Heterodera glycines
  misc_feature (27)..(27): n is a, c, g, or t
tttttggtgtttttatgattaaagatntaaagtcgtataaaagtgattcgaacatttacagtagagatcggaattctcaaacatgccggaccggaccaggctgatatttcagaagcagccggttttcggggcccgcctcccccccaaacccgtcaaccggaaaagcgctgaaacctgattctcaaattgccgggcccggaaccggtttggtaaaaatttaaaattctcaagtatttcgaccccaaaaatgaccaaaaatcgtgccaagtagttaaatttcggctctttcatcataaaattaaaaaatcgcttaaaaaaatttaaaaaattttttaatgaggttttgttattaaaatttttttattttttgaaattcttttgaaaattaaaaaaaaatttcgaaatgaagtgagtgcataccagataggcaccaacgtgaaaaaatttttatttaagtgatttcataaccttttgcaaaaaaaacgcttttggttttagattaaatcttttgccagaattgtgtggattcttgggacacatttctatagaatttaccgaaaaatttgtaaattgaagatgaaaagcaaaaaaagggcttgcttagccgggtccactgcgtttcggcgctcgcgtttcggcgctcccgtttcggcgccagcatatggccacgcttaactgacccagtccggccaaagtaaccgtgcccgaaattgaatctccccatttttagtttgagtttgtcggtcactgcaatattcgttttttctaattttgttatatttgaaaatggatgataaagtaattaaacttgcttctccctaataatgtagagcatagtttagttgctgttgtattttcggcttttttggcatcggtatcaaaagttatcagaaaaaatctatcaataagttgtcaaaattttaaaagttcaaaacaaattccaaatgatggtaggagccacaaacttttttaaaatgacctgaaacaaaatctcttattttttggtgtttttatgattaaaaatttaagtcgtttaaaagtgatttgaacatttacagtagagatcggaattctcaaaaatgccggaccggaccaggctgatattttc

SEQ ID NO: 26454 - DNA, 1347 bp, Heterodera glycines
aaattttaaaaaattttaatcatcttcccttttgatagaataagcatcagagagccttatttaacttgtaaatagaatttggtgcgtttcagagcatttctgaaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgtaaaattatgagtgattgaattttcactaaaaagttaagcctaaactttttgactgtttaaaaagtaattaaaaattttaaaaaattttaatcatcttcccttttgatagaaaaagcatcagagagccttatttaacttgtaaatagaatttggtgcgtttcagagcatttctgaaaaaaataattatgaattaatttttcaaaaaattggaaaagtacgcaatattgcaatgtctaaaatttttaaagaaacattatgggacagttaaataattatatgaataagcattcttctcagctgttaccctgcaaaacctggtgcgcttctgagcactactcgaaaaatgagtaaattaattttcactaaaaagttaagcctaaactttttgacttgtttaaagaggaattaaaaattttaaaaattttattcatcttcctttttgatagaaaaagcatcagagagccttatttaacatgtaaataaaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgtaaaattatgagtgattgaattttcactaaaaagttaagcctaaactttttgactgtttaaaaattaattaaaaattttaaaaaattttaatcatcttcccttttgatagaaaaagcatcagagagccttatttaacatgtaaataaaatttggtgcgtttaagagcactttctgaaaaaataattatgaattaattttgcaaaaaattggaaaagtacgcaaaattgcaatgtctaaaatttttaaagaaatattatgggacagttaaataattatatgaataagcattcttctcagctgttaccctgcaaaatctggtgcatttctgatcactactcgtaaaattatgagtgattgaatgtcactaaaaagttaagcctaaactttttggcctgtt

SEQ ID NO: 26455 - DNA, 1366 bp, Heterodera glycines
atagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccattttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaaaacacaaaatttgtttttatttgccccccaacatccgcttatgacgggccgaaagaaaatcaacaaaatttggcaccggaaaaactccattttttt

SEQ ID NO: 26456 - DNA, 1667 bp, Heterodera glycines
taaggaagtgatttcccactcttaatttataaaatcaaaaaacttcaaaaataaaaaaggaatcgaaaatttgttaaaatataaaaaggaaacaatcaaaattacaacatttgatttaatttgaaattttattacctcaatttccactcgaaacacaaaaaagattttgttgataaatgatttgtcgcccatttgcatcatatgcttcagataatctttcaacgttctttccattgtttccatttgatagggttgaggaatttgctttaacaaaaacttttcgtcttttgtacgataaattttgtttgagcttttccctttgatacccaggtcagctaagtcatccgatagaaaagattcctaaaaattttatttaaaaatattttttaccatttataaaacaataaattttttcggtcttttaattgttcatagtttcaatcgaattttatcattaatgtgtttaggatatgtggataattaccgctaatttcttgtaagtaattccaaatttctcccgcatttcgcccattgcttcttccgcataaaattgaacatcgtccaccgttgtccaatcaaatttgcaatttagctttttgggatccttttgcttgtttttttcattttctttcatgtttttgcaaatatatttgcccaattttgcttgaattcgttctttatcgtccattttaaagtgcgcatcgtctttcatttcatcagcatcagccaatgccaaaaattcaatgcaaatgttgtcattttcatctttcaaatggcaaaatttaattatatttaatttaatttatttttaaatcatatagtgaattaaataataaatcaatattttcgttattcacctgtcatatcaatttctcttggcatcagttcaatttcttgcccttcgaatttgtgccatttcccaattggcactttttcatctggcactttctcaattggttgcacgttttcatctttttctttgtataatattccggccgcataaaagttcaatttgccgaccattttttctgcgtcaatttcaacaccaacaaatgcacctccgtcaagtgcgacttcttttcgtgccttacttgtttcacctgcgatctctggtcgttttccaacgttatttggatatctgagttttcgcatttttaatctacagtttaacctattagtatttatgtaattttaaatgttctaatgaatgatgttacaataacgaaacaattggcaaaatgtttggcctcgggtgggaatcgaacccatgcattcagccaatgtacgtgggcaattctaccattaatcagctgccaagtcccacctgcccttctggcattataatgccacgcttttcgcgttttaaccggatcctttttgactgacgtcattaattaattgtcttccgattcccctccaatttttaacaatacagcaaataattacttgaatttcacatatttctcatatgcctccggaaaccgagttgggttggcattttttgcattttccatgcgcgacccggcacctgacacaatgtatttggtgttgatacggtaatagctgttgctcaggtcgacatgcttcaggctgtgggaatgaccagcaaaataggcttgcactttgaagaagcgcatcagtgccatcagacgcggagcgcacggaaa

SEQ ID NO: 26457 - DNA, 2105 bp, Heterodera glycines
gggaatgaagcgagttatggctgatcaagtgtgatcaaaactaaacaacgaaaataaggcactgaaacataagtaaatattatataaatttaatttatcattttattatctctaaaaaatatctattggcttttttgaagtggattggaagcaatggcctctgattaggaattttatcaatcataaagtcactttgttttcaattgaatgcattggcgttttgttttttacgccaatgaccttttgccgctttttttcttccatgctcctccagactcctcccaattaattaattagtatcaattaatcatcactaattatcacccccatcccatcggtcggcaacttcaaagggctgcatctctgccatagtatttttcgttccccccctttttttttgcatttttttgtttgtataatttgcaacaaattttgttttaatacataatattaatttttgttttcatttcaatagaagcatataatgtctaaccagaaacaattgtttttattcgatgggagtggacttcttgaaaggtttttttttgaggggggggggggggagggtttccatgactttgttacattttcggtttcccagcattttatgaaaagaaattttggttatttgttagagcttttgactcataaaatgccaatgaatgaactgcgaaaaacgatgccattgaattaaacactatttaaaattgccaaaatcatttaggacgaatgaatgtgcggacaaacggaacaaaagtgagcagcaattgacctctacacttcaacaaatcccagcggaccaaatcaaacaaattgcggtcggctcaacacacgtcgcttttctgttcacggttttaatttttgggatttttaccatgttcatttgagggccaaagcgggtcttaacaatgaactttttcgtctagtggacttttgtggggttttactttgcgaatttggatgaaatatgggaccaaattcgggttcgaatgcagaaaaattttctggattttacgcgtcacttgaatatttatgcgtaccaagctcacgaatttcttgtattttactgaattttgttttttccgtccaggataacaccattggacgtctcgcattcgaacttgtgaccaatgttgttgagacttcagctgcaacggacaaaagttagttgtttgttgctttcatcctgttaaccatgaccaattttttgaaaattccaaacaagccttggctcaagaaacaccacccattttaactatttttcgaatcgaactcgtacaaaagcaaaatgatttgttgatttgaacaatttttggcaatggtgtggaattgcggtcccgacgaaaaaaaatgttaaaaatttcgctagtgttttttgcccaatttttcgcatagctctcaaaaatttttagtgtaattttaatcctaatttttgactatggcgtgaattaaaatttaaattctgtttagacgagccatcagccagttcagcccggaattcgggcgcttcgtcaaccgatccggtgtccgctgctgcacaggcggctgtgaacgcggccaatcggacagcgaaaatcagggttttttcactattttaaaaaaattttttatttttgttcttaaaaatccttacgtgtccacgacttgcatttcttgacagggtaccattttggtataaaaatgttaaaaaaaatcaaaattttcccatggcacggaccaaaaaaaaaagagttcccgccggggctagaattcaatcctggtaccgtccctgtgtctcttggacgaagacgacattaatgcgactctgagaatttcctggacatttttaatatattccgtttttccatcaaaatgtctgacaatgagcgaattatttgttacttgtcaattttagatggttttgcaagacaaatcgcgagatgtgattgtgcgtgagttgcaacagaccaattttgatgcgaacgaggcggtgaacaacttgttgagccgggacgacgacgaaatggaggacttgggcgagacgtactgcacgttgggagttgttgtccttgctggacgccgggctgcgctctgatggtgatacgggtgcatttacatgcattttt

SEQ ID NO: 26458 - DNA, 1568 bp, Heterodera glycines
  misc_feature (1442)..(1443): n is a, c, g, or t
  misc_feature (1453)..(1453): n is a, c, g, or t
  misc_feature (1478)..(1478): n is a, c, g, or t
  misc_feature (1505)..(1505): n is a, c, g, or t
  misc_feature (1515)..(1515): n is a, c, g, or t
  misc_feature (1532)..(1532): n is a, c, g, or t
ttttctcccccagtaaacctggggttgtttcgacgctgttccatagcctcgactgggtccagaatgtacaactggccaaagccaggaatctgagttgtaccagcctgcatgctgcttatgcggcgatggaattctccgttaagaataacggccatcggaccgccagcagggcttggtttgttgccagcggaaacgctcgcaaattggaacaggttgttataacgcgacatgtgtcgcacaaattcttttccttcacgggattgcttattccccacaatcagctctttgagctcatcaggatgcgggttaagcattggcagcacaactcttcccttccggcagcaaatactactgtcttcatgtgagaagagatgtgcaccgcaatcggcgcattttttgtcaccgagtttcccggagtcacaatattccgggaaatgtttggctgctgctgcagcgcattgccaccccttgtgaaatgcagagcaacgccgtgtgatcggcgttgccactcccagcgaatttgctggcgggggacgtttcggcgccggtgaaggcgaacggctaacagaagctgaaagccttttttgaacgcgcattgatcgccttggtggcgtcttaggtctgatgaaaattacatcatcagcctgcgcgattggttcttgctggacaattgtgtccgcaacaacaccgtgggtgtcagcttgattttcgccgatcactggtgcttgcgcaagaacagcagtatcttccgaggaaggaagcactgctgaatcatccacttccattggcattatgaccttggaggaagtttgcgctacatccccattgtgatgagacacaacagcgaaagatgttgaaacaccttcccttggatgaaacggcacaatatcagagccgtaaagctcatttatgtgccataaaatgcgcttcttctcataattgatgttcaaatccggcagaacaaaagtgcaattgttcataagccaggattcagcatacaggcacacaaagtacccgcagctatttccatcatgttgtaccgtaagatttaccgcattaaaaatcccggtcaacactgctgacggcaaaatgtcagaaatgatctttccaattttatccgtcagttgccaatccaacctgccatagggggtaggcaaagaatcggcaaaatgagtaccccactgaacatcatggacaattagagtccaatgtccagggaaatgcactggcaaaagtatgacttctgccggaacattagggttgtacccaaatgtcatatttttgtaaggcatgactctgtccaagccatttctccataccattgggtcaacaacgaccacttttcgttgtgaaatgctagccaaatatgctaaatatgtggcagcaaaaccgtcattgagaaactgagtcagatcattccaacaggtctcaatgtatcttgnngcagagctcngggcaagcgatgtttcgccatcacngtcgtaaaggccattgctgcccatttnccaatttacnagcaaattccgcgtggntgcgaaataatttgcactgtgctgaaatttattttt

SEQ ID NO: 26459 - DNA, 1078 bp, Heterodera glycines
  misc_feature (28)..(28): n is a, c, g, or t
tttttctatccttgtggactgagtcgcncctgaaatttatatatcagggaacccaacactttcttggaatttcccagtacgggtttgtccgtgaaaatttgaaaaatatttccaaaaatccctatttcttttttctatccttgtaaatttgaaaaatatttccaaaatccctattttttctatccttgtggactgagtcggcccttgaaattatatagcagggaacccaatacttccttggaattttccagtacgggtttgtccgtgaaaatttgaaaaatatttccaaaaatccctatttcttttttctatccttgtggactgagtcggcccttgaaattatatatcagggaacccaatacttccttggaattttccagtacgggtttgtccgtgaaaatttgaaaaatatttccaaaaatccctatttcttttttctatccttgtggactgagtcggcccttgaaattatatagcagtgaacccaatacttccttggaattttccagtacgggtttgtccgtgaaaatttgaaaaatatttccaaaaatccctatttcttttttctatccttgtggactgagtcggcccttgaaattatatagcagggaacccaatactttcttggaattttccagtacgggtttgtccgtgaaaatttgaaaaatatttccaaaatccctatttcttttttctatccttgtggactgagtcggcccttgaaattatatagcagggaacccaatactttcttggaattttccagtacgggtttgtccgtgaaaatttgaaaaatatttccaaaaatccctatttcttttttctatccttgtggactgagtcggcccttgaaattatatagcagtgaacccaatactttcttggaattttccagtacgggtttgtccgtgaaaatttgaaaaatatttccaaaatccctatttcttttttctatccttgtggactgagtcggcccttgaaattatatatcagggaactcaatactttcttggaattttccagtacggggttgtccgtgaaaatttgaaaaatatttccaaaatccctatttcttttt

SEQ ID NO: 26460 - DNA, 2443 bp, Heterodera glycines
cttgggtttttagcttcccataagtcatgctcatcatcatcactttcaatccgtgccatccctttcttcttcttcttcggcacttttccacccacgcgtgccgtccgtccttttcgctttgtgccgtttttctttttgctcctttcattggctattatttacttgtctggcccaatttttcttcttttctctgcaaaatttccttttctttttcctttctttcttttttatacgaaatgatgtgtgactttcttcaaagaaaaaatttaaaaacgaagcaaataaatcaacactctctctttgccatcgtttctttgcctctctccctttttcattttttctctctcttctttcccccccccccctctctctctctttctctctcttccttcgccctttctctctctctctctctctttcttaaaagccgatggtacccaaacttctcacttttcccaccacctctcacccgctcgccgagggaacgctgtctccgatacgcttttatgcttttcctgcgcgttggcttttgtgcctcagggcattttgtcttgttctctgtccctttgaagccgcgggtcatacacacggctttacactttctctccccttccgcttctcttcctgtcccatttatttataatttacgacttttctcacttctctctgctgcccaccccatttggcccacagatatcgacgcgtttattatttgtctctccgcgttgcccggcgtttccggcaaggcacagtcccctctcaccccctccctttcaatgcttggccattctgctgggccgggtaagaaagttggacggatccctccccttccccccgccctccgacagtgcctttttttgccgccattcagaaacaaatgggtgggcgtcgtcggtggacggcacggggggggaggagtgccatttgaggaaaagccattcccggcaattgttgactgtcgttgcctttcccccagcggcggatgtggttaatttgccccccccccccctcttctcgtcatcttcctcttttcctcttcatatgtattcgtcgcccgttgaagtgccattccgtccattgaagcggataatgtgcttcgtaatattcacttgccattttcgattattcttcggcacttttccctttttcgtaaatttcaaaatttattttttttttttacatttctccatttttatttttgttccctgacaaaatttgccatttgaaaaaatatatttttcttttgcctttgaatttctgatggaaatgtcttcgctaaagcattggccaatgaatgaatgattaatgggttcctttcttcctctgatcactcactgtcatattcattcaaatcaaatctcttttttcctgtaattttgaatttatttaaatttaaatttaaacaattcgatttattttcttaggatttcctttttaaggcaattctttcgtctttaattggttttttaataaaacaatttctataatgcttaaattaattaaactctaaattaattagttaaagtcattggtgccataattcttcataatattattcgtcaaaattggattttcccattgttttttttgtttatttttggtattaatttaattcatattcaaatgccaatgttattcgcgtgccgtgccgtctttcacatttgaatttgcccattttagctttggtttggcagggtgttgggaggtgatttggcattcatttcccatttggtcgcactttttgctacaaattcattttaaaatattaatttatccttagcctcctttttggagcaacaactataatcacttttattcagcgtttgtttcatttttcattttgccattgcttccggcctcccaactcatccgtcataatccctcaggaaattaggaaatctctgttgagggagtccgaggcaacaacagaaagaaacggcaacaaaaacaacccttggcaaagcgttcgttggcattttgccttttcgccgtttgccctttcctccgacatttctcttctgctgatgaatgagtgagtgctgcttcgtcttcgtcttcgtctccgtcttcctcttctgccactgcttctgatactgctccgtcttttcttttccttttgctccgctgctgaacaaaaatcacaacgacgcctcacatactgaaatcggcagaatcgttcactttgtgtttcggcaaaatgggctgcacaatgagtcaggaggaacgggcggcgttggaacggtccaaaatgatcgagaagaatttgaaggaggactttgtgcatgtgagcaacagaagaacaagcggaatagggagagaagccaaatcagtgaaaatgggaaacaaaaactgatcaaacggagcaaaaagaaaaaagaaaaagcgattttggaagaatttcgaaagataatgacaatgaatgtgcatattggaacttcatttt

SEQ ID NO: 26461 - DNA, 1841 bp, Heterodera glycines
  misc_feature (37)..(37): n is a, c, g, or t
  misc_feature (61)..(61): n is a, c, g, or t
gaaaatcacatcagaagcattgaaccattcgcatttncgcaaaactcgagcatagtaatgnaaaagcacaatattataatgtgattttctgcccttctcaggccgttttgatattggaacagaattggatgaccgaagtgaccaaagacaactttcgcccgcttaaacagcttcagcaactgtccttgaaaaacaacaaagtgagaagcagcaggcagcactttttcgttttaaacatttcccccgcccaattcgatattaattgcttttcctttttaattaatttttccattcgtttttagctaaggtccgtggacgtagcggcctttcaggccaatccatcgctggtgatgttggacttgagtcgcaatgagctgattgacctgtcgccgggcactttcctctcccaactgaaccttctcctcgtcgatttgagcttcaacaaaattgtcagaactccgttcggcgcttttggccgtcggattgctaccgtattacttcaaggtaataaaataataactacagtatacgcaactaataattttgtttagaaaatcctttggtttgtgtggaacaaattcatatgctccaacagggaaacggcgtgttcattccgaacatcgaagacaaaatctgtggaaaggattcgacaacaaaatccacgacagtttcggaaattgaggcaaattaaaagcaattacctaaaataattatgaaatttatttcaaatttaacttcctttttaagtcactctccgccgatcaaatcgaagacaacgcatcggaggagacggaagcagcagaagaatccgcatttgttcagcaacagagcaccacgccgcccaagggatcgaccgaccaatttgctgagacaattgaaacaacgatcaatggccataaaatgggcaaaatgccaaacatacgcccaattcaaatagggcacaaacaacggcaaaaggcggcaacaacacaagtaaatgccgtagttaatttggctgtaataaaaagcaattattgcttttaattattaggtgccatctgccgatggttttgttgctgaatcgtcgccttccgccgaattaactgagcaaaatgccaaattaatgcagcagaatcagaaaaacaacggagctgaattggaccaattttcacttgaaggaaatgaaattaggcaccagcaaagaaaggacagcaaagtaacaaaagtcaattcaattaagctaaattagcgttaattatttattatttgtttaggaaataaattcgggcccaattcctctcaacgaaaaaattgaaaatggcgaaggaatttcaaaggtgagagaccgtaccgctgaaactgagtcacagactgcgaccgatacggtaattggagaactgaccgatgctccctcgtcgactacggtagacccgcgcaacgatccggccgtcatttacccgcacccggtcccatttttggccactgggccgaaacttcacacggcacacagtgtaaaaagaattttaaaatgtatacagtatttaagaaatattatttgctttttatagataaatagcgaagaaaatggcagcaattcgatgctgactttgccgccgaacattgttatggcgggaggggaagaagaacaaagtttgtcgaggccaactgaggacgaaaacgaagcggcaaaaaagggggaaaaaggtgaaatcgaagagaaaagcaaataaacaaatgccaaatgatgacacttaatctaattagtaaatttttaagaaaatgggcaaaacttcgcaaatatttcccaattgaccaaagaaaatggggaggacggacagaaatgggaggattccaactgagga

SEQ ID NO: 26462 - DNA, 1329 bp, Heterodera glycines
cagaaaaaacagtccagccagggctaggagttttcttgggttttcagaaaaaacagtcaagccagggctaggagttttattggattttcagaaaaaaaaataggtccagccagggctaggagttttcttcgattttcagaaaaaacaggtccagccagggctaggagttttcttggattttcagaaaaaacagtccagccagggctaggagttttcttgggttttcagaaaaaacagtcaagccagggctaggagttttattggattttcagaaaaaaaaataggtccagccagggctaggagttttcttggatattcagaaaaaacagtcaagccagggctaggagttttcttggattttcagaaaaaaataggtccagccagggctaggagttttcttcgattttcagaaaaaaacaggccagccagggctaggagttttcttggattttcagaaaaaacaggtccagccagggctaggagttttattggattttcagaaaaaataggcccagccagggctaggagttttcttggattttcagaaaaaacaggtccagccagggctaggagttttcttggattttcagaaaaaacagtccagccagggctaggagttttcttgggttttcagaaaaaacagtcaagccagggctaggagttttcttggatttcagaaaaaaggcccagccagggctaggagttttcttggatattcagaaaaaacaggtccagccatgggtaggagttttcttggattttcagaaaaaacagtccagccagggctaggagttttcttgggttttcagaaaaaacagtcaagccatgggtaggagttttattggattttaggaaaaaaataggtccagccagggctaggagttttcttggatattcagaaaaaacagtccagccaaggctatgagttttattggattttcagaaaaaacagtccagccagggctaggagttttcttggattttcagaaaaaaataggtccagccagggctaggagttttcttcgattttcagaaaaaaacaggtccagccagggctaggagttttcttggattttcagaaaaaacaggtccagccagggctagtagttttattggattttcagaaaaaataggcccagccagggctaggagttttcttggattttcagaaaaaacaggtccagccagggctaggagttttcttggattttcagaaaaaacagtccagccagggctaggagtttttttttgtgttttttttaaaaaaaaaaaagccaaggccccgggccgggggggtttttttttttgtttttttttaaaaaaaaaaaa

SEQ ID NO: 26463 - DNA, 2554 bp, Heterodera glycines
tgaaaatcagaacaaatataataaatatttgtagatcgactttttaaaatgaattttttattcggtaaagccgaaaacttaaatgtgaaaaaaatcagaatatagacttacaaataattcatgatagaaatgattataaaaggaataagggaaagcctatttttatcttcattatattctctcggttctaatgaacatcaaggaggccttgaggccggaatcggcacgcttattcaatcgcaaattgcgaaatggccgaaaattggctttgctctgcttttcaacaaaataataaatgacaaaaaggataatgagcataaaattatgaagtttcaaagaattagaagcagcacataattctggaatgatatttttatcatttaaattaaataatattcatttttacgggttttaacactctacaataataataaatataaaatttataataactcaacaataacctaacaaaaaggaaaccaataaattaaatgataaactgaattaaaatgaatttattgttccggatcgacagtgatgaatattttactttcgatcagatacttacaaagaaaacatatatttcaataattaaaaataatgaactcatctgacaattcaaaaagtaaattgcgacgtggaacgaacaattctcgaaacaaacaatttcatattcaactttaacataaagataaattgctcaagcactgcaaaaaagaggaaataaacaatttcaaagaattgttttaagaaatttcaaaattacaactaaacaaataaaaaataatcttaaaaatcagtaaattaagaaaaaaagtaatttggttcattgaatctattagtacaatttataaaaaaataaaagaactaagaaatttaaaataaaatttggacttaaaatttcgatttagctttgattctaaaacaatcgattacaattttcgttctaagtatttataaatgaatgaaaaataaagaaaaaatttccgaaaaaaaatattaaaactcctttgcttgtttgtttatatttgtttgatgtgacgcaaatttaacattgcatataaattatggtattaaatgttaagaattttgccatttttaaattacaaaaattcaataattattagggattacatttttaggcaaaagcctattttttcctgtctgaactccccgtggcctgatgcgcacgaaaaacatatttttttgggctgttgttaagcggcttttcgagtttttagtgactattttctaggcttttatttttagcgcctaaaaagcctaaaaaattttgaaagaacctatttttgcctattttggcgttttgccgaaaatttgttaacaaaaatgcaataaaaacgaaaaacacacccctaagaatcgacccaaaaaattttcaaaaaatgcacccctaagaaaaatttttcaaaaattcacctcaaaatttattttttatatattgacaagaatttgtgatttaaaaacatttatctcaatactgatttgggttaattttgttacctttttggataaaattttaaaattttacacccctaaaaatgggttttttagtgcctattttgcatttttagtcctattttttgggtttttagagcctaaagcctacctattttggcggtttttagagcctaaaaatgtaatccttactaattataaacattggtgctgaactttaaccctgctctattttaagcattaatctgtattaaaattttaacattttttcgtagcgatagtattttttgaaatgaataattggctttgttttttgggattgcgtccccaagcgaagcaattccattgattttggctggatcctccagcggagtttggcagagaatgggctctatgggctatattgactgaagaaatgtgaaattactcaaccgacgaaaaacttcaaaaatcaaacttggtttatgcagttgattttaatccgatttatgtataaagtcaagaaatctttcgaaaaattaaaattaaataaattattttacttctaataatatgattttgttgatcggaaactttagttttgagtaaacaaaaaatgatataatgtcaaacattaagtaatttcattaacaggcttaaaaagtttgataaatcctaaaagatttaaagtcatttttatttatcatttaaattcgattaaagaatacagaaaatgcagtgatcatagccgctgaaatttgaattttccgcgagatgccgttgattttctatacatagaaaattaaaatttcttgaaaaatgggcaatgtgcgcggaaatgaaacgcaactcattcatatttaaataaaattataaactttacaattaccagttaagagtcaagttttaattattgaaaaattatgaatctttttaaaaaattataaaagaaatataaagtttaaaatagattattcttgacataaaaatagaaaactattaaatatataaatatattttcatttattttaataagcttacattttacgagtaaaataagtgataaagataaattattatatgtgtacatatataaaga

SEQ ID NO: 26464 - DNA, 2569 bp, Heterodera glycines
tcacaattatgtactaaaaacaattatttaaacaactaactaccacactctttcgatcatccgctgtacattcgacgatcacagattggaatttttcatctaggaacaattatcgcaaacgaatcgtcataaatactattaaaacgtatttttaattatttttaatcgatgaaattgatttgcggtcgctcgaatttcgtacattttttaattaaattttttaaattttttctttaaaaaattaatttttcaagtttttctagcaaaaaatcattcgaaaaattttatctgttttccatttcattttaagaagaattttatactaacaaacttatattttttttttgctcattttcattaaaaaaattttaatttgaaaattttttttattccgttttattttaaatttatttattaataaaagttttattttttcatattataaacacaccaatagcgtccaacttcgtctggatggcacgcgttcaaaaaggcggcaattttttgtttcgattctgcaatatttccatttgtatggtccaacactgattgtatcatctaaaaaaatgaattttattaattttttgtatgctcatggatctaaaaattctaaaatatttgtgtaatttttatttaaatttcataatgccaaatttttggagtgcaactttaaacacattgtgtcctgatctgatccctatggctcggaaaaatatcattttagaatcggaatccggtttccgaattttgagccgtctaaatgccgatttccgaaatgtttttgatggcgttggcacaaatgcctacccgccctggactttcaaaactggcatatatccccgccggttggactgcttgaaaaagtgtggcaccaacaatcgcaccacccaccttgttcacttgctccaatgccttgaattggtgctgatcacgtggcgtttcaattgatatgttcacagtattgcacctggccaaaattcgttgcatgttcaacatcagtccgtcacgttcggctgaaaaaaaattgggaaattttttagaatttaaaatttaaaaaaaaatttattgccttgcgaaaattgcgctgccgtcggcttaatgccagccgccgatgatgctttgatgttgttaattttgtccagaattgtctccttctcctgctccaatttgatcgcattttctcttaaatttttacaaaattatcggattaaatttttagcggttttttttcattttaaaagaacataacttcaaggaaattttgaaaaattttccaagcgattttttttaattttaggatgaattaaattgttcaatcttcgaaaaaagtttctaagattttttttatctaagtttgaaattttttgtctggaaaaagttagtcagagtattttgatcaaaataaaaagtacaaaattttaaaaaagtgatcagggtatgtatcatacccctccgtttttcgatttcaaaattttttagtcttcttcccgctcatccatcggctaaaatgctaataaacacctaagttgctcagtcaagtgctcagtttcatcaagaagttgtaggaggtcaatgtcgtcagcagttgtctgttttatgccataattgtgttgcttctcctccacatgttcatcaagttcagcacgttcacatgcactattacgatcattatcaacgacaacaacaacatttttatttgcttgattcaatgcttcgttattttgatgttgcgattggtgttcgactgctgaaattttgaaaaaaaaatatgaactgctccaggtcgccgaaaaatgatctgggccagtaaccaggaaaaacccaggcctgagtccaccaagtcctggcccaagctcttgtcaatttaaaaaattgctgatttcctattgccgaatttttttgagggcatcgatcaacatcacctaatcgtcacgatcgatatgatttcgatattttattatcgatcggtcgtcaaccattttttcgggtttttaagtggaataatgtgtgccgtgcgtgcctccgaccaaaaacctaaacacggtaaactacggcttttttccggatctgttggttccagggatgtgtcgaatgccgatttccgatattcttgggcacggaaagcccaattttcgattacagaagagctctgctggtctacaatttgattatcctcattcatgccttcaggtgctggcaatggaatggcgggtgccggcaacggaattgcggcacccattttgccgccattaaccgcctcattaacaccagcatcattgttgttgttgttattgttggtagtactgtagtcatcaatggtaatgttcggtatggacggagcacgacgacgataatggtgagcaccacaaactttgttattcaccataataccatcatcattgtctataaaaatgagatttttttggttttttttcttagaaaaatctcggtcgataaaattgagaaaaaattgtaaaattgagacgaaggttaactcagtgcccccaaggatttaccggaattaaatggatgtcatttcttactaaataaatttttttttgatttgata

SEQ ID NO: 26465 - DNA, 2471 bp, Heterodera glycines
  misc_feature (2462)..(2462): n is a, c, g, or t
attttttggaaaaaacgccaaaaaaggcaccaaaccgtcaaaatgccaaaaaaggcatttaaggcacgaaaatcccgaaaaggcaaaagcatttgtctcaaaagtcggtctcaaattatcatcctaaaaatttatcttttaccatctgataaatgtcttatgtccaattcagttttctcaagaataaaacatattgtcacatcatttttcattcgtttttctgagttttcactttggcattttctttttcgtattggcatttttacacttttcatttactttttttttcacctgttctttccgtgccaaatgctttcgctttgcctttttacttggaaagaaagaaatgccattgtgcgcttttcactttcattcgcgttaaattaattttaataattgccatgtgcaaattctcagtaatccaattgtgcctttccaactaaacactgcacgaaagtgccgaaacgtttttcatttaattttacaagaaaattatttttgctttagaaaaagttttcagttttacgactaaattataatgttttatgaagttaatttcagtaaacaaaattattaatgttaaataatcattttctctattactattttttgaaaaatattccatttttaaattttcgatttatattacgatcgggaataaactgggattttccaagaaaattttttttagaaattaaaatatttttccccaatgttaagataaattaaaaaatagaaaaaaaatcaaaacaaaattaaattaaatttttgttaaaaactcctcaaaacttttctatctttgatttttaaagctggaaaaattaatgtcacatcaattttcagaaattttttaaaattttctttaaaaacattttacaaatgaaaattattaatcttgaatatatcttttttacgaatgttttatttaaaagattttaaaatatataaataatatcacatatgaaatcatttctcacataaaataacgaaattgtcaaattaaatttattaattatattttatttccttttttcttcgcccattttcccattgcttttccaatttgagtcagtataacaagttcttcattaaacaaatggagctcatttgccagtacattaggcctttctgacacttttttcccctgccgttccgtgcactaattaatgactttgtcaatttgctgcttttccctaattgcgtgtccattcaaaaaatacgtttttcatgaaattgtattttgattaaaagtgcctaattgccatcatttgatttatttttcatgaagagtttcgggtttgggttcagcaaaattaagcaagtaaaatgccgtgatttcgagtttcgaaaaaacaaataaaaaagggcactgactgctgctcgagactaaaaatccaagactcgagaccgagacgaaaaaaacccgagacttttctcgagtcgagtctgagactcttgagtgcgactttttgcgccgtcggcactacgacggcactcaacttttgaattttgcatttttgggttgcaaaaaggcttaaatattaaaaaaataaattaattaatattatttcattgttggctgggaccatcaatgctttgaaaaattctattcttttcttcaattaacactttttctgtctcccgtcattcgcctgagtttttcccacccgtccgtctgctggcggcactgaattgtcccacgcttaggccgcttcatcgcggcaaatttgccaccaccgccgttctgtgccgtgccgtgcgtgtgcccccgtccgattttgctgtgccattgtccccccccccccccacctcaagagcccattattttatccatttctttgtgtgctgcgcttaacgcggtgccattgtacaaattgggcaaatttgtccttggcatttccatccattcgctcattcattcgcatttttcgaatagcaaaacaaaaacagaaggattaacacacaacacaaaaaagaaaggtgaagcagactaagcacaaaacgacaaaataatttctcttttgcgtttccttcaattaaaatatttgcttagcttttacatattttataatctaaattttacttttatgaaatttcttttggcaaaaattcagtgttaatttgggcgtatttagtaaatatattaaaatagagtatttttaattaaataataaatttaaaaaatatataatacatgttatatatataatttcaattcgatttttatatttcttttttattagaaattaatttataaaaaaaaataattgaccttattgaattttaaataatttttaggtatcagaaaaaactattttataatcaaaatttttacttcgtatgaaatttcttatgacaaaaattcagtgcccaatttgaattttagtatatatattaaattgaaatattttaaattaaataataaataaatttcgatttttttatttctttttctactaaanaattaattt

SEQ ID NO: 26466 - DNA, 2060 bp, Heterodera glycines
  misc_feature (2043)..(2043): n is a, c, g, or t
ttttttaccagtatgaggatagttttttgtggcaaaacccttgaacaatgctgtaaagtcaaaaataagacattaattaaaatttgcatttttattctccgatttgttctccttcacccttatattttttctattccttgtttcatgttggaaatgttggtggcattgtaaccggtggaactggcggcactgacgggaacagactcggcggaagtggaggcacttttggggacggactcctccgaagtggaggcacttcgggagacggactcggccgaagtggaggcacttcgggagacggactcggccgaagtggaggcacttcgggggaaagtggaggcagtgggaccggtggtactggcggcactgacgggaatatactcggcggaagtggaggcacttttggggacggactcctccgaagtggaggcacttcgggagacggactcggccgaagtggaggcacttcgggggaaagtagaggcagtgggactggtggtactggcggcactgacgggaacagactcggcggaagtggaggcacttttggggacggactcctccgaagtggaggcacttttggggacggactcctccgaagtggaggcacttcgggagacggactcggccgaagtggaggcacttcgggagacggactcggccgaagtggaggcacttcgggggaaagtggaggcagtgggaccggtggtactggcgtaaatgaacccagaggaaatgaaggcaatgacgggaacggactcggcggaagtgggggcactggctaagggaacggactcggcgggatttgaggtgattagagaacggcgactgatttgatgaaaggaattaaaagagaaattccccttttcatgttaaatcaatgttgatcaacgacaaataaatctttttaaatttcgtattagtaaaaagtatcatcattagtaggaacatagtgtacccaagaagttataattcctcacatcttaggtggaagggtcgactcaatataatataactaaactagaagacatatgtaagaaattcgaatatataaaaacaaaatattctcagcccgacaattaatacaatcaacttaatgaaatcagataggtaatagataaaaaaacagccttatttcattcaaatgcgcaagcccttgatgacttctaggtctgtctccataagcatttcctgagtcggccaaatgttgaggtggtcgtagacaaattgtgccaacagaattctgttagtatccaactgaacatggcttgtcttctctgcccgtgccttgacaccagccgaacaaactcaaacagaaccgtttttgatttattccccaaaagacttcaccttccggcacaccaaaaccgcccaacgaattgcctctctccattttattggattcgacgaaatctgtgcccaaaaaaatgtccgactgtccacgttttgagtcggcagtgctgtccaatttggacaaagttccttccacagacgctccactcacatcgaaaagctaaaaaattcaagggtaaagtgagtgggaccgattgcccaaaaattaccatcccaatttgactcgcattcggcaattcctccagcatttctcccttgacactcagctcttcactgaaactggcctctcgggaagagttgtgcgggaatttggccataaaacggtcaatgccacgtggcgacctcaggggtctgtaaattttggattgggactgctgaaagcatgcaatggctttacttgggtggacttttggactcgcgaggacttctcagctccggcacgcaattcatcgttctcagtttgagcagcgcttcgctggccgagtccctcctcagtttgcccatgctgtcccgcgcactggtgctcatcgaattgctacgcaatgacagaatggagtgcagcgacttctccgacggtttgaaggtggaaacgatgtcctccgaaaacacttcttccgcaatcgaatcgtccgtctgttgttgttgctggtgttcagcgacgggttccacggcgaccaccatccccttccnagatgacatggtggaaa

SEQ ID NO: 26467 - DNA, 1270 bp, Heterodera glycines
tgcctaggctaaaaaagtgtttttttcttccataaaccacttcccgaattttttctgcttgttgcttattgtgtcaggggttgttccgaattccattgcttttgttgtgtagagaattccgaattttttgagcctatcggaccatttctgcttcacacactatcatcaagaattctttactctcgtagtcattctttgttaacatattatttaattttacgatccttttaccatcattcatcatctttcatttttcattaattgatcaaatgaggagacatgtgagttctgtctttttttcaattaagagaaattttttcatttttgcttttcgtcattccgttaattaattaccaatcagagtgattgtaattaattcaacctctcaattttcattcctttcaaaaatttagcccaatcatttgaataaagtttttcataaatttcatcatctttaaattatgacagggatgggcttttgcctatcattggcttatagatgtgctaacaaataaaaataaataaaaaactacaataagagatcatttatgccgtttttcaaccaaatatgctaaattcgaaaatttggactttcgactttttgtccgagttcgggtccggggttcggaattggccgaaatggatacctgagcatggtcagtgcccccgaaaacacacggacttgtttttatggcaataaaattttcactaacgcatttccactgacccattttccgggcgccctttttggtttctttttggaaaatgatcacaaaaaagagaaataattcgaaaatttgaagcaattaaagaaaagttgaaggaaaaaggtaaatacaaaagcaaagaccaatacaaaattgagagaaaaattgcaaaattattaggaacaaatcggcaattaataagtaaatggaaaaatgaattgaatttaaataaaaataaaataaaaaaggaattttatgagatgaaaaagagtgaattcattgaacgatttgatgaatttaaagatttatatggccaaggcaaacagaaagaatttgtgaaggaattgggcatttgtaaacaaacatttataaaatggaaaaaagaattaatgccaaaataccacaaaagtaagagaaagaatataattttaatgaagttaaatctaatttttgtttaagaacaccataccaatgaggccaaattgatgaagatgaagcaatattttgaaataaaagaagcaaacacaaaagtgaccgacgaaataattgccgaaggaattggg

SEQ ID NO: 26468 - DNA, 1237 bp, Heterodera glycines
cggagggacccggagtcgggatcccgactgaatcccgatcccgatcaatcccgaacattttcgaaaaatgatcgggacgaatcccgaccgaatcccgatcccgatcaatcccgaagattttttttcgggatcccgcgggattatcgggatttgctaaaactcatttttttaatattttgtgccaagttttgttcaaatgcttatataatatttataattaattgatcaattcgattgagaaaaatagggatgggaattatatcaggtttttatataaatttttcaaaattaaaatatcatgcccaaaaagagattttaggaccaaaaattagaacattaacatcatagcattaaatagttttttttacaatttaataaattactattaatttttgtattttcgcctcctctgatcatttttaacaattttgaggaaagttagcaaatcgtaagtgcaagtcgtcaaaatcactaacaaaaatgacataaaattaaagaagaaaatgccaaaataatttaaacacacaataatatcacatgcatccgaatctaaaaatccgatttttaaccattttttgcagcgaatttcttcaaaaactttaggggaacaggggggaggccggcggtgccgataggcgccgccgggaaaattttgaaaatttggaatgtaatttgttaacagaatttatccaaaaacagtctatattttgtgatttttttctcaaaaatgccaaaaacttcgaatcataccgagaatgtgcatttgcttcaaaaaatattttttaaaaattcattgccatggaacggactcgaacctgcgcccattttccctttattatcttacaaaatcaacttacccacagttatttggtactgcggctcatttccagattaattcaaaaaaaatataaatttatatttttaaaaatctaagtttggtgtcgcattttcagggagccgtacagaatgaccatttttgaaattccaatgattttaatcaattttagaacaagaatgaaaaattttaaaaaatttgaattttcaattttttgctcgaattcgggttcggggttttgaattcgtataaattgatgtcagatttgtgatcagcaacctcaaaatcccccagggaaggagttttacacgactttttgaaatttttattttttcgaaaaatcggggggaccaagcacattaaatataattttttttaaaaatttcaggggggtgacaaaaa

SEQ ID NO: 26469 - DNA, 1024 bp, Heterodera glycines
atcattgatgaaatggactggatcaatattaacttaaataaaataaaaacaaagtgtaggtagatgagcagtcaactcatatttaaaattaataataccctttctcatcggaaaccttaattaaattaattataatctttatcaaaaattgtatacaaaatttattaaagttttataataaaaccgaaaattgtaattatttttaaatttttttagtttttcaacgtttgaccggtgaccccccgctcggcttcaaaccgagtttaagtcaaaaaagccggcagtgtacatcgaaaagattgaaaaaagccaatgataaaaatgaagaaataccttatcagaattattactttttatttacttaatttttcaattatcataaaatatccaaatttaaaataatagggacatttaagaacaaaaattgttattgcaatgaaaaaagattgatatttgaatttactcaacgaattgaaaatatagtttaaaaatcgaaaaaaataatatattagtacaaaaataagcaaagcaaactaaataaatctttatagcatttgctctaaaaatagtaaaaaaaaaactctgaaaacacagctatctcaaaaaactggccggaaaatgttaatcttaaaataagtattttttaccataaaatgattttcccaagcattattatcgatcaattctatcggcaattataaaataaaattattttgaaatactaataaaatatataattaattaataattactagggatgggaattttatgcacgaaaaatgaccaaaatatgcacataaatatgcaaataaaattgccaaatatgcagcaaatatgcacaaaaatcgtaaaatatgcacgaaatatgcattaaaaaattgaaaattaggggtgcaaattcaaaaaaaaaaaatttttttttagctacatttcttttaaaaaaattctctttagcaaatattgacattttttaaatcaaacattttctcatgaaaaaaaatttgggagaagaattttgagaaaa

SEQ ID NO: 26470 - DNA, 1505 bp, Heterodera glycines
  misc_feature (104)..(104): n is a, c, g, or t
gaggtataaaatttctcaaaaaaagagatagccatttttctgggatagagtataaatataaaaattccctcaaaaataaaaggtaaattgcgcaccgccctccnctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagatataaatttaaaaattccctcaaaaataaaaggtctattgcgcaccgccctccctatcatgctcgagagcatttgtatgtgtataaaatttatcaaaaaaagagatagccatttttctgggatagagtataaatataaaaatcctctcaaaaatagaggggaccacgaatgaatgaatgaatgtgtgtgatgtgatgaatgaatgaatgtaaagggcggcggaatggtggcgaagggatcgatggaactgcggaggggtcgggagagatattggggaaatttgagagaaaattggacgaaaaagcgacagagggaaggctgaatttttcgattggatttcgagaaggttgagattcgcttttctgagatttgctatttatgatagtgtcggatatttaaattgggacatttgatttgtttaggtatcccctaaatccaaattaaagtcatttaatgtttctttctctacacattccgctcggtttcagcgtttctttccaaatttatatccaaaaaactccttttttttttgctgtgttcacaatttgtgctgctctttgttcatttgccgccgcccattaagaaatcgagaatttgtgctgtgtcgtttcgagaattctcaaatttagcccattcaaaaggcaaattcttcgcacgttttttcgcgcaaattctgttcgtaattgagctaacaaaaagcacttcgattcattgtagttggtggggaaagctgtgaaatacgcaatagagaagagatttatgggtgggggtggtgttaagtgaaaatgtgtgagaattggggcgggggagggggggggggg

SEQ ID NO: 26471 - DNA, 1231 bp, Heterodera glycines
  misc_feature (1154)..(1154): n is a, c, g, or t
  misc_feature (1177)..(1177): n is a, c, g, or t
  misc_feature (1198)..(1198): n is a, c, g, or t
cattatgcaaagatactttataagatccggcgccgaaaaatgagagcacgaaataatgttactacaccacagaacgtcgtagtttgtgatacaaggaacaattggcctgatcaggacataagcattgtgcattatgcaaagatactttataagatccggcgccaaaaaatgagagcacaaaataatgttactacaccacagaacgtcttgttttggtaatacaaggaacaattggtctgatcaggacttaagcattgtgcattatgcaaagatactttataagatccggcgccaaaaaatgagagcaccaaataatgttactacaccacagaacgtcttgttttggtaatacaaggaacaattggcctgatcaggacttaagcattgtgcattatgcaaagatactttataagatccggcgccaaaaaatgagagcaccaaataatgttactacaccacagaacgtcttcgtttggtaatacaaggaacaattggcctgatcaggacttaagcattgtgcattatgcaaagatactttataagatccggcgccaaaaaatgagagcaccaaataatgttactacaccacagaacgtcttcgtttggtaatacaaggaacaattggcctgatcaggacttaagcattgtgcattatgcaaagatactttataagatccggcgccaaaaaatgagagcaccaaataatgttactacaccacagaacgtcttcgtttggtaatacaaggaacaattggcctgatcaggacataagcattgtgcattatgcaaagatactttataagatccggcgccaaaaaatgagagcaccaaataatgttactacaccacagaacgtcttcgtttggtaatacaaggaacaattggcctgatcaggacttaagcattgtgcattatgcaaagatactttataagatccggcgccaaaaaatgagagcaccaaataatgttactacaccacagaacgtcttcgtttggtaatacaaggaacaattggcctgatcaggacataaccattgtgcattatgcaaagatactttataagatccggcgccaaaaaatgagagcaccaaataatgttactacaccacagaacgtcttgttttgatatacacaggaacaattggcctgattangacataaccattgtgcattatgncaagatactttataagatccngcgcccaaaatgagagcaccaataaatgtacta

SEQ ID NO: 26472 - DNA, 951 bp, Heterodera glycines
cgtctgaggcctcggggcggctgaatgcttcccacaaaattaaaaacgggcgcgaagcgcccgtcttgaggctgcgatcaattgctaaattacatcactttctagcgacgcggcgaagccgcgtcccctgagcgcgaagcgctttccccacagcaacagaactcaattgaaatacaacaaagccaactgtgcaccctagtttatataccttagaacaacagtgcaactcattgctaaaacaaaaatctcgggaacggctaatcggggggacctgaaatgttgacattgcttaagcaactttttgaggcgcatccaggaaaactataggcattccggtccggtggccaactgagcgccggcggcgctgaaacggcttttcgtttcagtctcactgttacgaaatttttttcttttgctttgatcaaaaaatgcttgctgggaggattttaagttgaagtgtgccctacaacttcgcttccaatcatttttctctacggcctactgtattccgtgtacagtcgtggaaaaattgcttacttttttggccatttcagcgccggcggaataactcgtcggggttttgagggaggatgtcggtgtaagcggcttttttgtacagctcgacgagctctatccaaccatgtttttgtatttctgaaattttcagaaattttcgagctaggccccctcgtcacttttgaggtttttgaattttagtattttttgcagatttttccggggaaaacggagaccactttcaagcaaccgtttttcatgctctatcgattggtgtcattttcagaaaaatttttcaaaaattttttggaaatagaaaatttttggttgctaggcctcaatttcagttctggcgcaataagtcgtcaggagttgaatttatcaaaaaatcgtcaaagagcttttttgtagagaattttaagccccaatctaatg

SEQ ID NO: 26473 - DNA, 1674 bp, Heterodera glycines
  misc_feature (50)..(50): n is a, c, g, or t
  misc_feature (160)..(160): n is a, c, g, or t
  misc_feature (168)..(168): n is a, c, g, or t
  misc_feature (201)..(201): n is a, c, g, or t
ccaaaagacaattggggtaattagaggcaattaattaactttttgtttgnttcacttgatttaaagattggtcattggattggaacaaaggcttttgcaattcggacaatcccaagaaacttttccccgaacaaatttccgcagattgtcttccgtccgngcctttgngatgtgtcgcgttgtcagcccggtcgggtcgcnccgtcccttttccttttgaattttggaatttgaaggcgaaccgccagttgtcatcagtcagccgaactttctgtacgcgccggaattcgttcagaaatcaatcgacggacttcgtcagcccgtgcaggaattggaccaaattgaggtgggcattcattgaatggagaattgttttgaattgaaaatgttcagattgacatcgaacctcggctgggcactcttttgcaggcccatcggcgttttctcatttccatttcgatgtggcacggcgtcaacattacgctgtcgtaagtgccattccatcgatttttgagtttttaaaaaaaatatttagcgatttgaaaaacttccgaaatagcattgtgcctgtgctcgaagttgatgaacatgtaaaagataaaattggaaattgaaactcattgatttgattagtcaattgcttttggcagattcacatcgatgagcccaatttgaatttgatcaaaacgaaattggtccaaactgagaaattcgtctcttccgggtgcattttcactgccattctttcgctggtggcaattgccgtcgtttccgttattttcatccggcgtcaattggttgctctagcaattagcattggttaattaacaattatatgctgaatttatttccaggggagctccgactccgagaaattctcttcgcccgccggcgtcgctgccgatggaaatcgccgttcgggcgccgtttcgccgattcctttgtcagtgcccaaatccaatggcacggaccttcgccaatgattcacaaaacgaaattcgctcactttcactttccattgattcgatttgtgctcaatctctcttttccatgctttgccttacgattttcgttattcgttttctccaaatcagtcgattaatttgatttttctgattcgcaacatcaaaattctaatttcatttgtcaatcgggtcatcatcgccaatcgcaaaatgacatgtccgtcagaagaccttacaacataattcctttttatttgtatttttatttttatcatttttatgttcaaattaggagtatagtgctctgaaagtaacaatttatattcaatcggatattaattgttttatttgtttttgtaaataaatttattttcaaggattgccgcaatttttcttagaagcaaccaaattaaacataacgatctctatgcttataaaagttcaaaattttgcagggtttttagggtcgctggtcagtattaattaaaggatttttagtgatatcccaatataattattaattaaataaatagtgacaaaaaatgccaaatagtggcgaaaagccaaatttttaattatgtattttaatttgaaaataatttaaattaaaggcaacatttattcatttattgcagttacaaatgagtagagaccgacttttgaggcatatgcctttttttgcactagttccgatatatgcataaaaaaa

SEQ ID NO: 26474 - DNA, 1243 bp, Heterodera glycines
ttcttcaacaattcgctggtgaaaaaacggcccgacttctcttcagtcgctgccgctaatcgcaaattgcgcaacgatgtcgccacggaatgtgccaatgtcgccattcatcgccagcaacagcagcagcagaagaacggaagtgccatcatcatgcaaacttaagcagaggacggacgagtgggatgaagaatgatgatgctggtgccaacaaacattcaatgcgatgaaatgatataaagcataatatgtatttctcagctgtattccattgtattgtatattccattatatcgcctatatgcgtatgcatggtctcaaataaactcacctagaattcggatttaagaaaatgcaatagacaaaaaaattatgcaagtaagacaatttatcatttcatattcgtctttgaattaaccgacggagaaatgtcttttaatgtttttgtcgcggattatgtatggaatagttgatagatggagcccctagactagtgggaccgagacttctacgagattttactggattcccgctcctgctggaaatttcaaattttctactttgttcgaattcgggtccggggctcgaaataagttgaaatggatgtcaaatttgttatcaacgaccctgaaaactcccgtatttgccccgcgggattccaggtcacgctcccggaaaattttaaattcgcccgtaaattattttttaccggtctctagtatgcttaaatgtacatatattgtggttgcctgtattcaattttggcacatttattatcaggtttattacacacattgaacaatgaatacaaacactgtgcatacacacaaatagcgaatatgaagcagcacattaatggatattatacatacatacatattttgatcacattaggaaggtcgctctgatcacatggaatatgtacaaaatatggggaacggacttcacacaaacaacagcaagcagtaggggggactgatcgtgaagggggagaggtcgtcgtgcaccgtcgtcgttctcatcgctggctattcgtccgcttgggtcgtctccgctgtgctctgttctccggcgttagctgctggctcggcggcgtccttcttcttgtcctttttgtccttcttcccgtgcttgtccttcttggaacggcggttgctgtcgtcgctcttcccctcctttgatttgtgtttgtccttgcgcttctcctccttcttgtccgccgcagctgcgccgtcgcctttct

SEQ ID NO: 26475 - DNA, 961 bp, Heterodera glycines
taatctactcaaaacggttcagaattcaataaaaataacattcacggtgcgaaaaatggggtttgaaaagtttattgtgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcgataaaaataacattcacggtgcgaaaaatggggttgaaaagtttattggggaaaaaaagactttacaaaataatacccctggggaagggagtggaacatgatttcaaaatttcaatttttctagtctatctactc

SEQ ID NO: 26476 - DNA, 1134 bp, Heterodera glycines
aaaaaaaccccccggggaaaggggggggggaacaaagattttaaaattttcaattttttttttttaatttcctaaaacggttcaaaattcaaaaaaaaatcctctccgggggaaaaaagggggtttgaaaattttttggggaaaaaaagcctttccaaaataatcccccggggaaagggaaggggaaccagaatttcaaaattttcaattttttttaattttattttcttcaaaacggttccgaattccataaaaataaccatcccggggcgaaaaaaggggtttgaaaaattttttggggaaaaaaaaaccttccaaaataatacccctggaagaagggagtgggaaacatgatttcaaaattttcaaatttttctagtctaatctactcaaaacggttcagaattcaataaaaataaccttcccggtgcgaaaaatggggtttgaaaagttttttggggaaaaaaagcctttccaaaataatacccctgggagaagggagtgggaaacatgatttcaaaattttcaattttttttagtttaatctactcaaaacggttcagaattcaataaaaataacattcccggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacccctagaagggggaaaaaaagactttacaaaataatacacctggga

SEQ ID NO: 26477 - DNA, 1044 bp, Heterodera glycines
ttgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgatttttttcagtgtccgtttggggtactcaaacaattatggggagcaaaaatcccacgcagaattaagtacaggctatagggaagctattcccgaaggattcgatctccccataaatctgggcgcatcggttcggggggactgccccgaaaacaaaaaa

SEQ ID NO: 26478 - DNA, 1335 bp, Heterodera glycines
tgataattttagcgctcataaagggatgtataaaggcgattgtagaaggaattggaagcgctaaaattgtttgagaaactttttgagcgtaatttcgatttttacttagaccattttttttagggttagatctcatgcgatttttggcactctgataaatttagcgctcataaagggaagtataaaagggattgtagaaggaattggaagcgttaaaattgtttgagaaactttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgattttacttacaccatttttttctaggcttagatcacatgcgattttcggcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgattttacttacaccattttttgctaggcttagatcacatgcgattttcggcactctgataattttagcgctcataatgggatgtataaaggcgattgtagaaggaattggaagcgctaaaattgtttgaaaagctttttgagcgtaattacgattttacttacaccatttttttctaggcttagatcacatgcgattttcggcactctgataattttagcgctcataatgggatgtataaaggcgattgtagaaggaattggacgcgctaaaattgtttgaggagctttttgagcgtaattacgatttttacttacaccattttttgctaggcttagatgacatgcgattttcggcactctgataattttagcgctcataatgggatgtataaaggcgattgtagaaggaatgggagcgctaaaattgtttgaaaagcttttgagcgtaatacgattttacttacaccatttttt

SEQ ID NO: 26479 - DNA, 1302 bp, Heterodera glycines
tggatttgtagcgacgtttggatggacattctgccatcgcttgaccatgcccaacttggcctcaaaatggcattgcttatcgcttcgatgttttggttgacacgcattttgatggaaaaagcgaattgacaatttggaaagcaatcgaaattcgcaaggacgaaggaccaaaagcgaaactatttgtgggaatcacggataaatttgtgggcttttctttgccggaccgtccgctgcccaacaaaatacgctttaatcacattcggattgagtaatttaacattttgtaacattcctgcctctatcgcattttgttattcctttttcaggtacattgatcactctgtgctcgcatttctccgttccaacaagcaaatttgggacagaattggcactaatttggaattgtttatatgggcaaacaaaacggaggatgatcacccaatttgggatgttttcgcccatgaaattttgccaatttttgcgacaaaccttcgccagttgggctttaccagtggcgatgctttggacaatttgtgtcgccgcacttcaccgacaaaaagcattttttaaaaaggtgtaaaaaactgaatattatttttttcttttttttttttaattttattaatttttttaatttttttttattagtttagagtacggaggtgggtgcggctgattatatggtttaattaagatcaccgttaatctcactgatcttgatcagttgaattcgatcgatttcgctcttatgtgctctgacatgattgacaatcaaattctgtccaaatggttgcacacgccgagcaaagatggacagccgaagcaattgtgttttcgtgcttatgttggtctaccaaacctcgaatggctcaacaatttccgagaggtggtcgcccaacttttctacattttcattaatgactaattgattgatttaattgccctaaatttacgctttatttttgtttatacattccgccgtgccaccacttctgtcagttacaatattcaactttattttcaagtggaaccaataccaattgaaccatttgaattggtgaatggacggaccaatgagaagctgacactgaaactgagcaaagaatacaatttggttaattggctgttgcaacggtgcccaattggggagacggcgacggcgccagttaagtggaaaaaacgtgaaaattcgggtgccaattctaactatatcagatttgatctacggtatgccaattattcgggtgctaatttgaacaatatccgatttgagttgtggggtggaaatagttgcattgg

SEQ ID NO: 26480 - DNA, 1143 bp, Heterodera glycines
gggggaagcgtggggggaagggtggggagccacgcatgttgtggtacacgcatcgattatggaagccgcgcatgcactagcaacgaagtcctttgcgcgaagcgctcatgtcagcgcccgcccatatataccaaaagtatactgtctacaccgagcaattactgtgcaaagcatactgtctacaccgagcaattactgtgcaaagcatactgtctacaccgagcaattagtgtgcaaagcatactgtctacaccgagcaactactgcgccacaacacgctagttactatatatgttatattgacaaggagtttcgttgctaaaaccattttctcccggccgaaggccgggagcgccctgaaaatagtggaagggtcttacaactttttgaggcgcatctgggaaaactatagaaaaaaattcagcgcggacgactgagtcccggggaccgatttctcactttttcttgcgtttgaaggcccctaactttttttctaaaacccgaatcaaaaaatgtctgctgtgagggggctaagttgaagtgttttctaaaaaacaaaaaaaattccaagcctctatctgcaataggaaaggctgtaggttcgtgaactttttcagtaccaactttgtccagttcagtcccggttgaataactcattagggtttgatctgggcggggagttaccagcagacttattgtagagttttgaaagcccgatttttccaaatttaaaaatttcgaaaattttcaaaaattttcgagttaggcctaaaaaacggttttcgggtttttgaattttaggattttttaacgatttttcccagagaaacgaagaccacttccaaaacatagtttttcgagctctatcgattggtgatatttttgaaaaaatttcgatttttttccggaaatagaaaaattttttggcctgagcgggacatttgagtcccgggcccataactcgtcaggagttgatcttatccaaaaattgccttagagcaaaattgtagagcattttaaatgctatcgaatggtgtactacatgatgtaaaattttcaaaaattttcgagctaggccccctagaaaatttcaaaaatttttttggggtcgaaaaagccggtggggaatttttttctggggta

SEQ ID NO: 26481 - DNA, 1462 bp, Heterodera glycines
atgccttccttcgcctttgggagggaggcctcgccgctctacttttgcgctttactcgccgtcatccgaattttgaactcagaatcaccggccactcaatgggtggcgcattggcagcattggccgcctctttcattgcccaccataaactcatcgccagtggagccgaattcaatcgacgaattcggctctacacattcggtgcggtgcactgcggagaccgtcggtgggcactcgaattgaaacgggcggtgcccgactcattccgagtaattaaccattgggacatcgtgccacaaattgcgagaagcgttcgcatcgattattaccattatggaacggaggtgaaggaaccaaagggaaagaaagggcaatcagtgcttttactttgtcaggtgtggtacaacaatttgatgttgaaagggcacccattccgacaatgccacgacggccaatccgccttctgttcggtggtcgttcaccctttgctttggaattggcttgatcatttgttttattttggcacttttgtgttcagttcttgtcaattgtgcatgatggcataacaaatgagcagacaaacacttttttttatttatttatttattaagcatttaaatttgaattttaaatgaattatatacaattaacatttgcattgtgtgtgttttattcgtatgctttccttcccctttcaatccaacgaaaatcaatgtttactttttctatgttctccaccaaatactcttttttaattttattgttgcaatttgtctcaattttttaaaatgttttttgagatacaaaatgtccaattcttttcgaattctttccttattctgtccgctgtttctgcttctctttgttcctgagacttcacgagctctctattttcacatcgctgagactgagaaaaaatgtttcattgaggaaattccggacgagacaatggtgatggggcggtacaaagtgcaactgtacgacccgaacacgaaggcatatggggactatccaacaatcggaatgcatgtcgaagctaaggacccggaagaaaaggtcggcaccattcgctgacaaagagtgacgaatggttttgctaattaagttgggctttcttaggttattttgagcaaattgtacacgagcgaaggcatgttcacgttcacatcccattcccccggcgaacatctcatttgtctctattcaaattcgtccgcttggttcagtggcgctcaattgcgcgttcatttggacatccaagtcggagaacatgcccaggactacgagcaggtgactgactcttctcttcagttttgatattttgggaaagcctggtcctatatttatggacgaaaatccaattttcaattgattttgtggaaattgcaatttttgactttttctttgggttcggagtcatataatatttttagggggatctgttggggctacaatgtaaagg

SEQ ID NO: 26482 - DNA, 1422 bp, Heterodera glycines
ttatataaattttatttggcatttctatcactttttttaaaaaaagatacaaaaataaaagtgattttgggattcgggaccaaaggggggtgaccaggatttttgagtgggaaaatttttctcacaaaaatcttccaaaaatatgtatttaggggttatttgggccgctgatcacgaatacgtgatcagattttacttttgacatcgtcaagacctcagaatccctgtgtgattggggattctgaggcatcattttttgggggggggcggcaggttcgaatccggacggtgaacattatttttctatgcatttttgggttatttttcagtgcgtttaatttatatttaaagatttgttatttttcaaaatatgctcctatgaaatgaaaaaaattttcccaaaaatttactttcttggcaaaaatttttaattttaaaaatttttttaggtaactattttgggttttttggtcttaaaaatcgcagtcctactcatttgcaactgcaaatagtgaataaaaattatttttgctcaatttttggctgaaaattatgtcactattcgtcactattttggacttttttcactattttgtcactattttggcactttttcgtcactattttagttactatttcgggatttttcgtcactaaatgtcccggccctaaaaattaatttcatattaatttaaatatccaattcttgtacatttcaaaattctctttgtaattaataaaaggaataattaattttattttttaaagtttataataaattgcattcaatttttgtacctcttctaatcagttttgtacctcttttatcactgttgtacctcttctaatcagatttgtacctcttttatcactgttgcacctcttctatcactgttgtacctcttctaatcagttttgtacctcttttatcactgttgtacctcttctaatcagatttgtacctcttttatcactgttgcacctcttctatcactgttgtacctcttctaatcacttttgtacctcttttaatcaccgttgtacctcttttaatcacttttgtacttcttctaatcacatttgtacctttttaatcaccgttgtacctcttctaatgacttttgtacctcttctaatcacatttgtacctcttttatcactgttgcacctcttctatcactgttgtacctcttctaatcacttttgtacctcttttaatcactgttgcacctcttctaacatttgttgtacctcttctaatcacttttgtacctcttttaatcaccgttgtacctcttttaatcacttttgtacttcttctaatcacatttgtacctttttaatcaccgttgtacctcttctaatgacttttgtacctcttctaatcacatttgtacctcttttatcactgttgcacctctt

SEQ ID NO: 26483 - DNA, 2587 bp, Heterodera glycines
  misc_feature (1062)..(1062): n is a, c, g, or t
tgatgataaaataaaaagaaaagaaaaattattaactattctgtattaaaaggaatgaaattaaaaatttcttaaattttcattaaatctaacattattttttaaaaaatgaaaaaataattaagttattaaaaggcattttataaaattcgtaatgataaatgataactgagcaaagcaataatttattaaagtaaataatacaacgttttataataaatttacaaaatttaaaccgtcaaaataaatcgacaataaccagaacgcaaaccgagaaattatttaataatgattatattaaattaaataaagtaatgcaaaaattttcgcgtaaataaaaaactaataaaatttaaacaataacgaaataaaattatttttaaaattttatttagttagttttgcttttccaatataaattaatagtttatgaaaaagtttactaattttacacaacaaataataaactttaaaattattttctttaaaatattttagtttactgatattctgtttttatttataatcgaattataacaaaggacaaacaaagaaattgctataaagtcaaattaatgatgcaattcacaagaatataaaaaataatttttaaatgaataaacaaaaataattaaaccaatcatcagtaaggtccgtcctgtagccgagattagtgaatattaaaaatggttataacttactttctgtatgaattaataataatttgaacgcctcaaatgtgcagtacaactccaagaaaaaataaaactattttgtaatctatgacatttctaatataatacaataaaatcaatttgaattgaaatatgaatgttcttaatctaaaatcttaatgtaagaatcaaaagccaacaattaagaaaacatgaaaagaaaaatataatgataacccaatattaaaatttgaattattccaagtaagaattattacgaacaaagagattcaaataatatataaaaatgataaatcattttgtttttacttatgaactaatttctttttaaattatgattggaaacctggtaaagtataacgaactngaatctagaaaataataattaattaatttttggagaaatctcatagtaattgttgcattaagatatctaaaaatataagtatatattttatgaaaagggcccggatacaaaaaataataataaaatatccttttttaggaaatgaaattatataatcttaaataagtaatttgaataaaaacaaataataaataacaatcaataagaataaataaatcagaaatatttaataaaaacctttaaattttgtgttgttaagtaattatttactaaaaacctcaaaaagttcaaaatatttgccaaaaattgaaaaaaaaactgataaaaaaatacatgaatttctcattaaaatctcaaaaaatatattagaaaaatttaatcatgtaaatctgaaaaaaataattacattagatcataaaattcaaaagaatcgcgaaatttgacaggaaaatagttttgtaaaaatgaaataagaaaaaatattttaaataaaaaaatttttcttttaaaattgtgggtacaaaagaaggaaaattaaattttaaattatcctaaataaataaacgaggattgaaataataaatatggttattttatttgtattttcctaaaagcagaaataaacaaaacggaaaaatattgtaaaacaccaaaattcaagaacaatatttttccctgtggtgccgacggcaccgccggacctcaagaaatccttattctcttaaaaattgaccaaagtcgcaaattttaacatttttggaccaaaagccgtaataaaatgcactcaaattttccaattttttacaggcgttgcctatcggcatcgctggagaaatagatatcttattattattaatatttgtctgtttgcacaatgaaaacagaaagaagcatcctagaattaaaaaatatgtcaataatagaaaataaaatatatgcatattatcaattaattataaaaatagaggtaaatagaaaatttacattgaataagtaaacctttttaattaaattaaaaaataaaatttatcataagttttgttgttatatttaaaattaaataattaagataaaaataaatataatgattatatttcgttttataacataataaataaattacaaactataaaccacaccaaaaatttaaaatgtttttaaaattaaaatatttattcgggttttgattacatatcaaattattaccgtattggatgagctgaacaattaatgaccaagcaaagaaagacggtcaatagagaaaaggagaacactggataattaattaattattagaatttaatattaatactatttaatttatttactattaaaaatgattttatttattttatgaataaatatttagttcccaaatgatcaaatgaaatgaatgaaagtggtaggatggaattggttggtgcagtgaattccgtcgttggaccaatcactgaattttctgtgtcgacgtgtaaaaaaaagtgggggaaaagcaaccagcaaaggcgaaaaagctgacaaacga

SEQ ID NO: 26484 - DNA, 1329 bp, Heterodera glycines
  misc_feature (1255)..(1255): n is a, c, g, or t
aaattcagaatatgtggacaaagtgttgtccaagcagcatcagatgtacgcggatgcgagcgaccacatgctgtgtaagttcagcgggacactcggcggatgcggcgactattgcaaaacgggatattgagaagggacggacggaagggaaggaacactttctcattagcatttagtcgtcctttgttttagttaaaatggtgcgctttttctctctgatttattgcataaataaaaaattttaaaaatgccaattttattttaatttttctgtatgacggagaaatttttgcgggtatatttttgaataaagttcaagaattatggaaaagtgtccaaagaattacggaattgaggaaaatgcagaaaattaatggacaaatgatcaaaattaaaattatttggtcataattaggaaatgaatcgcaactttttgagccatcgcaatgtgctcgtgcgtttcttaaattcgccaaagccaagaaaattaaaaattaacacatgtatcaaattgtcaaaaggaaataattgttttattctttttgattcgatagcccaatggttactgtattattttgaaatccaaaaatatttaaaaacttctgatcgacttaatttgatcttttggtgcaaccaaacttatcatttttgatccttgaaaggacgtcaaggcccattgacaaaccaacgttggaagcatccatgcctcgaaaaaatttaatgtttttttgttcaacttaactgaatattccgcttacattcaagtcacgggtctcgtgtttttttgggcctcggtctcgagtctcgggaaattttcggtctcgagcattactactactagggttgtctagaacagggttcctccgcctgaatcccgggtcggccgagcctttttttactccggaatcccggatccagatccattgaatttggctgtcccaagcaaaatcccggctttttttctcattccgaatcccgaatctaatcagctgttccccttacatcctttgatatgttcgacgccttctccggtcgaagtcgacacactgttgcaacacaattccacgagattcgaacagtgccatttcagaacactgacctgaaccgcaaattttgatttatgccataattaatgaaaaaaataaaataaattgttttgagtttgttatgacgctttaggaagcaacttttgcagccttaattattttaattgaatttcataaatatttaaaaatttctattttaatgcatttanttttaaattattattcgtttttttattttcctgcatatttttgacgtaatgtttcgaatattttttgaaaccca

SEQ ID NO: 26485 - DNA, 2311 bp, Heterodera glycines
  misc_feature (2188)..(2188): n is a, c, g, or t
  misc_feature (2199)..(2199): n is a, c, g, or t
  misc_feature (2222)..(2222): n is a, c, g, or t
  misc_feature (2255)..(2256): n is a, c, g, or t
  misc_feature (2262)..(2262): n is a, c, g, or t
  misc_feature (2277)..(2277): n is a, c, g, or t
ccctattctttaccctgaacgatccagggacagcaacattactgacatttattataaaatagcctcctttgaccattcctacttgaataaaattaatcaatctgaattattctcaatgattgatgaaattgttgaaaattttcaactttgtaatgtagaagaaacgaggtcattatcgagatgggtatactgtatgctactagttttgctatggatagcaattgttatgacaggaatttttctctattttaattccttgattcgaaatttatgtaagcttatgcatatatgtagagacggaaatggacacaacgacaataaatcggattctagcgggaaacacaaagaccagagaacactacttgggatgcttcccttgcgacaaactcccaaacataatcatcaggtacccttcaacactggtggcgaataatgacccatcgaataaggaaggaacgcattggatagcaatgttcatcgttgataacaagaccgtctactattttgatagttttggtaggaaaccgaacagatgtatcagccagtttttacggaattatgaaaaagtgatttcgaataagccagctattcagtcagtgtttagtgagaattgcggctactattgcatttattttgttcattttatgtgctcatttggggaaagaaattatgagagtaattttgaaaaaatgacaaaaaagttgataggagaagataatccagatttgtttgtcgtgaattttgttaagaaactgataaaaagtatttaaggaatttttcattaactcatttataaaaatggaccgattagacacaataattgcatctctccttaactgctctgcacgtaatttatgtgatcgtcttaatcacccggatgagattcaaaaagttgaaaaatacctcaaaggaaaaactctacaaacaacatacaaaaatcaactaggtgagtgcaaagattttgagtacggtggaattaccaaagaatgtgcccgtaagcagatggcttacaatggtttcaagaatgtgaccgtcgaccagcatttttatgtacggcaccgcatttgtcttcgctattcaagcaatccttgcgtaatcgaaaaacacaagaatggcaatgaacgtttctacccacttgaacttgtgaaagtgaaggacaatgatataatttatttagggcaaaattttcctaaacctttaattcgtgatgataatatgtttattgatgatcaacaatatttgaattggtaacttaatgtttaaaattacataataatgaataaaatttgttaaatacagaatctatttctgtctttgatttacttccggttatattcaattttccactcgagaaaacaatgatggagactttggggcttttattccgatagacaagaccggggaatagttcaggagtgaaggaacaatatttggcgcgtagaaagtcggacagaggtcctaagcgtatatgaaaaccaacgtctgctgtcacaatcaaattcttcaccgcaaattcgtggattcgtgcctcgtagtacccacattgccttattcgttcggtgacttgctccgcagcttgcctacattctttctcattagctgctcctgtacatacgaattttccagttgagaaaattatggcggtagcatttggattatacactttcataattacagcatgaattttacgtggattatattttgtggatggagatattaaataaattttttcaatatcaaggggtattttgaggtctacaacagcaacgcaatttttgattattggaaaaaacattttaaatgaataatgggagaaaatttttaggtatttatactaaaataaattgaatttagttatattttattcctaaattaattttaaacttttaattaatttttatttaatttactttaatttatttttatttttatgattttaattaactggcatatttagataatatgaaacatcgttaaaaatgacccgcccctctcctaaaagtcatttagccgctcagcactgcacaaaaaggcacttcaaccatcaccgcttagcccattttcggctttgttttgcacatttggatgaaaaccctcatcattttcattatttttatttattttatattgtttattctttattttctatttctattaatattttattttcactttttagattttttanatattttttanaattttcacctcctcagcggatntaattttacttcctccgttttactcctacttgnngtttantatttttattttacncctttagatgttttttctatttttacctcctctg

SEQ ID NO: 26486 - DNA, 1794 bp, Heterodera glycines
cctcccccctcaaatgatgcctcagaatccccaatcacacggggattctgagggcttaacgatgtcataattgaaatctgatcacgtattcgtgatcagcggcccaaataacccctaaagacatgtttttggaagatttttggtgaaaaaattttccaactcaaaaatcctatgctcacccctttggtcccgaatctcaaaatcacttttatttttataaaaattcttaaaaaagtgataaaaatgccaaataaaatttatataatagagcaaaaaactgcggatttttgtagtattttatttttccagaataacttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaatattaggccaaaatcccaagggccaaaaaattgccaaaaaataaagaatttttaaaatattccaaaaattctgaaacgtaaaacaaacatcatattcgtgctcagcacctcaaaataccccagaaaaaaaattttcacccccattttggcccacaaaaaaaattttgaaaatttctagggggcctagctcgaaaatttttgaaaattttacatcatgtagtacaccgttcgatagagcttaaaaaactttacaattttgccctaaggcgttttttcgataaaaccaacccctaacgagttatgggcccgggactcaaatgtcccgctcaggccaaaaattttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccgttttttaggcctaactcgaaaaattttgaaaattttcgaaatttttaaatttcaaaaaatctagctttcaaagctctacaataagttcgctggcgaccccccgctcagatcaaaccctggcgcggtattcacctggtactgaagtgtactttttgagcacgcttcagttgccattttttgcaggccagggggtgtgctcaaaaaaaattttaaaaaataccagcatttagaggacaccttgatggagtgccctcacagcgggcactttttgattcgagttttacaaaaaaagttaggggccgtcaaacgctctcaaaaatgagaaatcagtccctggtactcagttggcccttggacctgaaaacctatatttttcccggatgctcctcaaaaagttgtaagacccttccactactttcagggcgctcccggccttcggccgggagaaaatggttttagcaacgaaactccttgtcaatataacatatatagtaactagggtgcccagttggctatggtgtgcatgcgtggcttggtaatatatggccctcatttgttattttaaaacatacaaaacattatcaattgagttctgttgctgtggggaaagcgcttcgcgctcagggacgcggcttcgccgcgtcactagaaattgatgtaatttagcaattcatcgcagcctcaagacgggcgcttcgcgcccgtttttaattttttgggggatattcggccgcttcgcggcctcaggacgggtgcttcacccccgtaatgtaattttttgcgttacattgcgtcgcttcgcggactca

SEQ ID NO: 26487 - DNA, 1176 bp, Heterodera glycines
tttttaaaatgggaatgcatttttaataaaaatggatcgtttatcctcgtcgttctgatcagccgtacatttgcgcgatcagcagggtcgtcctcctcgtcccccagactttcacccttgcggaagccggcgccgcgtcggttggcgccagcgggcgccgccgcgcgcggccaaccggcgccgccgcgtcgccttcatcaccgcgtgcacgagcgccgagacgagcacgaaggcagcagcacccgccagcaacagttccagcggcacgcgcttgtccccgcccgcggcgtttgtctttaaaaaaatgtcggtcttgaaaagaacggtaataccgtaaccaatgcattaatagtgagtacggtattccaaaaatctaaaatattcaaattttgtgcccgtgaatacatcaagcaatgctatgaagagtcccagctgttcatttgagactgtggcacttttcaggacactttcccagagacataggctcggattgactcgcaaatttgggggaataaagcctgccattcttcggcagaaaatcaaaaagcgtatataatttgggcgctatttttccaattttttcttttggcattttgactcacttttggcacggcactttttgtctgttgctgttgttgttgcttctgtgcctgttgctgcttgtgctgctgattatcttctcagtccataatgctccgcgggggggggccgaaggcccccctcgaggccgcgaagcggccgagtgagtaccatgggcgcaggaaaattattaaggaggagggttcattatttattgatttttgcaaaattaattttttattattttttgtgaaacttatcagaagcgccccaaactatgcagggatactgaaaggaaaagaattaacctgttttatcacattatcgaggccgcgaagcggccgagtgagtaccatgggcgcaggaaaattattaaggaggagggttcattatttattgatttttgcaaaattaattttttattattttttgtgaaacttatcagaagcgccccaaactttgcagggatactgaaaggaaaagaattaacctgttttatcacattagcttgtcatcagtttttataaaaaattttcaaaattctgagtcttctattattttattttttttttcaaaattttgaaggcgggggggggg

SEQ ID NO: 26488 - DNA, 1647 bp, Heterodera glycines
attcaataatttttcttgaaataaaaaaattcagaaatttttttttgtaaaaattcataaacttggtaatttaaaaaagttttgtgggggggggggggaggggaaaaggtgtgagggggatgaaatttcccccccgccagtcccctctttccccaaaaatttaaaaaatgcactagttgtcaaaaatgcaaaaaaattaataaaaattatttttgaaattttggcctagtctcaccatcactgaaaatgtgagaaaaaagacgagaaacgacctctttgaaactgttgatccattcaaagtttcttctgcctgatgcatacaaacaatggtttaagctacgcaatctcttcggttggccgtcttttctcggagagtgcagccatttggacaacgcttggccagcagaagaagttgcagttggtggcccatcatcatcagcaagttggtcgggaaacatcacatatgattggattgaattcagccgggcgaggtcagagaaaattgttggcgaaatgagacgaagaaagttgtccaagtgatcagcaccgggggaaatgttcaagtggcgaatgtttggcccaaaaatgggccaaatttgacgcacaaaaacatcccaaatgggcgtgacatcagtttttgatgaaaatatgtccaccgctaaatgggtggatttatcaaaaatgtgcggattggcacgaagaaattcgatgacggagtgatcgatgaaactgaaatggatgttttctatgggattaattagagtgtttcgggttcaaattactcaatctgtagctccctaaaacggattttcttgggcaacggacgatccggcaacggaaatggcaccaattcgtcacatacacatacacaaagtatggcattttcagcctcagtgtttttccgaatttcgattggtctccaaagcgtcaattcgcttttgccattgaaatgtttgtccaccagcgcatcgaaacgtggcgaaatcagtgtcaatttgaggccgagttgaggacgaccaaagaatgggaaaatgtccatccaaaggtcgttgcacacccaactgaaattggggaacagaaaaacattgggtgccgtggacaatccgtacaaagacttaggcttaggcataagcttaggccttatttattattattgtatgagttgccattaactcactcagacattggcacgttagtgccattaaaatgccaaatttggctcattttttcaccaaaattcgatgattcaattttttctctgtccgcaaaatgagtttgctttaacacaaaaattttgtgtgcattaaaattcctaatttattaagaatttaaaaaacaattaagtttttcaatgaaaaaatcttagtaggccaaaggaaccaaaaaaaaaaattgttttgttttttgccattcatttttctatttgaacgaaattttttcaattttgcagacctttttcgaatagtataaagtttttgaatgggcaggaaatgatttttgagtgcaaatccaaaaggataccaattaaaattcatattaattaattaattaccatttgactcacattttcctcaacttcggttctccaaatggtgtcataaataaagccaaccaattgttgctgattttcaccaattgtggcagaag

SEQ ID NO: 26489 - DNA, 1763 bp, Heterodera glycines
  misc_feature (17)..(17): n is a, c, g, or t
  misc_feature (40)..(40): n is a, c, g, or t
ttttcgtcaatattttncgatttgatatctcttaggatanaatttgaaaatgcctaaaataaatccaaatctgaatgggtgcgcgagtgggtcaacagtgagtttcactgccgaaaaccttgagaaatttttgatttacaattgtaaaaacaacctatataatttatgaggaataaaattttttaaattaatttgcacccctaattttcaagtttttttgtgcatatttgatgcatatttggcaattttatttgcatatttatgtgcatattttggtcacttttcgtgcatattttttgcagccctggtgatttgatttgttttcatttaggccattttttggcattttgtgactatttcaccctttagtaagaatttttttttccaaaaaataatcattttaaaaaagcagattttttgaaaaaaaggaatccagttttaagagcaaaataaagtgcaaaaaaatctttgaaatttttcgcgtttcagccccaaaaaacgagttgaggtaataaaaatgagttgggacaaaaagaaaattgtgtgtcgtccgaaaaataatttttttaaaaactcgaaattcacgggctcggtcgttttgacgccagcccgagtttttggattgtaatttttttgaccaaatcctgataatcttggttcattcgaaagcttaatgtgaagaagctgtttctaggctattgcttggcgattaggcaattaataaaaaaggttataaatttaccagcgcttcttatccagtcaattttatcattagcattgcacattggctttcggcttatgacataagcagctaaatgggccttttaatctgatcaatgcttggaccggggagcgattggtatgaaacaattgatgatcaaaatattttgttaatccgttgtccaatttcacgcgatgaacacaaatggccctatggggggaggaggcgattgagttcgcattttattgacaaattgaacagaatttgcttttaaattgaaaattcaaatattattcattacatttgttatctttaaaagagccatattaattgaaaatttttgacaaatttagtttcataaaataaaaagctcaaacaaaggtcaaagcatattttttctcaaatatatggatttttgtgaagccaatcaccaattttaagaataaatatcgccttaaaaatttatcctttacatatttgggcaatttaggctaaagaaaaatgtgaattttataataccgtaagaataaattgggccactagcgcaggatacggtattgggcaaacagagcagagaaaacatagctgcagaaaatagtagcaaaaagtgagttggtgagtgagacaagcagagaaaaaatattttacaaaacagagaaacgaatcatacaaagtggggcagagaactagaatatcaaaaaagaatgtggtgaaaagagaaaaaaagatatataaaagatttgtaaatattatatgtaaaatagtaaaaaaaatccatatctggtataatttccaaaacaatttttctctgatgaggtaagaaaacagtcgtacatggccgaatcgtacagtgccgatcgaaatgctgtcacgctaattaggataattagtaatatatttccgagtctataagttgagggtcttagtatgaatacaagtgtaggtttgcggtaatacgaattggccttgtacaaatcgtccgttccaagtccttcttcccactgatcattgatctagaacagatcagattcattgatcagct

SEQ ID NO: 26490 - DNA, 995 bp, Heterodera glycines
cgaaatgcgaagggaaaagcactgacagcaaaagccatgaagaaattgggaaaacataagggagagagtgatatcacttatcaaacggaaaaggacgaggccaaaaaagaacaaaaattaaaggaaagggagggaagggaagaaagcaaaagattattttcatgttcaaaagaaagaaaggcaattcggcacccatcggcggacggtgccataaatcggccatcaaagcctccttttttgggtgacaaaagtgcggacttttgttcccatttggcttggtttttgcacaaaaaatttttcgagtcgttttcaaacttctaaaaatgttctaaaacaaaaaagaatatgatgaagttatttgaaaccaaattaagaaaaaatatttaattgaaacgccccttttatccgaccgaaaacgacagaaaataactgatttgcagtgcatttttccgctaatttagaaaattttaggttctgccttcaccccctcaaaaaatgttataattccgacaaaggaaaacactttttgggtaatttaggcgcttttaagaattgatgtcaatagcataaaacccaaggcgctacgtcgctaatcacgaatctgacatgtattttgactaatttctaatccctaacccgaactcgaataaaaatcgaaattttgaatttttcaaattatgattttttgttcaaatttagattaggaaatcggaattgaaagtttcatgatcggggaccccaaaaaccccagagaataaatttttatgactatcacaaaaaaattttgcaaaacaaaagagtttggatcattcttttttttattcatcacttaaaaaccaaataaattccgttggctggcgttttcttcacttttacaaatcatttgtccaccgagtgacgtcattgccattgccattgccaattaccttcgctttgagtttccgtcggtgcctcccccattctctctcccgtcgttcctcccactctcttccatc

SEQ ID NO: 26491 - DNA, 1827 bp, Heterodera glycines
  misc_feature (115)..(115): n is a, c, g, or t
  misc_feature (1816)..(1816): n is a, c, g, or t
tgtttatttcaatataataaatgacagatttgagttcattaattatttaagttataaaagatattttgtattgtaattgaaatcgacaaatattactatagtaacaatatttttnaaagaattcgaatttgttgtggtgatgacttgtttttattggcattagtgattgcttattgttctaatcattcatggctccatattatttattggagtttaatttaattgtgaaaaatgaaaacatattaaattaatattgacttttataacaattgaaattgttgtattttgccttccattttggttaatattatgtgtttcttcgtgaagaatttattttatattattttcaaaatgagatattttaataaatttgtgctatttgttgattttattcaagtttattctttcttgttgatatatttctgataactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataatttgagttgacacatcgcataatgcaatggaaaccggaagtgccctaacgttgcacgtcatggccctcctccctcccttagtccaggcgttggcacgttattgggctgagcgctaaatggcaattcacctgtaggccctaaagagggctgaccggtccatgtcccggatccaagcttctcaccattttcgcacccaacatagtgcagatgggaatgggattggaatctctccaaaaaccatgtgcccaactgctctggactattgctcatttactgtaatttgagcatatgcgtggccacaataatcagcactttggctcggcctagggcatcaatttcccggttgggagcatgaacacggacattgtttccgtccgttgcccgagagaaggccgtatacaattgaccgtgggaaaatacttccttttccagatcaatgccgacagtgcggattgtttggccctgacctttttgaatggtcatagcgaatgcaggctttattgggaactgcaaacgctcatattttatgccgccaggcgatttgtcttcatagacatttcgtgttctttcaagaaagaatctcacttggccgccaatagcattgctattgataacacgaccaatgaggcgatcatcgccaagttcttccagaactatgcgtgtgccattgatcagtccttccttatcacttttattgataagaaggacgacgacgcatccgactttaagccggagactgtgcgggggcatgcccgagtctgtgcgccggttcaacgcagccacttcggactcgatctcatcgatgtccagtgggcggtcgtcaaggggcttatccgtggacaagtattcccgcacttgacctggcacattcgccatcatgatctcgtttacttcatcacacgtgtcaatgtgcggagcgagaatcaaacgattgagcagctctttgtcattgccaaggagttgttggaagttaggatagacataatctatcagctcttccttgctcttaacgaggaactgcggaggaatccagaagtgctctccggtttctccgagcccgatttggcggcacatttgcaagtacgcttgctgaccttggcccagtctctggttgatggtcaatttcatcgtggtgaattgaccaaacaacggagacgtttgaaaacaggctgtcacctgagcggttaagccttcatgaggcacgaccggcagcgactgtttgaagtcaccgctgaaaatgaccgtttttcctccgnaagaggagatc

SEQ ID NO: 26492 - DNA, 1496 bp, Heterodera glycines
ccccccccccctccaattcaaacaaaaggggggacacccccgggggggtaggaattggggggactgagcagctggtcgcatttggggataaagacgaatgaatgggggggggggggggaattgtgacagcttttgcccgtccgtctcattattgtcaccaccaccccgtccgacttcatcatcatttgcgccgtccttttgctgttcgttcggacatcacacatttgtgcccattacccccccccccccgcctttcgccctcaaaacccattcaattgaaaatgacaacaaacaaacaaacagaaacggggggggggcatttgcgctttttcttttgctgctttttcgcctttggtccgacagatggccacggcaatgacaaaacgtttttattttgcgtcgttttttcaaatgatcggatcaatgaatatctttggatttgatcacttttccttcttggcaaattcccttcctattattaattcgttcgttcgttcatttttggtggtgaaacttcattcattaggccacaattaataattttaaatagggtaaaatttaaaaggaaaactaaaaaattaaattaaatgcttaattagcaacggttcattgtttgtgtttcgtttctcaattgtccaattagaagcaattagcattttcatggacagctgttcttcccctgctgctgctgatttatttacctccaaacaacaaaaaataaaatatgtcgcgataattgtcccattataattgtgcaaaatacggccaattttggcaaggaatttcgacggacgaagccgagagtcgccctaaggccccttcccttcccggggctttaattgttcatttgggcaccgttcagcgcattacgcaacggtgccggagggggggggggaaattaagtggcataacgcaatttgctggtgatggacgggaagcaatgaatgaacgaaaaatgaaaaaatttggcacgaaaataatatttcaaattattcgaagaaatgtaatattaagaaatttggaacaaacaattagaaattatcaaaaatgacatatttttgttttcagaatgtctccgtccatttgtccgtgctcagtgccaacaacaaacttttgcttttctcccgcttttcctcccaaatgccatcgccggcggagggcgaaaatgcgcaaacatttcaatacgtaagaaaaaagcaaacaaacgaaaggcgggcaaaaagaaaacatttgcaggtcaactacggcaatgtgctcatttttcagctgagggcgaaatgcgccgacggatcggtgggccaaaaatgcacggaaatttgtgcaccaccgaaggcggggtcagccaaaagaaaataaattgggggaaatggcaaaaaaagaatggcaaaatggggggggggggaggggaatggcattaaataaatgaagatgggggaaaggcaaaatgggggaggggaaatgaatttgacacaattttgctgttaagaggccattac

SEQ ID NO: 26493 - DNA, 1526 bp, Heterodera glycines
cggccgaatgtcccgtcaaaaaattaatattcgggcgcgactcgcccgtctgaggccgagaagcagccgaatgcttcccgcaaaattaaatacgggcgcaaagcgcccgtcctgaggctgcgatcaattgctaaattacatcactttctagcgacgcggcgaagccgcgtccctgagcgcgaagcgctttcccctcaaatgagggccatatattaccaagccacgcatgcacaccatagccaactggtcaccctagtttatatactactaaagaaacagatgaactcattgctaaaacaaaaatctcgggaaccgctggcgggagggactcgggatttcgaccttgggggcaacttttgacggcgcatccaggaaaactataggcattccggtccgagggccaactgagcgccagcggcgctgaaacggcttttttaaatttttttttgctgtttttgggattcaaaaattttttaaagtcctaaatgaaaaatcggcctcgataggaaatcaagttgggaggtttggcacaactttttgctcttcaccgacctcgtagggcctaccagtttttccgaaaaactgcgcaaaaattgcatacttttttggccatttcagcgccggcggaataactcgtcggggtttggagggaggaggtcggtgtaagcggcttttttgtacagctcgacgagctctatccaaccatgtttttggatttctgaaattttcagaaattttcgagctaggccccctcgaaaattttccgtttttgaattttatgattttttacagatttttccggggaaaacggagaccactttcaagcaaccgtttttcatgctctatcgattggtgtcattttcagaaaaatttttaaaaatttttttggaaatagaaaatttttggttggtaggcctcaatttcagttctggcgcaataacttgtcaggagttgattttagcaaaaagtcatgcaagagcatttttgtagagaattaaaagcccaatctaatgtgctttatctcatgtttttaccatgagtttaaaaaaagttataaaattaattgtgattttgaaactcaaaaccataggggggaccccatggttttgcatttcatgaaaaatttttttgctcctaaattagccaaaatgcatttttatggcataatttgaggtgctgaatacgtatatacactttattttgcgtttcagactttttggaaggtgtttaaaattttttgaaaaatcgtcaaaatttgagccccggaaaatccagtgaaatttcgaaaattcataactgtcttcgtttttggtcaaatttagtggaataaagtttgaaaaatagcaaaaaattaggagaattttatgagatttatttggaatttctatctgcaaaaataaaaaagttattccagaatttctggaaaaattcgatttttcagaaaaaaattcctaactcccttctgaaaaagtattttataaaaataatatactcaaaaaatccgcaattttttgctctattcataa

SEQ ID NO: 26494 - DNA, 1486 bp, Heterodera glycines
ttcttcacttttggttcgggattcaaggaaggtgtcaaggcttctcagagagtttatttattccaaattaaaaaaagaaacaatcaattttctttggagaagacaaaacataaaactaatgcaactaaattcgaatacaagaaaaggtgggaaaaacggtcacaaataattaaacataatgccaaacaaatataaaaaataaaataaaggtcaaaaagtccaacacccccaaacaatcaaaaaaggcgtccctgcctttagccttgagttccttgaaaaccaaaaggggtggtcctctgagcagatcaacgacgatgggggcggccatcatttcggcgatcggagtcacggactcgcgcaggtccgtgcaaatgtccttggtacggctgatagcgcaccgatccacggcgtccatggagaattcggaacgacggattttggtctcgacgaggaccgacccggtctctcggaacagctgtggtcgtgtccgaacgaggatcggcctgatctctcgaagggactcctaccgctgacttgagcgtgcgcacactcagctcaatgtctccggggaatgacgattgggaaaaaatccaagctttaaggattttgcaccccggattgcgcattttaccgtcatccgtgaccaaatatttgttgaaatgatccccaaaacggaaaatttccaaaacagagcggcctttttctgtgatgcaaattgaaataatgggtccattatttattaaggccctcattttgtcgatcaattgatcatattcagcggatttgttgtggacatacgggggcgggcaccaataaattttgacatgactgaagcgacggcacagctccaccaccatttcgaattgttcggcaatggattcggcagtttctccggcgacaagcgagtcacggcctgtgattataagcatcgcttttactcgacttgacaaaatggtcggctgaaattgtcgaatgatgtctgccattgacccctcctgtccaatgcaaaatgaattggggatatattgtgaaagggcggcagctgatgaatctccgagcaaaacgcgctggtgtgccaaaaagcggcccgctttgtgcacaaccgtcgcccgcacacattcgagggcccaagcgctttggccaaacacttctttccacttcagcttttcggattcaggaagggaattgactccttctggctcctccatttccagcgggttgaatccggtggctgccaaagcctgtctggccacataacatgacccagcccacttctccagggcttttcgctggtcttcctccgttgggtatttgcccgaactgatctgatcacccctctttccaaaatacatgcaaagctccaattttggctgagcctttacaatcacttcaaccaacgtctgtgctgccgtcagcgaagaagcaacgcccgagcgaaggaggaagatgccgaggagcgcttgcagaggagtcttggccaccatcg

SEQ ID NO: 26495 - DNA, 1143 bp, Heterodera glycines
aaaaatgtggtttgaaaagtttattgaggaaaaaatagactttctaaaataattcccctgggagaagggagtgggaaacatgatttcaaaattttcaattttttctagtctaatctactcaaaccggttcagaattctataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgtcgagctagctggctcaaaaaaattttcgaaaatctgagtctttcgtttttattatttttttccataattaattcataaatatcttcttcagaaaaggtaccgagacgtgccaatatttgatttacatgttaggagaatgaggctatagctggttcgatcaaatggctattatttcactgatttcattgctcgtagtcctgcttagagatggaatttttgctctagatatatatctgacaaatgctgatctaagatcccttctcctatgaaagcatacagtgaggacagctctaaatattattaaatcattgccacaaacatcctattcacaatcctcccgatctcacattgaatcttatgacattaaatatggtcaagaaaataataatccatccccttcagaggaaatgaactctcctcaaatagaccgccaaagtgaagctatttgagaatcaatatttatgcttcgactcttatgctgaattaaaagaatttggatctattcctgcaaatgtataccttacgattttcctaattaagattagtggagttgaatttagagctgtagatgatagtgcttcagaaaccccacttgaatcatatagaattctttat

SEQ ID NO: 26496 - DNA, 1045 bp, Heterodera glycines
  misc_feature (979)..(979): n is a, c, g, or t
cggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaatggaaaaaattttgaagaggctctgcggaacggattagcatcggggttacgagatagaaaattgtcctaaaaagagatagccatttttctgagaattaattcacaatttccgcaactcttgcggtaatggaaaaaattttgaagaggctctgcggaacggattagcatcggggttacgagatagaaaattgtcctaaaaagagatagccatttttctgagaattaattcacaatttccgcagctcttgcggtaattgaaaaattttgaagagtctctgcggaacggatagcatcggggttacgagatagaaaattgtcctaaaaagagatagtcatttttctgagaataattcacaatttccgcagctcttagggtaatggaaaaaattttgaagaggctctgcggaacggatagcatcggggttacgagatagaaaatgtcctaaaagagatagccatttttctgagaataatttcacatttccgcagctcttanggtaatggaaaaaattttgaaagagctctgcgggacggattagcatcggggttacgagatagaaaa

SEQ ID NO: 26497 - DNA, 965 bp, Heterodera glycines
cttggatagaatattcctcacatttctttaccattattttaattaaaattttaatttaaaaaaatattccaacttttttctttcatgttaagcatcctaaaaacccaaaacttaatcaattggtcattttttttacaaattctgttaacaaatcgcattaaaaattacaaattttttcccggcggcgcctatcggcaccgccggccctccttgtcccccaaaagtcttggaaaaaacgtgccgcgtaaaaagcggtgttgaaagcaaaaaaaaggtcattgatttacattaatttacatggccggagaccccttcgcaaaattggaaaattggctgctgaccccttgttttgcaataatctgaattttgaggtctatatctgaattttagtgttctatgtcctgaatttgaaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggttgaaaaagttggtaccggtaccggtaccggtttttgcagtaccggtcagtaccggtaccggtttttttgcaattaccgattaccgctcaactctaatctaaaacattatttcgttgcaaattagtttcggtttggcattttgtaaacgatggctcattttactcgcacgaaaatgacgtcttgcggattatggcacatcggtccacttaggctatggcattttcttatttttgtgtatttttctgtccgattgtccagtgacgcccaaattgaccatttgctgctgctgcgtctccaattggacaattcgtcccaaaatagcattctgatcattttgaaaccgagtcagttggccaactgaaaccgggcaaagcattattagtttttag

SEQ ID NO: 26498 - DNA, 1432 bp, Heterodera glycines
caaaacgtacaaaaagcagcaacagcaacgaggatggcagaacgccaacaaacggcaaaaatttgtcaccaaaaaaacgcaaccattcacaacagcgtcagcaacagaacgacagcaaaaaaagcgcattgtccacagatttgggcctcaaatcagtggtggtacagagaaagctgaacagccagacgagtaaaaagcaattaaagtgtcaaattaataattaatgtaaaaatgggatatttaattggttggcattgtcttcgggatgatttatggagattttctggtctggttttaagggggaagggaccaaaacgggtgccctggtaatacggaattttattccaaaaagtttgacctcggttttaaaatttcggactctaatacacgtgatatgtgcgctctcgtgtgaatgtttggctaaaacgaatcgataaaatcatttgtgcaaaaacaaataattcttaattaaaaaataggaaattatttgttgtttgttttgttttgcgaaatttattataaaatttaaatcatttgtggggtttgatattttttttgaaacaaatttaaaatcattggaaacctgaaaatttggaatttttttttccaaaattaaacttgtaaatcgatgggtaactgaaaaatatacgttaaatttgaacgcatttaccgaattcatataaaaatttaaaaactacagtaattatggctggttactataaccgggacccacgcgtttcggcgctcgtgtttcggcgccagctcgtttttccacttaagcttttttctttggcatccaaatccaacaatcttggtatcattcgaaagctcaacatgctctattagccttatcaaaaacgaaaagtttttcaagcctgtaaaaattttattaagaaaaaacttcaaaaatttcgacttttcgcaatttccatgcataactgttttgataattgtctaatcgcaaagcaatagcttagaaaaagcttcaaaatagattaagctttcgaacgacaccaacaatgttggatttggtttacaaagaaaaaagttatagccaaaaacatgctggcgccgaaacgggagcgccgaaacgcagtggacccactataaccaaccatatataaatacgtacgtaccgtatcccccaaccgccgtcagattattcactgcgtgcagtgcgcaagaaaatcacggcctccaacgaattggtggtggagcaggacgaaggggtcgcaaaggccaaaccgccgaacgaacaccgctacaaaagagccgccaaagacgaaaatgaaaatgacgcttttggcgaggacgacggggatgaaaatgattacgatggtggtgaagatgagcatggcatttggctaaattggcgcgccaagaaacgggacaaccaaagcaacaaattgggcggtggctaaagttcgcaaaa

SEQ ID NO: 26499 - DNA, 1670 bp, Heterodera glycines
ctgttcggctgaaccgacggtccaacaatttatgccgtacatttggccacccattttgggtttggccaaatttggaatttctttccatcaccgatgatggccctccgaattgttcttcgtcatcatcgtcctgaagcaatgcctcgcaaatttcgcgggctcgaaaggtataacgttgctgctgatgttgttgatggaatctgctgctgctgcttgagagactgaaatttaaatttaaacacattaaattaaatttacattttaaagtggaaaatataattagtgctatttctaaaattaaatttttttttgaattaataaatgaaattgaaacacacaaaatttcctccgccgattttgtcggtggttcaacccgtacaaatggaaacacacacaaattggcgcagttcaacgttttcatcagcaatttacgttccactggcaaaggctcaggatggacaagtttcatgtcgaaactaaaaaattaaatatgaaaaagatagaattaacccagagcttcgatctcaaaattttgaaaatcctcatttcagccgtaaaaaatcctcattattgaattacagaaaattaactttgtcataaagtttttataaaagattacggtttcgtacctgaatacagtaccatcatccgacaactgttgagcctgaggctttatcgtacgccgagaacactgtagctcggccacaattagtgtgtttatctgtggaataatttttatttaattacaataaataaagtaattgcaatattaattttaaatcaacttttatcatttattaaaaatgattatgtaaaatttaacaataatgaattaaatctatgagaaattatctatatgaaatatttttaatcatttttaaaaaattcattaatttatataaattatattgcgcatatttaaaaaaataataatttacaagttttctttgtttttctttgttgttgtttttattacgaaatttgccaacaattttttttttattccaaattttctcccaaattttggcggtctttccccaaaactttgtcggattggtcaacaattcaattacacaaattcagagtgctcctcaatccacgaattccagcacaaattgggtgaagggaataatgaaataaaacaaaagaaaataaggtaaggaatgaaaggaagaaataatttggacaaaacacttgaacatttgctgggcaatgttaaaaaaaattaagtaaaatattgaaaatttttgtattttttttattaggccaggcctaaaatattaattaaatagcttttagggtttgaatataaaaaatgagaaattttgatattgagcgatttttccattattttatatttgaaaattttaagttttttttattagttctaaaatataaatttaaaaacacttctatgtttggattagtataaaaaagtaagaaattttttgctcatatgataaatttttgagagatttttcattattttatatattttaaaaaactttttgaaaagccacaatccttggcacttaaaaattatttttattattttaataattataatattaaaagaaatgaattaacggttattgaaattatgcattttggatttctgtttaacagagaacatccgaaaatatatgcaaattgagcaaaatccgactttt

SEQ ID NO: 26500 - DNA, 2416 bp, Heterodera glycines
atttataacaaaaattttttaagcattttctaaagaggctttttgacttcaatcataattatattgtcaattgtttgaaacgcatctgttgcagttggaagaggccgatggaaaatttttcggcttttcgcgaaaaagttttcccagaaaatggcgtgggacaaataaaaattgtacttttattatgagcaatatatatttcctatcaatttcaggtttgctttacacgtttgccaatgaaaaaatggagttttgtgaatgcaaattttaacggattttctttagacgtgtcataagcgggttgtttcgggacaaatgcaaaccaatttgatgctattcgaatgagctaggcgcgctctaccctttcaaatgtatcaacaaagggtgtcgccaaagcgactaagaaagaggagaaaaagaagaaatgatggaaaatggaaaaagagagagagaattgaggaagaagaattaattgtgttaattggaataatttaatatttgtgattgattttcttattatctaaattgtgatatttcctattcaatgtgattttcgtgcttagtattagtcactcttttttgttgttgatcgttctgtctaaattgctccacctccgcttttcctctctatttaaacacgcacgtttttcgcttcaacacattcttttcatctgacatcttattatatttaccaaataaaacttcttttatttattcggtatttatcccccccttattcaccccgccctctctccctcgcgccttcccatttttgcccccctttgccgcccgagtcaacaaatgggattttttaaaagaaaaaaaattctctatggtaaaaatttagaaaaaaaaaattaattttttctttacttttggtgtgttcgggcacgagttgtagtgcgattattttgttccagaacagtggaacagttgcgcacccttttggcccaacgggacgcaattaaagcggacgaaagcgcgttcaaagcgcagtgccgacaaaggctggacgaattagacacgcaaattgaacggcttgaacagtgcgagcggaatggtgtggatttacaattcagatcccttaaaatttccgggaaaaaaattgaaaacaattttctacaggataaatgccgcttgggaaggagacgggcagggaatgcgatggcttacaaatttttctattaaaaagtgtgaaaaacctacggtttccctctccgtcgaattttttttttctcgtaccaacactaaaaatgggggcgctgtagtgggataaatttttaggacctgattatataatatacttaattcttttttatgtagacaaataatgtgtccaaattgtggaaaagaaatttattcaaaaaaaagatgccgctgatgagcacgttgtcgacggtggcgccgacgaaatcgctgcggccaatgcggcggcggcggcgcaggcactgcacgacgatggcatggcacgggcgcgcgcgttggcggccgaagttggggcaacgaatcggcaaattgtgcgcctcagccggcggttgggtgcccgcccgtcccgggtggagttggcgcagtaccaacgcaaatttgtggagctgtgcaaccaaagtgagtggtgatgaaatgagttttttgcttttgtgctaatttttaattgcggcagtcgccggaaaaaattttgagattttgaaaaattttattaatttttttttttttttgtaaagttccaatgtccatgcaggttcttttattttgggttttaattttcaaataagaaaattcaaaaattatgtcttaatcatcacccgaacattaaattttgtgaaaaatcattttaatgaagcaaacaaaaaaaaaaaaattcatttcatggaatttccctaacaaataagcgccaaattccggcaccatcagggcatttttatttgtatatattcattaaaaatccgaaaattttgtcgatttttccattaaaaaatcaaaaaatttattccataccaaaaatttgaaattgtttaaatttggtcggcattttttttagtaagtgccaagcatggggagacaaaacgccaatacacactgtacaacacgttggtcagcaaacgggactttatccagcgcgaaattcgtctgctgaacagcattgatgaccaacgggagttggcccagcgggaggagtaccgggactcattgctggacaatttgcaacaaattggacgcggtgttgacgacagtcttgacaaggtgttgttgtggatggtctgggtgcactatgtttagagtcccccgaaaacttaaaaaaaaagattatttttttgaaagttttgataaattagtataaaaaaaaatgcaaaatttttcaacaacaaaaaaaaatcgctgaaattttttcaatttttctaatttttttttttgaaaa

SEQ ID NO: 26501 - DNA, 1537 bp, Heterodera glycines
ttaataaattttttaattaaaaaattgtttttcgacccccttgagaatgcgtcgcaacagcttggatgggataatcgcgctgacaaattgtacgaaagtccgtggccaacttaattttattattaattaaattttggcaatgtttttaaaacaaaaatggggaattttggcccccaaatttgcttttttaaatttaatacccattcaggtacataaaaaagtccgattaaatgtgaatatttgatcaacttgcctgcactgcttcctgctccaccatactcgagaagcagctcaatgggctctgttttcgtcgtcctaacgccagctcaacaccgtacatctattaaattaattaccatacacctatgatcacttggccgagaactctaatttctcagttatgatcacaattaccaaaattataaaatatctgatcagctcagatcagtttcaaacatttgtgtaacagtcagcgaaaaaaatgccctcaatttctgaacaaaacctgagaaaatgtgaactttcctaagccagttctcgaaatttcaccgaaattccaggaaaaaagggattaaaattttcaaaattgggttttcgacaatttaaatacggcacatgccaaaattccccaaaacacgaacatggagctgttcacgcagcaatcgtccgccgtccttgttcttcgccttgcgcaaaatgccgcccaaaatggacgcgttcatgcactccggtggtgccagccggcgttggatttccccaactgacacccggtacttcttctggttggacaacagtgtgagacggcccggcacgctacagtacgtctcataattgttgatcggatggaactgttgttgttgttgttgttgttgttgatcaatggtgatcagagcgccgatcggcggcagaaacggcacaatcactggcgacgattgcaactgatccgatgccggtggcatcacaaccacaactgattgtgaggaggatgatgatgagttggatgaggatgatgagtcatcagtgccagtttcctcaacatccgttgttatccatgttgacgaggaggacagtttcgtagtcgttgttgccgtcgttgactgtaaattgtaggacaaaagtaccgtaccagcaggaatataacagtagtcctctccataagaaaagaattatgtctcaaaatttcccaaaaattgatcagcaaacgaaatcctgggtcactgtttctattttctatacattttttaaattggcattaaaatctttcattttttgaaatggaggtactgtggttaggcgctggggagaattttaaaaaattgaatacaaattttaaaaatcataaaattttcctacagtatcgtccgagtccacaacactgtctccgtcctatagttagtgataatgttcataggctggcattctaaatttgatagcatttttcattgctggtgtgaaggactagtttctctgcacaagaatattgaacattataattttatcagtgaacgtttagacgcaacattatagaaacagatca

SEQ ID NO: 26502 - DNA, 1434 bp, Heterodera glycines
ccagcttcaaactggccgtgcatcgttttacaaggatctgtgcgtgctccatgatcgtgttgactcgttgaaaaaggtcattggctgcaacgaccaaattttggaagagtttgccactgaccaaagtgcgcaattggctgtagggagggaaaatgtcaaccgatacgttgaaagtacaattgaacggatgggaatgggtcagaacatttcgggttagttattcttttgcttgccttttaatccattgtttatttcaagctgaatttggaaactgcactgccaaggcgtcctcagaagtcattcgatccatcgctcacatcgaaaatgaaattggcaatttcaacacggcgattgatgagactttgaacacctttaggaaggaggctgagaaggtccaatgccctcagcaaagtttgtcaatatcaaactgattctaacaattgcaggctcaggctaagctccacgcttttgttagctcttgcaataagcgtcttcacagccaacgcggacagatcgaccaattctcagaagcgactttgggccgggttcaaaaaatgaacaatatcatgggagatcaggttggtggtattaactttttgatttaaaatatattttaagaaagagtcgacttcgtctatgcgagtgcatctgaatgccactttgaacgatgctcaatcaatggttgatcggtttgctcacagtgactacaaacgtgttatcgccacgggtaaaaaaatggagtgattattaaaaaagaacatccatccaattataggagttacgcctgtccgtcgcagaaacagttttagcgaggaattggtcgaacttccgccggcccaagaacttatccagtcgcagcagcagttgtgtactccacgtcgcaccagcttttatcggacccgcgactccattttggactcttccgactttctcacctctcttttatcaccaaacacgcttaaagagaacatgaacagcaccaagatggacgaagccggcaaattggagactatcggtgaaagcattgaacggactgcgagttcgaccctcagctgtagcagcagaaccgagaagagagggaaatgatggaaggacaaaagaatgacggcgaaatacaatactattgattttatgtttttctgtataacagtgattagcgtaaattggcgcaataaattctctctctctctctctctcgctgcattttttctagactttgcgtttttatttaaccaatcctatataataaagttgagtgtttgtatctgccatgctttgaattggcgtggcgttttgttattattttgcgttaaaaaatgatttgaaaaatggaaatgttttgttttgcttttttcatatttgttttgtcagtatttgatttttgcaaaagcacagctaaaaatttcttttttttttgtgtcgtatattcatagt

SEQ ID NO: 26503 - DNA, 1585 bp, Heterodera glycines
aagaattggttcatctgtcgccaaaaactttcgcttttttggtggtggctcctctccggcaatgaaattcgaccgttgcaaatgagcgaatgttaattaaacctagcttatgccaagtggcgagggatccctcaggcttagtttttagaatcttaatttttaaaaaagcacatttttcgatttttgggttggggcccaaacgaccccggggcccaaaaacgggggcccaaaaacgggggcccaaacgcgggggcccaaaaacgggggcccaaacgctctggtcccccagtttatgcgtccgatcaatttttatacatcaaaaattttttcaaagcaactcaagtaaacaaaaaacacactataaattcacctaccacaacaattttatatatttttcaccgttattgaaaatgggtaagctcatttgtgagttacagccgacctttttctccgttcgtcggcaaattaatttgagctaaaatttgatcaatttttaacaatttttgaaaaacataactttttgttagaattcgggtttggagttgggcaactccgagtgaaatcgtaattagaactctcgaaagcccccttaaactgaattagagccaaaataaataaatttatttatttttggcacaaatttgaggtatttcacacacaaataaatatttttacataaaaaacagcagccaatcaatcatcaaattaaacgcattaaatatcaatgggatggaatcatttgcggaaaatcgcactgaaaagcacagtgtcatcacgggtcagaaacacacagaacggatggtcagcgacaaaacggtattctttgcccggactgctcgaacaatatctcacattctttgctgtggctgctgcggcgacagtgccctcctcattcacctaaatttcgttgttgtttttctttttgataattacgcttaactattttccaaagatgggataagtaactacaaaaaaattattcatatgttaaaaaatgggaccaaattctcgaattttttttttaaaaaattcgatatctcaaattgaattcaaatcatgagcgatcaacgcacctcaatgaacgccttttgcaccacttcgctgatcagcaacggttcctcggcggaaatgcccccaaaattggcgccgtcggtgaacgcggtggccatgcccatgttaatcaaaggtttgttcagtttgtgcgtggcctcctactccacctgggaaataatctcaaaatcttgtcaacgaaatttttatataaaaaaactttcaaacagtccaaaaacgaaagtgaaatggtttctagcattttccgaaaccgaaaaaaagggttaaaattctttctcacagcaatttttgatgaaattctatttttaaatttattcacggttgtgtttcggcggctgtgttttgtcctgttccggcaccggggaatcctccccccccctcccccgaaatgaaaaaattttcaggaaaaagtcattaaaaattttgtagaccagaaaagcaaaaagaaaaaaaaacggatttttttacctttacagtgcgtttgtaccattttttgatcagttccacaaggctc

SEQ ID NO: 26504 - DNA, 1132 bp, Heterodera glycines
tagtgccacaccttgggcgtgggtgagagtgagcattgagcacaatttgttcatgctcacttcaaagaggtcggtaaccatgtagccgagctgcaacgccctgttgagctccacctcagtgtatgcggtgacccatgagcgctggtcgtcgccgtgccggcacgggcgttgctgtctccgctcggcacacgtggcacacagagggaacgtgaagcgcccgtccctggtccggtagccgagcagtggcacacggacgtgccgtggggccagcactcggaccagcaaaagaccgcggaaggtgttgcattccggtctgctccacggcagaggggcggtcggtggacggagcagcacctcccgggtcagcacccgtgggttcccgacaggaaatgggttgaccttctgcagtgcaatttgtgtttgcgtataacaaaaaaaaaatgtaaacagaccatgacataagggtagaggctgaccacgtcaatgcacaaaatctcctccccttcggcacacacgtggtggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatacaaaaaaaatgggggctcccaagtgcgcgaccgtgatagtaacagcccatccactcgatggccatcgggcgaaggggcggctcccgacgccaaaggccgtccacccgatacccgctgtcctcaatgtgcgcctctccgacggaccagctcgcacactgcacctgcgcgcccggatgctctagctcaaagaagcgaatgtagcgcctcgactcggcggaagcacgacgtccacgcaggtagccgccctccggggagtggaccaaccggttggctggcagaaagcattgtcgaagggtggccagcgcaagcccggcagcggttgacgc

SEQ ID NO: 26505 - DNA, 2022 bp, Heterodera glycines
aaaaaatattttgtgaaaatgacgactgcggctgttcatcctcctgctgtccgtcacgtccttttttcttctgctccttctcatctttagggttggatagcgctgaaacccgtaaaatatataggacaatacgttacttaaactaaaaaattaataaatttttttgaaaatcaacgaattaaaaatataagtttttcaaataaattaataaagcattaattcatctaaatttaaaattcacaaaaattaatatttttaattaggtttgtaagaagattttgatttaaaatataagttaaccgcttattttacgcgaacaccagcaccacaatttcggcttgatgcataggcctattaataaaaaagattttattttttcagaaaatcaactaagtggcttaaaatttacggacacaggaaaaaattaaattgaaaaaatcttgaaataaaattatttatattaacaactaaaaatttttcaaagaacaataaaaaatttaatttattatatttaaaatacccaaatcaattttattcattgtaataaattttcaacattttattattttgaataaaggatttaataaaaaagattaaaaaataaatacgtcttttaattaatgttgatgaggcacatattttctaagtaaactaatatgtataacaagtaataaaaattgtattttaaaattaacttatgacatagagaaaatggttctgggggtgactaattggtcaaactcacacctattgggggttttttgtgtaaataattaattgattattaattaattggggggggggtgatggaggagggcatggaggcagatgggatgaatggggaggggtgtcagatgaccatgggggccgacgtgatagatgggagtgtcgtttgctgtgctgttgccgtaccgcgggttgtcgtcgtattgtgcatctgagcaccgtttatttgcaggcaaaacacagacgccattttgtgtgaccatgaaatttcaggaaaattttttagccaaaaattttttatttgatgtttacatttaatgagttgaaacattcattttacttttagcaatccgaaaacaaacctaaaaagccagaaacataataaatttgtggaaaaatggtcattttttgggttgtctggctaggcaaatgtctcagaatttatgattttcatttttttttctccacaaagttttctgattttctaggcttccatcgtatggcccaatgtgcacggccgtgaggttgagcagtttcgccaatttcgtgaacaatgcccattcccggcgtactgtcacagcaaattcgaggccgaggagagcattcgaaaggctgcgaaagtgttggggagagaaggtccgtacagagaagtcacaccacaaggggcatcccgtttcgaatttgccctgtttcgaattcgaacattttgatacataattaaatgagtttcaaatgccgtttcaaaaaaactttaccaatatataattggtatcgaaaaacgggggagaatggaaccggatatagccgacatcgcaagaatgtggcatcgattttccggtcatttagcgataaaattacggtttcataaaaaattacaaaaaattttggttattgaattctggatggataaaaaaagacattcaaattggcgacttcctattaggcaaaatcagccatataaactgaatttcatgttttcgcgatattgggtttttccgtcaattccttttttcttttggtaaatccccctttttttctttgtagccatttacagtgtcatcgctcgtgtcggtccgttgtatggggagggtgaccgccgttcgttggtctgtgatgccattttgcttacccatcggttcggcgctgtgccgttggtcggcgaccagggcggcacgcttcaggcaaatttttggttcataatttccgacgacaaaaggtttccgaatttttattcgattgaaaatgtcaatctatgtagagtagttccatgccttttagcaaatagaacccattttt

SEQ ID NO: 26506 - DNA, 1161 bp, Heterodera glycines
  misc_feature (28)..(29): n is a, c, g, or t
agatgtcccgaatttcgaacagaatatnnttttagtgtctttttgcaaaaatgcttcaaaaaaaaaattgcgacccctgctgaaggggacagtggaaaatttttaaatttgaaaattaaaacaaatcataaaaattccaaaaaatttccctccccaccggcccctaaaaatccttatttttctttaaacagatttattgagattcaaatttttgcaaaatgaacgaatggaatgctcatgggggcgaaataatttccatttttggattgactgaattttcaaaaccatcaaacaacaattttttcctcatcagcaattgtacatcgcggtgggcatcagcggtgccatccaacacttggccggcatgaaggacagcaaagtgattgtggccatcaacaaggacaaggacgcgcccattttccaggttggcacagccgaacaaagggggtgcagttcatttcccccccccctcaccccccaaaaattttttttttttaaatttgctaacttggaaatttttcagaaaacaaaatcttactagtagaaattttttcataggaaaattcttagaaaaaaatttttttgagaaatttttatggtgaattactaaaaattttttaatttctcggggggaaacgagctgctcccaacaaaggagggggtcagaaattttcatttacaaaatacctccccgccaagggctggagaccaaaatggcaaagaatagtaattttttaccgaaaaaacggcaaataattttgtaaaatatacaccacccataattcgggatttcaaaaaacgaaaaatacacccctaaaaaccgaatttttgacttcagcccaccaaacagaatttgctgaatttccagaaaaaaatttaaaaaattcatttttttattcccccgaatttccataaacaaaaactttcggattaagctagaccgtcttttttgttttcaatgagttttgcgaattttttcccctttctaaaagatttttaagaatttttttttttttattcatttccgttttaattttctcgtatatttttgactcttcggtaatttttttaatttatcttctaaaggttgccgactttgggctcgttgcggatttgttcaaagctgtgcccgcagctaacggaacagctcaaaaaggcgaa

SEQ ID NO: 26507 - DNA, 1018 bp, Heterodera glycines
  misc_feature (35)..(35): n is a, c, g, or t
ttcctctttctctttctcttcccctttctcttccnctttctgttcttcttccactttctcttccactttctcttcttctttcggttcctctttctctttctctcccactttctgttctcttcctctttcttttccactttttcttttttcactttttctgttctcttccactttctcttccagtttctgttcttcttccactttctgtttctcttccactttcggttccactttcggttcctcttgctctttctcttccactttcggttccactttctgttcctcttccactttctcttccactttctgttcttcttccactttctctttctcttccactttctcttccactttctgttcttcttccactttctcttccactttcagttccactttctgttctcttcctctttcgcttccactttctcttctactttcggttcctctttctctttctcttccactttctcttcctctttctgttcttcttccactttctcttccactttctcttccactttcggttcctctttcactttctcttccactttctgttctcttcctctttcttttccactttttcttccactttcggttccactttcggttcctcttcctctttcttttccactttctctttctcttccactttctgttcttcttccactttctgttcctcttccactttcggttcctcttgctttcttttccacattctctttctcttccactttctgttctcttcctctttctcttccactttctgttctcttcctctttctcttccactttctctttttccactttctctttctcttccactttctcttccactttctgttcttcttccactttctctttctcttccactttttgttcttcttccactttctcttccactttcagttccactttctgttcctcttccactttcagttccactttctgttctcttcctctttctcttccactttctcttccacaatcggttcctcttgctctttcttttccactttct

SEQ ID NO: 26508 - DNA, 2033 bp, Heterodera glycines
aagaggattaaaattattaaataatgaatttttttttcctctaatttctttggcattttattttcccatttcaatttgccaatgtaatttttaggtgctaaaaacatccaaaaaagttactaaaattaatgaccaacattttcaaaacagccgtgatggtacgatattttcgaaaacaataggttccctggtctggcctctctcaatctgctcaaaacggtcaaacaagattttcaagtcgtgcagggtcgtttcgtaaaatccgtcattttagcgaatttttcgacaaaacatggcataactttgcttaaaggcaaccaaattttacattctcacgaagtgattaatctcgacggtaaattcggatgagtctattttttaaagaaaatttaattttatgctattgaataaaaacaatatgaacatctaatttccatttgttatcactagggtcgcaacttttagtgaaaaaactttttttttgctcaattgttttgagaaaaggagctcaaaaaacgtatttctgcgttgcgttaaaattttttcatttggacgtcacttttcgtcactagaaatcactattttggcgacttcgtcactaaaatagttaaaaatcactattttggcgacttcgtcactaaaatagttaaaaatcactattttggcgttttgtcactattttttcactatttcgacattttttggaaaattctttaacaaaaatgcaataaaaccaaaaaatacacccctaagaatcgacctaaaaattttttcaaaaagcactcctaagaaatgaaaaaaattttctaaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatggcactattcgtcactatttcggactttttgacactattttgtcactattttggcatttttactcactattttagttaactatttcgggatttttcgtcactaaaagttgcgaccctactaataattgaaaatgtgtccgatcaaccgataataaacattgaatattaagtattaacagcacaattatggtgaataaaatgtatattcacgatttttatccaaaaaaaaatttacaaaacaaaagggtcccccctatggtttttgataaaattcaaaatctatcactttataactagcgccaaatttgcttaataggcccaaataattgtcatattcgtgatcagcgacctttaaaacacccgggtacttggtttcaggactttttaaacaaaaaaaaaatttgaccaaaaaaaagttgaaaaaattttcaaaaggttactctttgcaactagcgccgaattttgtcaaaatgtcaatttatcttcagctgtgcggtctggtcgcccttctgctgacagtccaatgctggccaaatccgcttttccccttctgtttgggccgtgtcgtcgacttctttcagttgttcaacgccgtctgtgtccacggcttcttcctggtcggcactttcttcttggcattggcacatttgttcagtgccccggacgcattttaccattacaatttccaacttttggtagttttttattgaatgttcaatttatctatttattattcatttattaatttctgtatctaattgggcttaggaacaattttactgcgctttggcctccgttatgtatttgatgggctcagtgttcgctgttttgaacatgctcaaggcaatattcgcccctctgtggttttttcatttggtaactttttgaattattatttttttatatttttattttaagtttgtaacttttgccggttttggcctctacgcattcgacttttggacacgttggaaacgggacagtcagttgaggaaggagcaccagcagaaccaatccgtctatatcacttgaccaatcaaacgcacactttgcatacattcgcaattttc

SEQ ID NO: 26509 - DNA, 1757 bp, Heterodera glycines
  misc_feature (68)..(68): n is a, c, g, or t
caattcgggcgccaaatgcgtaccaaacgatttgggatgccacaaatggcagtgtcaaattgccgccnaaacacaacgccaagccaaccgcgaccatccatttgccattgattcggtcggcaaaaaagcctgttttaaaatttgaatttttatatttgggtattggaattttaatttagataaaatatttaatacttttttaattaaattggacgaaaatttttgaaaaaaaaattttttttttgttttttttgaatttgtttacctgtcgccaacatgaaaagtgagccaatgttttgtgctgcaagaagaaggccctgaaaatgtgcaattaaaaattctatttgaattatcgaaattctccccctcccctcaaaagaattctcggatttcccggtttaatacgagtgccaaaattaccgaacatctccggcaccactcaaaattctcttctgaaatgtcctaataaatagcctctcataattgcaaaaaattaattttaaaaacagcaataagccaaactccatttttaggccatttctttggccacaattttcgtaattaaaaatttaaaatttctttaactgatacggcacattcagagcttttccaaatgatgccaaaatgttttgacgtattttccaaagaccgtaaaactaattagcgctctaattggtttcatggcactaattgccgcactaattagtcggctatatgtaatatgccagctctatccgtccctctgcttgcctctttgtccgtctcccattccaacgtgccgtggtagccgtgccgcctttcgcatttgatcatgcaaatcactgccacctgtcacgggcatgagggcatttctcactccgctacttagccctattagatcgcatcaattttttgccctaattatcatttatttgctaattaatcactctgtccccccctccctttgtttattatgctacgctaattattgtgctaatgagctttggtcacgctaagtttatcgccgccgccgttaattgattgttttctccatctagtgatcgcgcaacctaattagcgttcacatttgctgctaattaattaattagccggcaattcgccgtcacgctaattagcgttgcgtattgttaattgggcaaaatttgccttacggcaatgtttgacgagctgacggagacggtaatgtacacaaggcaaaggcacagtgccaacagaaggcgcatcgatggcaaaagtgggacctgctgaagggggggggggggaagaaataattaataattattgaaaaatgaataattaaattctttttaaatactttaaactgtgcgagattttgtaaaattattaaaatttaattgaaaacgatagtttttaggttaaaaattagttttccgtgctttttttaaaattatttttcttttattctttcaattttatttattttttattttattccatttttaatttttaaattaatttttaaacgaaaaattttatttaaaatgattcaaaaatgattgaataatatttttcaataacattttattcatttttaagtaaaacaaaattatgcatattcattttttaaatatttaattattaaaaataaaatatttaattattaaaaatacatttaaaattaatttaatttaatttatttttccatgctttccttcttcacctttgaactgcttgttgatgatgatgaggacgaaaggaggtgttcaacgagttgattgaggatgcttttttgttgg

SEQ ID NO: 26510 - DNA, 1839 bp, Heterodera glycines
aaattttgttttctcaggaaatgcagcaaattttactttctcagtaacacctaggttttttttaaatttttatggcaattttgaaaaaagttttatttaattttttttgcggcgacgttacgtccccgcgaagccggcgacgttttgggggtgtacccacacacgagggcccgggttttgaacaatcccagacagcaactgttgctgctgcattcggaccgggttcccggatcaaaatcctattctcgaactgacctttggccgatattctgtgacagttgctcaggtccaacatttccaaagtgttggcgaacattccgccaattcggctcagcacccaatcgtcgatccatcgacagtccctcaggctgagcatccgaaggaattccaagtcgtacaaattgtcgaagccttcgtgtgagggaagtaaaaatgtttttttggaaggggataagtgccatagaaaaaaaaacaaaaacaatcgcgtaaaaaataaaattattagttaaagccaagctcagaaatggggtgcatttcattccctcctctgccccgtcgttttccccacatttttttttatttacaaacttaaattatataagaatttccaagaaaaaaatttttggaaaatttttcaggaacatcacagaatttaaaaaaaagctagaaaaacttggtataatttcctatatctgaaaaatatccgttttaaaatttaaaaaacaaattttcgaaggtggggaaacgtcctgctcataataagcgagaaaagttgtattttgttaaagaattccatcaattctatttccccccttttttcttcggtctgcccaccttcgaacatcagttcggtgccggaagcgtcaattgcctccacgtaaaagccctccgttttggtgcccggcaaatagtaagtgcccgcccgtccctcgcgcttgtaccagtggtcgtcgccgacaaatttgacggaaccatgcctaaaaaggcgacaaaaaggcatgtttttcttttgaaatcttgtgccaaattttgcctgtgcactatgaaatgggctgcggcgaggtcggcgcccaggaaaatcagtcgatctggcaaaaacctaaaaaacggaaagaaaaattgtaaaattagtcgagagatcggcgtgattgatccaattaaagaacaattaaaaatcttgaattcatttaaatatttttttcataaggagaaatttgctgaaaggtttttttacgagcttgtgccgatgttcaatttttaatttccaatatgcctcattaagaagaaaaaacttaaaaatgtaaaactcttgttttttggaacgggaaaacagtaatttttggtcagtcatctttaaaaaatttgcacaaatttttcgacctttggtcgtattgcatggcttggaatttgcggtattccctgcagcggcgaatgttgtccatgctgtggtcaagatacctctgtgaagaaaaagcagacaattgtttatttattgtccatattttgactctctgaattgaaaaaatggaatttcaatttcggaaaatgaaattgcggttaaaaaccctcgaaaagcggctgcatttctctgttgtgagacaaaaggaccaatgctttttttatataaaaaaagtgacgggttttcacatattttaatgcaaaccacaattatggctaggcccgtaccatggagggggaatgaaaattttagttttttcagaaaaaaaggtaatttggccctaagttttccccgaaaatgcctaacggcaccgccggagcccaaattttcttatatttttgacaaaatcttgtcacaaagttgccaattctgccgaaaat

SEQ ID NO: 26511 - DNA, 1307 bp, Heterodera glycines
tatagcacaaaaggattaaataaaatcgctcaatcgaagaaagctaaataattaataaggaaataaaaatttcataatttttgtattgaaatgtaccgataggttgcaatataataatataaatttaaatttattgaaaaataccgaatttttgatgttttctgcaaaattttcggatttttatgtcattaattacattctggtcagataaagattaaaattctgaattttagtaatattcttaattgtttgaaaatagttatttgaagtaaatttattcaaaatgtttataatatttctttacttttggtttttaaaattataaattttcacttgaataatcaaaaattttaatttttccatttttaaacttttttattgggaaaattaccagcttgttcccgtttcacgtcccgggcgaaaatcgaggtgcactccaggtttttcagtcccggcaattcccggtccaggttttggtttattaaattcataaattttcattaaaaaaaagttgaaaaaattggcaaaacgccaaaatatgaattttaactatttaatgacaaaacgccaaaataatcatttataatgacgagaaatgcgttttaccatataaatataaattcgacaaccaacctttaaaataacaagaattttttacgaaaaaaagacaacagtaacaaaaataataattataaaaatacttgcaaaacacttaaatacgtcatttatcaatagaatctttataaaaataataatttatgaaacattaccatcaaacttaaataatatcaattgctataaatgaccttttaggtatggttcgaagcgctcaaacgcgcagtctttttcactctgaacggaaccaattgatctgattgggcattgattgatttcatctaattgtttaaaaattgctgtctaaaaaaatttaaaattaaaaaattattaaaaaatctattaaattttttaaagagaatttaaatttaaaaaaatctaaactttaatttatttgatacggcgtaataattataaatcattacaaccaatcgttaatttattgttttgatcaacatacttaatctttaaagttcgagtttcagatttattagaaagaattcaaaaatgatggaatatataaaaataataaatctattttgtatttaagaaaaattttgatacagagctacttagcttttttttagtaattcaatattattttttcttttatttgataaggtataaatttacgaaattatatatagcgttggaatatcattttgctagataaaatggtgcaccactttttt

SEQ ID NO: 26512 - DNA, 620 bp, Heterodera glycines
attttatacgcaattatttttttcaaagcatgatgggacaacacttatgaccatgactgtatgtcaaacggagccatacacaaaaagggatacgaaaacatgaagcacatgcgaagaacgattgccattttctgttatggcccggatttgaatttttaaacaaacattgaatagaattgcaagatattcgtcactattgcataaatttaaaaaaaggcatttttcgaagacacaaattattgcatttatttatgcctccgaaattatttagttttcgaactatgagcccttttttaaaaactcacgggccacaaaacagaaaagtaccgtaggtttgagatatgtacagactgatcaagggggaaaaaagtaaatatattggtgctatgtcgttatataacaaccatcaaaaagggcgttatataaaaaaccatcaaatggaaattttcaacaaaaaactgtccataacttttgtcaaagttaaccaaattaaacattcttggtatcattggatagccctaacatttctctacaagctcatctaaatttcaaaaaatttgctcaagttgagaaaagttatggacaaaagtacgcaaggcaccaagtttgcacacattttt

SEQ ID NO: 26513 - DNA, 1203 bp, Heterodera glycines
ttgagataatttttttttccgattcctttatctccaagcatgagccttataagtgattgttcatatccttctcttgaaaaaaattgtcagtaaaaaaaacacgttttctgaatattagcaacaaaaatttttagccactttctaaagaggaaggaaaaaaatttttcatttgcttaatatttatttatactgttgatctgttggaaatgcatctgatgccgtcggaaaagctccgattttgtggggaagttttcttctttcagtctcacctcctgatttgttgaggctaatttttttcgccaatttcttttgtctacaaacattatttattgcgtttcatcctgtagtgtgtaaaaaattttcagtaaaaaaaacttgttatctgaatatttacaagcaaaatttaagaccatttccaaagaggaaggaacaaaaatttttgcctaaattttatattatattgttgaattgtttgaaatgcatctgttgtctgccgttttgaaatttttcaacttttcgcgaaaagatttcccagaaaatgcatgggacaaataaaaattaaacttctattatgatcaatttaaatttcctatcagtttcgggtttgctttaaacacgctggcctatgaaaaaatggagttttatggatgtcaaattttgggacttttcttcgacgtggccatcagcgggttgtttcgtgacaaaaacaaaccagtttgatgttattcgaatgagctagacgcgctctacattttcaaatgtatcaacaaagggtctaccgccactccctggcgagatatggcctgtcaaagcagaacggggccaataaatttgaatttttgttaatcttcggcagttgcctttatttcgagcctactctacttgtgcatcttttcccaatatggcactgcttccgaattattgaactgtttcacgactgattgttgagataatttttttttccgattcctttatctccaagcatgagccttataagtgattgttcatatccttctcttgaaaaaaattgtcagtaaaaaaaacacgttttctgaatattaacaacaaaaatttttagacactttctaaagaggaaggaaaaaaatttttcatttacctaatatttatttatactgttgaactgttggaatgcagctgatgccgtcggaaagctccgattctttgcgtgagtttttttctttc

SEQ ID NO: 26514 - DNA, 1931 bp, Heterodera glycines
atctgaggatttttcctcattttgtgatcttttagagggtcaaagaggattttttttttggaactgaggatttgcggatttttgtggtcttttgataaaaaagtgacaaaatatataattgatgtgttatactgtttgcagctgcaccctgtggcttttgctttagccaatatacatattatgtgaacgtcgttttgcgtttctcaaccaaagtgacaacatattcgtttaaagtgacaactgcactttattttcatattagccgtcagatccatactttagcgtctgaacaggtaaagccacacattctctaccattatgaattttcaaatcctctttccttgacaattcttggtcgtaaaatgcgtctgaattcgcaacatttggccatcatatgcatgttctgttctccttttcaaatacgtgtttgcgttgtagaattcagacactgtacccataggcaatttgaaccattcttttctaggaagaaagcggtttgaaggtgataaagcggttgccatcgtatttatagaaagtggctccaatacgataactttaaaatatataacggatgtgttattctgtttgcagctgcaccctgtggcttttgctttggccaatacattatgtgaacgtcgttttgcgtttctcaaccaaagtgacatatttcgttctttttgactcgaaaaaacatcggtcacttgaaataataaagtccaaaattttgtccaggaattcggattttttagcctcgacctgtattttttctagagttgggtaaaaaaaaatttccgggaacgggaaaaccaaaatgaacggggcgggattcgcgaacgggattcccgccttttttcccgttcccgtaaaaatcccgttggcgaaaaaagacgggaaacgggattcccggcttttcccgcgggattcccgttcccgcccaactctaattttttcatatttggcctggaaaaacccaggtccaatatttaaatttacatgctaaactaggggttaactctactgtgtggagaaaaactatgtacaatataataaacatatgaatatgtctttggaggcgtacaacagaacgattatacaataatacagcaatacatgtgcatgggaaatacatattggagtttcttgtcattaaacggcataattcgcgacatcgattcacttaagaaccctccgatgaagatgatgcgtcctctgtgccttcagaagttgcgtccgaagtcccagaactcccctcagagccagaatccaatgctgaatacttacccatatcttctgcatagtaactgagttctcatcgtccaagcgtccagtgtgctccaccgagtccacatgcgctccctccgttgacactgtatactccgatacgaatgatgccaactggccttgttctgcttatcctcacacagccgacttaacctcatcattcttctcatctatctattcaactcatatcttctttgattaaaatgattatgaatggatactccttgaatgcactatacccctctgcgtaatatttcagatcaactatttacttgctctatacttctggctcaaaaaatttagttatatttcaatttatttacctatcgcctttctaatgctgaaaaaataggagattgtgtaaaatttacgtgcttatctttgtaatatactactatttaataaacttactttaaatattaaaatttcactacatgatccatcatttactggattaattcttaacaaatatgcatggtttatatgagactcttctaaatatcctatgtaacttctctcttttgtttgataatcattttattcattacggataataaaatatatttcttaatgtcactcgtatcttttcactcgcttttgtcactattaatttagtttgtagaaagtgtattagtaacaaatgttttatg

SEQ ID NO: 26515 - DNA, 2150 bp, Heterodera glycines
ttgcgagacggagatggcttagattgctaagtaacatgccacgctgagccgaggttaatcctcgtaaattttggcccggggaaggctctgtccttcccttaaatgtcctttgaattttaaaaataattctcttgataaattttaagtgagttgagaatttattttggtcgaacaatcctcaagtgcttaagaatttgatagcttattatttatagaattttaaaattcacagattccgcctgtcgttattttttctcaaagcaatgtcgaaatcatattttacgtttaacgttatcattacatggcgtatgaatagaagagatattaagcaagaaaattggaaatatagaaaaaattttaaaaataatttctcttgataaatttttagtgagttgagaatttattttggtcgaacaatcctcaagtgcctaagaatttgatagcttattatttatagaattttaaactttacagattccgcctgagggtagtttcacatgcagattttgggggttaaatttcagccccgccatttcagtcccactggaaagggacatttcagtaccaaatttaaacctttaaaaaacacctataataaatatatccaatcccagaagaggtaaataattgaaaaaacatctgaaggataaaacccgaggtcaaatcctattagagaaggaaagggaggcagaggatgggcgtcaagggacgcatgccacctgagcgcccgcgtgtgtgccatttaaacgctcgcgtatgccatttgagccccagatttatttttacagcgcagccatttgagccccagagttatttttacagcgcagccatttgagccccagagttatttttacagtgccgccatttgagccccagagttattttttaagtttagccatttcactcccagtgcccacgggatatttcagttctgagacctaaagcctattgagtagtcaaagtctacagagagtcattaacattccttttaagtgcattttgaccaacgctaagcctacggagggtcattaatctttcctttgagtgcatttctaactaatgcctccgaaagtgttataaatatctccttacgagatgtggagtatgttgtgccaaagccaactgagcgccattaaccattcttttgtgaacatgtctgtccaacagaagctagtggtcattaattatccccttgggaattcttttttgtgcatttctgaccgagccaaaaccaatggaatggtcattaataaccccttggacgcattttgattgtataatacccacggaagtgtcaataatatccctattgccggttgactttcagttgtgagtcaatgattaattgtgacagttgtgactatgcaaaacccgacatcagatattctgtgcttgagacagctgcctcttttggcaaagtgccaaatttagccaagctgaaaaatagccccgcctactcggtggagtataaatagcaggtcatttccagcaaaagtgcattttttccattcatttggaaattttgaaatctttcttcaaacgactaacgcgctctttcccttttgcttcctcgctctctgcgactatttaaaccaatttcaccataaacttttgtttcctaccatccctttaaactttttctttcccttttcttcactatttcaacctaattcaatataattccctaatcttccaataaacctaaaacattataattttaaatcatattacaattaaataattaattacaaaaatactttaattttctacgtatccttacatcttttacctacttacccctttttgcttttgcttttcctccttgctcactatttaaacccatttcaccacttaattttaatataaatccctcaatttgaaaaatataaaaactccaataaacttaattaaatcataaaatttttataaaaactttacttcataaaatttaaaaactttcctttattcatatatccatattttacccaatcaattaataaaaactaataaatatgaagcgtgtctctaaagcccaatcttcatcttcctccccaaaaaagttccaaccgaaatgtattcgtaaacttgaccaatttacttcaaaaagcattaaacatcattttattcgttcaaaatctaaatttgttatt

SEQ ID NO: 26516 - DNA, 1075 bp, Heterodera glycines
gatttttacttacaccattttttgctaggcttagatcacatgcgattttcgccactctgatatttttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttgaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgagaagctttttgagcgtaattacgatttttacttaaaccatttttttctaggcttagatcacatgcgattttcggcactctgataattttagcgctataatgggatgtataaaggcgattgtagaaggaattggaagcgccaaaatgtttgagaagctttttgagcgtaatacgattttta

SEQ ID NO: 26517 - DNA, 1293 bp, Heterodera glycines
ttgcttttttatttatttttctcttttttacgccgacctcccgccgctttttcttcttttttcacttcaattaaactcatgtcaaaatttgggtctttagcaaaattaatattcgccatttctaagaatgtttttgcgtcattcattgtcaaaatttgcaataaattttgttggttgcctttgtttttggccacgtctaaataaagcagaacttttagcattcaaattacttttttataatacgtatgtgtctaattaatcattttgatttaacctgctaaaatcgcagcaaattttccatataaatttttttgcttttttttatttgtcaaaaacttgttcagttcagcaaaatgcatcgctttgatcgcttcgatcggttcattgaatttgtccccgctttcaatccatcccaatttgcccttttctcggacggaatgaatcatttctgccaatgcaatttcaaagtttgggtcgtccaatttctttttctccattttttcaacgaatttaaatgtttctaatgaaaaaaaatatttttaaaaaatatttactattaataaatttaaattaccgtcaacaaaactgctgaacataaaactcgcttctcttgcaatttcggtggacagagaatcgttaaaaattcggcaataaaagtacaaaaaatccgcaaattgttgcccatttgctcctccgatgcttctcggttttgattccatccgattgtaccacacaaaaatatctgcggccaatcgttggagcgtttttgacgggtcaatgggcggagagtccaagccaaaaaattgggcataatggtcaagcagacgcatttcattgaaatatgaaaaaaataataatttgcaaaatgtaaaatagcaaaatttgtttttagggctgagaattatatttattaaaaatcccgaatagttaacagttcctaaatagggcgaagatttatatggccaaaaaaaatagacgaaaagcgctgaaatatggccaagaaatacgaaaatatagacaaaaaatttctgaataaaaatcgtaaaccgataaaaaaaaattgcaaaattagtttatcagctgaatataatccccattcaaattctattttcaattgtctttatgttcatttttaattaaaataaaattatccacaaacaaacaatttttgttgatcagtttttggcgcaccgatggcattgcccaaatttgtatcattttgacgtgccctcccaccaaatcgttcatggccaacaacgcgccgtccttttccctgagaatgtgcacgatttc

SEQ ID NO: 26518 - DNA, 881 bp, Heterodera glycines
aaagaacagaaagaggggagagagatagagagacatagagagagagaagagagacgaagaaaatgaaatggagcgatttgaggattaattaataattggggaccaaaattcagtgaatttgactctattatactcaatttttggcacttcgcggactcttccctatttttttttttgtacaaaagttaaacccacgacaaactgtgccaccggcaaaatggtcgagggagggtgaacaatgaatgatcagtgagtgtgatcagtggcactcggagtcatttgccaaatgccatcgatgacgaactgtaaaaagaaaaacattagttatgtgtgtttagtgaatttaaattcaaagtaaatttgaagaattcaaggacagaagaacttccgtcacttccaaatgaatgaattaattaattaattacatctaatcacaatcaatcagcagttgcttattcgattattgcttttccttatcattttatgttcattttcatcatcggactctctgctccaaaagtgagagtttcaacatttgaaatgcaatttgatgactcattcattcactcgaagcgctgatgagtcagtcatcttacattttgtttgctatttaatggactttccatgggaaaacttattaaattttttaaattttcatcaatttaacaggccaatttccaattgaaaatggcgtgaaaatgtcataaaatgtgagtaattaattaattcattactccggcggaataaaatttgtggaatttgaaaaatctgaaattacataaaaattaaataaatacaaaacaatttcctgtccaaaaatatgtaacaaaggcaattgaaatttttcggaatttataagtgaaagcatcgagatggtactt

SEQ ID NO: 26519 - DNA, 898 bp, Heterodera glycines
ttttatttgtcaggtccctaggcttgagccaagtcttgatgccgagataagagatcgaaattattcgagaaacgagatctatcgggccaatgcttgagataagactactctaacaacaaaagacgagaataggtacataagtaagaagttttgacgagaaaaataaggggaccgccgccacattcattaaaccaattggcattggcattcattcggtggtcgaccggacggtccattgaaagcgaaagggccgaaaatttgacaaattgcagggaaaaggagaagagggggcgggaggggaggcaaaggcacacaacacattggaaaaagtgaatggagagaagggcggacgaatgaatgagaatggttttttggaagataaatacgctggaagaaaatggaagtagggagaaaagtgaaagtgaagacagaacgaaggagggaggggggagaaatagtacaccatggaataagaaaaagagaaagcgagagagtggaaggaaaagaagaaaatggtcggccgaaaacgcacggaaattggaaaaatgtatgcgcttccgtgattaatttggtgaacaatgaatgcatacataggccgagatagaggggaggagagaaggaaagagagaagagggagaaagagagatgggaagaaagagagaagagggagaaagagagagggagagagaaagagagatgggaaggacacaacgaagacatacagcactaaaatcagtgatcacattcactaaagcaccaaatcagtgatcaccaatcacaaagcatcaaaatcagtgatcaccaatcaaaccgttggaccatttaaaacaaacaaaactttaagtctaaaaaatttagacaaatagcctaagaagaagaaaagtggtcgtaatagatg

SEQ ID NO: 26520 - DNA, 1478 bp, Heterodera glycines
cattctctctctcttcccctctctctctcttccccatccttcacctcctctctccccgtccctaaaccaaaccgcagattttcttcgtctccgttgtgcttcttctcccctccccgcccccttcgtttgtttggtgttttttgcctctgctcccctccagggaatgcttcttgttgcccgggtacttaacctagtgatttgcctaaaagcagcacattcatttagtcataaatgcgtttattactcccccaaattcaccccccccccccccctctccgttcccattgctctcaaaataatttattaatagtccaaacggagaacagcaaaagcaaagggtgcgaggcgtaagggggatggctcggggagagggtgccatgcttttcatacgtgcttctggtgccatatagtgccgtgccttttatggcgttctgatggttcatgcctttgtatgtgccgatgttccctcatcccttggcatgccatgccattccctcttctttttccatcccttccaaaaatgccatcctttttctttttggctttcgccctgccatgccggatcttctcttccgcgcacattccttcactgtttgggtggggcgtctctttcccgtcacttttttcgtcctttgcctgcaaaaccttttccgaccagcggggaatgatttgcgagatgaattccgagacaaattgttcggtcggcttttttcgaaagctgctgaaggtcagctgacaaagcagtccatcaatcagacaaaacaaacgaaaagcaaagaaaggaaaagcaaagcgaaaggacggcaaagggacggaaaggcatgtcccccaatgcatcaatcactgattcaaagatcggtgactgatcggcgatgatcagtcggcgaggtgacaatgtccgagggtacagaggaggaggagggcattcattttggctttactttcgcgtgctttcgtcagaccaacaaaaaaaaacgggatggatccgccacgtcggacgccccccccccatttaaccccggttattagccactgcttctcgttttcgctgtccattcacgcagaattaccaccggcggaagaatccctccgctgatttgatctgataaaaccgcccattaaatgtttcttatttccaaaagcgatcaaatcattgctgattagtttgtgtttattgttcggtttagccatcagcagagaaaatgaccgagtcggacagtcgcattcgggcgtacaaattcgttgcctattcggccgtcactttctccatcgtggccgttctctctgttgtggtcactctgcccatggtgtacaattacgtagcccacgttcggcgacagatgcagcacgagctcggcttttgcaaggttgggagggaagagggaattggtgccgaatgcttttgggggttggcactggcatatttccaatggcattggaattggaatgccgttggaattgacatttggcattttgac

SEQ ID NO: 26521 - DNA, 1370 bp, Heterodera glycines
  misc_feature (25)..(25): n is a, c, g, or t
ataatacatttatcaattacatttntaatatttgcctttataattgaattttttgcaatttaattttcttttaatttttttacgcatgtcatttttagcattgccatgccattgaaacatttgaacatttggcttttaaatgaaaaacgagaaaaaaaactaaattttaaaactgtaacagaacgaaaaacattaaagaataaaacgaaaactctaaaaagccataaatattaaaaattaatgagcatttaaattgcaatgaaccaacagtgtgcataaaaaatgagcaaaatttcaaattcctggaatttattcaacaaagaaaatagtccaaaaaatggataacagctgctaagtttttagatacatttatcacaaataaagcatcattttatcgaaaaactaaatttatgtaattaatataaaaagaaattttataaaattaagtttatcttaatgcaattttctctaagtccaccgttgtcatgtggacgctgttggaaaaatttgaaatttaatttgagttattttttaaacggttagccgacttttgcgccgcgccatttacgccgcgacacttgcgccgctcagcaaaaaagactcttgcgccgcggacatttgcgccgtgccatttgcgccgcgacatttgcgccgtacagcgaaaaaagagatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggaggattttaagcgaaaaaaaaaaaggtaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattataaaggaattgaatttcattcctttttcgaagcaaaaaaataattgggggttctacagaaaattcttttttttcggttttttgttagtttgtattcttaatcattttttcatatctttgatgaacctattcaatgttaagattttaatggttaaaattgaatgtcaatctttgtgactaataattttttcgaattttcaattagttatttttgtcgatggcttatagttttagtaaaacttattgataatagtggaatttttatgaatataatatttttgacagcgcggcgcaaaagtccatttttgctgggcggcgcaaatatccgcggcgcaaatg

SEQ ID NO: 26522 - DNA, 1645 bp, Heterodera glycines
  misc_feature (1564)..(1564): n is a, c, g, or t
  misc_feature (1619)..(1619): n is a, c, g, or t
agattggaaaacgacacattctttaataaaacagattccaccactgggttccttttcccaggatatccttacaaatgagcattcgaaaaaaacattagaaattttccaatttttcaaattttatgccaatattttttattgataaaagttgcaataaattcctaaatggatcggccagtggcgaccccccccccccccatcggccaatcgtacgaggatatcattcttattgctggctgacttcttatgcacctatgaccttaaaatattatgctaaaagcatacatttttagaaatagctcatttttaatgaaatgtttttttatttgctagtattaaaataaaggaataatttttgtttttaagattttttcagtgaagaaatgatcagtgacgaaacaattagtgaagaaatgatcggtcaccgaaagaaaatttagtcaattttaaaagaaaatcaaaattgtatgctttgattgaaaactgcattttttgcaaaatctttatgctttttttcagcaaaaaagttgttgagctttcgaaaggtgctgagttgattggatttgataaacaatgaaaaaagctatggctttcagcctaattaataattttataatcaaatatcaacaaacaattcatttatcagtcccaaaaattgacagaattatcaacaaatgatttgacttttgtcaaattatttatcaaatcattcggcaacgctttttcatgtctcacttttttgacttggtcgatttgcttgaacttcctccgtcctttttcttgtctttaacaattttaaaagcattagcaattttagaaaacatcgatgactttgcttttttcttttttggcgatgcttttgatggtttgattaatgatcctttatgtggcggctttttccctccgcttccgctaacaattgaaattccactcgtcgatcgtttagccagcactttattgccaaatatggtctgaattttatcaaatgtattgggaatacccaaaattgattattgcttaatttttttatttttttagggtggcgaaaaattggtttttttaaaatttatttttcctcgttctgggccgacggtcccgactttttggtagctcaaccagcttaaaatattgggattgccttcttttaaatctccgatccattcatttcatttgtttaaattttttggtcataattaataaatgcaaattttgcaaaacatcaaaatcttttgaaaaaaagttgccaaaaagtcgcttaaaaatcgttaacgccgccgaaaacaatattaaaatttttggattggagtttattaagttttcaagaaaattcatttttgccaaaaaaatgcaattcttaaacgtgtattcttactcgcccgtggaaaatcccggaaagctaagaaaaatacggagcggatttacgcaaaatcccaacaagattttcgctaaaatgagttttggtctctaatttcattctccaatttttaccgttttttggttgtgcgacaaatttccgattgtgcccaaagaattgagtgattcaaatgcataagaaaaggttganaaacagatgtgaattgacaaaaaaatatggataaataaatgcattattttactanatcatatttatttaataattaataac

SEQ ID NO: 26523 - DNA, 1401 bp, Heterodera glycines
  misc_feature (192)..(192): n is a, c, g, or t
  misc_feature (194)..(194): n is a, c, g, or t
  misc_feature (204)..(204): n is a, c, g, or t
  misc_feature (207)..(207): n is a, c, g, or t
  misc_feature (223)..(223): n is a, c, g, or t
  misc_feature (229)..(229): n is a, c, g, or t
  misc_feature (238)..(238): n is a, c, g, or t
  misc_feature (241)..(241): n is a, c, g, or t
  misc_feature (244)..(244): n is a, c, g, or t
  misc_feature (252)..(252): n is a, c, g, or t
  misc_feature (254)..(254): n is a, c, g, or t
  misc_feature (257)..(257): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (281)..(281): n is a, c, g, or t
  misc_feature (295)..(295): n is a, c, g, or t
cccaactcacctccaactttcacaaccagtctaccacctcacaaatatcaaaatcaaaatcctaaaaaccacatccaatttcacctaatcactcaaaatcaactcccccttccccatcaactattatccccactcttcatcttctttcaacttcctatttatctcactcatatcacactccacctcatcctntnctctcatcantcnttccaccttttccatntctttncccatttcnttnccncccaattncnctnctttttccccaatncnttcnttcntctcttccactttntcattcaatctaaggacttaaatagtgccgcgtccgtcacttccgttggcacggtcactccgctgacctgcgagtgccgcgttgagaagtgttcggtagatgctcagtcggcccgccagccgttgccagccttcgttcacttccgccagccttttgcgcacatagtccgattcggccgactttcgcccgatcaatcgtcccccgaggcgattcgcctccgccagagtgccctcgtcgattccttggctttcgtccagccggtccagcctggatttgaaggggtgggtggtcatctgttgtccgtttgtgctcccccaatcactgacagtgattggcaatgctccaaatcttttcccaaatcttccgcaccgaccatcccttctttggcccgcacaaatgtgcacaatcggtctgctaattgctctaactccagcaagtcgcgtgcttcgtctaacgccgcgtgcaatttgcgcatcgcctcactgagttttgaccaacgcaaaagaaactcatccgcccgagagacctttcaagcaaaaagaataaattaatgagttccaatggggcgggccattttgggcatgatgccaacgttttccgtgtctccgtgtcatgtcctcccccttcccctccccgtccctctcgccaccgtttgactcaccgccgtctccgtgccatggcgccccctcagccattccaatcgctctctcattttgtcaatgcgtgtgccattggcgtccatctcccgctgcagtgcctgctgtcgcttcagtctgtccaacttttgctctaacgacgccccgcccgcttccgccgtttgtgctttgacgcgcttttccttctcctcaacccattcgcacatttctgacaatttggcttcaaattgctccaactcgactccctcgtccagcagccgcttaaccttttcaattcgctctcgaaggccgcccattcgcaagacgacctaacaaaagttacaaattgggtaatcgtggggataatttggataattaacggactcgatgataaatgggatgataaaacggaattgctgataattttgtcatttgtgtttccctgccaccttttttgccattcttttgcat

SEQ ID NO: 26524 - DNA, 1480 bp, Heterodera glycines
  misc_feature (1463)..(1464): n is a, c, g, or t
  misc_feature (1466)..(1466): n is a, c, g, or t
  misc_feature (1477)..(1477): n is a, c, g, or t
ccctaccattcaaaaaggcaattcgttagagaatttttgtgcttttttctggcagcccaatcaaaaaattacagaaaaaatttcacagcccttaatttttttctaaatttttcccaatttcaagccattttgacttttcctgattaccgtgaaggagggctctgatcaagttggtgtataataattttttgatcagcattaaaagttaagcaagcatgaattatttgaggtttttaaatgaactttaaggtggtttttcatgtttgagtcaagacttttttccgcccttcctttgttgagtcaagtctgatcaagtgaatcaatctcgagtatgaataaatcaattcaattttcttgttgtgtgtggacaaatcataaattgagggtaaaagtcgacttaaaaaagtaattaaattttacgaatctttctgttaaatttggacgtttcgcgaaatgccacatttttgcactgtcgcgattgtttttgattacagtaagatgaaacagatttcaataaatcatttccatgcgacaaaaaaaagcttttctactgtaattttctctttttcccattcgccggcgacccccccccccctatttttgtcggggagtttattttaattctttcaatttttattaaaatgccttattaacttttaaatcgcttaacttaacagactgatgccgactggaacattgaagaatctatttctttttggcttttcccagtgcaacatttagccaatgctaatcggcaacatttgcttcaaacgaattttgatccaacgaatatttccgccgttttcgtcgttttgtccctcttttaccttcaattatcccacactccgttatttctatcccttggccattctttgcccatatttcctgtctatggcagtgcaatgcgttatcgaatggcattacgaaactgcacttgacaccaaagtttctcttgatgaagattttattccagaaatttttttaaatttaattttatttgtaacagtttttattataaaaagaaactttttaccaccataaaagaatgaaatatggaagattaattagctttaacttcgaaataaagtaaaattttttgagaaaaaaaattgtttttgaaaataaatttttatcacttttaacctttttttttgttgcatgttcaaaccactttagattttacattccgatcaaaatagataaaacaaaattttaatttaattttttcaaattaaaaaattctgtaaaaatagtcggatgagaaaaaaatttaaagagcccaaatcaaagttaatttttaatataataatgcacgaattatagttttgaaccaaattaaatatttgaaaatgttgaaaacatgctgcttgaaattacttatattttctacataaaaattgtttaaaaatttggcggcagtttttcgccaactttttgagaaaacgcataataaagtgtcgtannanattaattcganttt

SEQ ID NO: 26525 - DNA, 850 bp, Heterodera glycines
taaagtacattagagccaaatagggtattcatgatcattccatgcattcgaatcaattttggtcaataaagatagattttggtgagaatggattttcgacttttgttagaatttgggtctggggttcaaaattgatcgaaatggatctcatattcgtgatcagcgaccccgaatacccttggaaacatgtttttatcattaaaaacaaataaaaagttttatttttcatgtggtctaaactgtacaagtaccttaaaattgatttaaacaaatgaatgttcattttttctgtttttaagggaggaacgggcgcatttccgataccctcagacaattgatgacgccaaaaggcttggccgtgtgcttatccgttacaaagaccaacatttttacaccgttctttcgggcgtcgccgccatttatttgatgtctgttttcattaatgacaatatggtacttgtgtgttatctgtgggcagattttcaaaaatttttatgtttttcgctataacttttttctttggcattcaaatccaagattgttggtatcattcgaaagcttaacatgtttcgaatctaattctatgtatcacttcgcgattagacaattaccaaaaaagttatacatgaaaaacatgaaaattgcgaaaaggtcgaaattatgaagttttttcttaataaaattttttccgggctagaaaatcatttcgttttttgtaaggctaatagagcatatgaagagctttcgaattataccaacaatcttggatttggatgccaaagaaaaaagttatagcgaaaaacataaaaaattttgaaaatctgctcacagataacacacaagtaccaaa

SEQ ID NO: 26526 - DNA, 1683 bp, Heterodera glycines
  misc_feature (1616)..(1616): n is a, c, g, or t
acatcgaaatctgcggggaaagccaattgacggtcacccccccaggcaacggatttggtaattaattgtgaaattgaacttataattaaagtgattttttgaattaggatggcattctgtgtttgcgaaatttcccatctccaagtgttgtcgtcccttcatgttctactttgaaatgaaagtcaccaaattgggaaggtaaaatgacatttattaactaattaaattcacaaaattcgcataaaattattgtttttgtgcattttttgttaattttcatatatttacatttttatatttttgcctcgattggattcgccaccaaagaaatgccattggacggagcaatcggacagcatttgaacagttacgggtaccgaagcgatggctcattaggctgcaatggtatcagtcggccgtataaaatgggatttggcaccatgccaatgccattcaacgcggcgattggacaacagagggaccgccgctacgttgggagtgccaattggtcatttccattggaatttgtgcccgtgccaatgccatcggacggcgcattggcattccaatcgccagcattttccaccggagatgtggtcggatgcggcgtttgtttggccactcgacagatctttttgacgaagaatggccgacgaatcggtgggccaaacacaaaacgaaaaaagcaaataatttaaatttcaatttgtcagatgactcctcttttttcactacaactcccatcaattctctgtttccatgcgtttctctgtggactggcgacaaaattgaggcgaactttgggccaagtttcaaattcaatttggccactctttgaagaaagctgaagaaccaacggaaagggcgattaatcatttagttaattaattcattatgcatttttcactttattttttcacatttattttcagttttttatattatttatcatgcgtatttgttaacaaataaattttactgttctttttgtttgtcttcattttttcatgtaaaaatttgatggaaaaaatggaacaggaagaaactcttgaacctgaagagattaaaaacttaaagaaatttttaaaatattaaattactcaaaaaatctctttttttctttcccctcatttatgtcccattgtgttacaatttaaaacgtttttctcaaaccctttgcccaactgtaaaaattaattaaaactaaaaatacatatttctatcatatgaaaatattaaataaaaaaagtctgtaaaatataaaataattataaaatttttattataaaaatgaaaaaagaagaaaaaagcttacaacaccttcgattcccaggacgtctccgttccaagtactaagaaggcccaacgttgcttaacttgccagatcggacgggatggcgtgctttcaacgtggtatggtcgtaagcgaaggggacccatttgaaaacaattaaataggtgtattaaaaaaagaattggagaatattgaactatgagaagcttaaacaatatttcaacttcgacaaaagaccgaaacgccttaagtttttagatattttaaatccttttttctttttatttgattaaaattaatttttgttttaaaattattgtanggaattagtccaagattttggtgcctgttaggaaatgaattttaatttgtggacaacatcataaatt

SEQ ID NO: 26527 - DNA, 1935 bp, Heterodera glycines
  misc_feature (1922)..(1922): n is a, c, g, or t
tatatggtaagagcatactgtagttgagtcatacttcccccccccgatatgttcagagaagtgagcaaaatcccacttccatccgtttatgtactgtaataataaaaatcgttaaattgtatcgttaaagaacacataattctgtcaaaatgatttgatatgtatactaaatcaaaacgaaataaaaggagagcgcagagaaaaatacgttttcttttatacatatttgaatttttttgaaataaaaaatttttcttttacattgaatttgcccgaatttacatacaggtagagaaaaaactaataattaggaatgggaattttatgtaataaagatagcgaaatatttaaataatatgtatataaatgttattatatgtaaaaaaaacatttataaaaaacaaaaatatgtaaaagatatgtaaatgaaaaaaaaattggataatttcccgtataggcgaaaatagacacaaataaaaactttaaaaccctcatgaagtttttttttttaatcagcatttattattttgaataaattaatgtaattggtagactcgaaaccccaatgtttgcattaaaatatattttgttttgtacaggcgcatcacttaagtgcattaagtatattaaggttttggaaatttaaaaaatatatatttttttgatattttaattttctgcttatcatttataaaccgtacatcccaaagagctgggaattttgtaaggccaatataaccgcaacgttgttcgtcgaattttctaatgatcagctgacacgtctccatgttgaacggtttagacgtgccgttttttaggactcgctgtagttttaatggtgaaatttgaccgttccggtcataatcgatcagtgcaaatttctgtgccatttcggcagatgttttattttcatcgatgttttttttcgatatcactgaaaaaatataaaatgcgtaatatattaatattttttttttaaaatgatgctatatttttttaaatataaattattataatgttaaaattttttccaagaattatatgactttagcaatacccaaaagaaaaaaagctcattttctgacttaaatcttaaatttcactagcggttcgactctcaataaaacagctttgccgtataataatttaaaacagaataataatagcataacaaaaaaaaatttttttttgtttgttaaaattgctcgaatcgatttgttttgctaataaatatttaagaaaaaaatatgtgtttttgatgtcctgcggcacagacaaacttttcccggttaatattgaaaagtttagtgcaatttgttacaaataaatgcaataaaggctgttttgaaatgagttggcatttttcgtttgttttttttgcaaaagtgtcatataagtaaaagaagtaaaagtaagagcatcaaacttgaaaaaggtcactacgttgatacattaaaataaagaaattttactctctccggaattgataaaagtttagtgcaaattgttacaaataaatgcaataaaggctgttttgaaatgaattggcatttttcgtttgtttttttttgcaaaagtgtcatataagtaaaagaagtaaaagtaagagcatcaaacttgaaaaaggtcactacgttgatacattaaaataaagaaattttactctctccgaaattgatagtttatttattaaaattagcacttaattaaatatgggctatttttgcgccagttttatcattaattttgcatcaatttttttttataaaattgctggcgcgagtaaaatagaacgatttcatacaaatttattgataattttgcaaggaattaatttattaatttaaaaaaaaagctaccgtatccattttttacaaaatttgctggcgtaagtaaaatagaacgattttcatgccatttantatttattttgca

SEQ ID NO: 26528 - DNA, 770 bp, Heterodera glycines
tggtggaaaatcgcaaaattttgtcttttttggacaaaatcttgttaacaaattgcatttaaaattacaaattttttcccggcggcgcctaccggcaccgccggaccaccgccccctcccctagttacccaaaaaattgtttttgaaaaaagcgcgcctttaaaaaaccaaaaaaaagtcattataagggatgtcaaaattatgtacaaatatgtatgtaaataaaatatttaaattgttgttttttggaaaaaaaaaattttcgtagagggtaagataggcacaaaatgtaacctaattaggcttatatcgtacatccgctatttgaaggcccccctctggtagaaggcccccctccaattaaaggcccctttttggaggggttgaacaatagaaggcccgtgccttcaaatagcggatttacggtaatcatcttttagtattttaaaaattaatttttgtattttttattggtacaatttcataaattctcaaaatatttaaaaaaatgaaaatatgtacgaaaaaagtttaaatatattacaatatttattgtttaatagataataaataatttagtatttttgtgttaattttttaataaaaaaggtttttatcaaaaaaattaaaaaatacaggtacaggcctggatacaggcctcgagaagcctgtatttttcctgtacctgtatttttctgtacttttgtacaggaaatataggtacaggtacaggtacaggcttttttcaaaatgtcgatctctattaatta

SEQ ID NO: 26529 - DNA, 1619 bp, Heterodera glycines
  misc_feature (61)..(61): n is a, c, g, or t
  misc_feature (97)..(97): n is a, c, g, or t
gctgcacagctgcttaactaagctgtgtgcatttagcctccagaccgccaaactcaattgncaaaatacaatgcggcattgatgaattttcttggcngatgatgattgaatttgccgcctggccaaccaaatcctcggcctcagcaaatcactcctccgccactcaacagcgaccaacaaacggtctttgatgctgttgttaaggctattcagtcggacccaagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagactatgtctatcctaacttccaacaactccttggcaatgacaaggagctgctcaatcgtttgattctcgctccgcacattgacacgtgcgacgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaatagatgcccaaggccgagccaaagtgctgaatattgtagctactaatatgctcaagttacaataaatggcttagtccagagcagtgggcacatggttttggag

SEQ ID NO: 26530 - DNA, 1565 bp, Heterodera glycines
  misc_feature (1323)..(1324): n is a, c, g, or t
atattttacaaagaaagacactgttcgatgggtcgacgtaatagacaaaataataacaaacattaacaacagtgtgaatagaacactgggagtcatcccctcccccctcccaatgcttttccaaccctacaaaaatgtgttagcagctgcaaatgcttctccttttttgctgatgtgcagcacagcaaaaagagagaaagagagagagagagagcacaagcaaaacacacactctcacgcccatttctcattaaatgtcccggcttttccttcccctcatccccatttttctatgggtatgctatttttatggtttttactccattttctcacacttgcgccacccaaataaacacatatacacacgcacaaaacacaaaaacgccggggtggtgctggaagctggacggacggatgggcgcccgaggggcgaaaagggattaagcagcatttggattttcatgtcatttaattaaggggaggggggagaggaagcggagacgagaagagagatgggacactgtggtgtcatggcgctgtggccatggccacggacggcacaaagatacaaaattgtgccaagtgtgccatcattgtggtccctcccctgttgctaacgctgcaactgatcctggttaacagcatctggtgatgctcatgaagcattttcgaggtgtactgcacccacgacgaagcggaaataaaaatgaaaaattagtaaaaaatgaatgaaaaagtaggtgttggcattggcgttattggcatgatggtcaccgacagaggattaatgaatggattagttgcaaaagcataaatgtgttgttagccctagtaaagggttagttgagtgagcttatgcgtgagtttgttgtcaggggcttctttttacgaggaaattttaggcaaaaatgaaatggcatggcactaacagtctgaggattatgtgctgcagaagcttggatgatcttggcaattaattgaccaatgccaaacaccacttacaattagaatgcaaaacggaaatttttggatgtaataattacaaaaaataaataaataatttttaattagggttcgcctccgaacctttgtggattaaaaatgtcgataaaatgtcttaaaaaattgatgagttattgggtggtaatggtaatacctagggatatgcgagaagtgatttttaccgagaagcgagaaccgaaaccgagaaatgatcccgaaaatgatgcgagaaccgagacccaaaaaaacccaagaaatttttctcgagtcgaaaatcgagactctcgcactttgttttcaaaagacatgaaagcatgttcnnctagggttttcggggtcgctgatctcgattccggcatctattccgaccaatttcgaaccccgaggctgtattctagctaacgttatggagttgaaagtattagcatcgctgcatttttcattgtgaaggaacatcaacaagaggacgagcagaagcgaatggggcgaacgcacaatcacagcgatggagaccattatcataagtataaaatagcggacaaatgaatgcgcggaaggaattc

SEQ ID NO: 26531 - DNA, 1138 bp, Heterodera glycines
tgaccaaaacatgccaagaaagtgcgaataatttcctcccaccggtcagatgatttgatacaattttatctttgattgctttcgagtcgtctttgagatggttttctttactctttctctctctacctctctctcgccctctaactcctccctttccctcttccttctcctttctctccactctctctctctccctttccccctccattctgtctctcctcctcgctctttcccctgctatttctctcccgctttccttccctctctctccccctttctttctttctctctccctccctctcttctctccctctctctcccctttcactccttcctttcccccttccttttcttttctctcctctctctctttctcctccctctctctccccctttctttatttctctctctctcccctcacttttgcttcatttacctctttacttggggcgtcatttcccactgttctcgtaaacatctcctagaaggaaaagaagaggcaattccccgtagggctgaataccccgatgatggaatggaatagttacgtaactgtgccggccgattcgctgaggtcaggtcaatgggaggggcggcggacgacggccttcgggggaagttcaaatgaagcggggggggggggggagattggacaggtaattgggcgacgctgtgccgacccttcccaccgcttggctcgctcgactcggctcggcccgacctcactttggctgacgagtgacaacaatcgccgtcctaacccgtccccccccccgtcggattgcgtcgccctccgacgatctccgcccccgggggatgaccccggcacattcgttgcccgaaagggcatgtcctcacatcagcagagattggcagattacgtccctctccaaaatgcacaactaaatcccacatttttcttttaaaatttagattcctaattgctttccctcagatggattctgatggttgtccaatgggacctttcactgcgaaatgtgccgattccgcgcacttaacaccgcagcaaatgctcaaaactgccatcccttcgtttccggccaatttcgctgcgcaacttcccaattctcggccaaactttctaccgacggccgattcttcatcattctcggccaa

SEQ ID NO: 26532 - DNA, 1350 bp, Heterodera glycines
cttaggctcaacctgcccacagggccatttttgagtaacctggatttttcctagacctcgatttttctggatttttgtccaggaaatccaggtccaacttaaaagccctgaaaataggggtctaaaattcctaaaatttaatggggattccatcaatttttcgaaaaaaataggtaaaaattaaagatttcgtgtcaattttctgaatgatccctcaaaattcataatttttttttttgatttttttggcattatatcctttttaaatatttttacttatttatttttatttgtacagaatgcgtttgggacgttactgtatggccaacacagccaaagttgaaaatctcgccccaaaatccggacaattcgccaaacatttgtgccaaactgcaccatcttgacctgaagggcaagaagcggctctgcttttatccgcacacaatcatcctttggtgggttggcaaaatgttcaagttcaaaaattagagtctttacattaattgactggttttaattaattgttgagcattaactaattagcctaattaggctctaatttcgtcattccgtccagtgacctgtcttcaaacaaaaatcttcttaaataatttgtttaaaaaaacatggaaattttcaaagagaatttaacaaaaaatttgcgtttttattatgaaaatgaagaatttcttaaatttattaatttaatgcttagaattaatcattggtaattttacccacaaatttttcgaaaattgaaaaaaattcgctttaattaatgacaattattttaatgcctgcccttttcagcaatgttggcattgagccggcactctccgggttgccaaagtcgggcatgtgagtttttataaattaaatttaaaattatttaaatttttcagccctccatttcggaccacagattttgttgaattctcacgccattacattgcctcatatgggtcccaagaaaaattcttcatcatgcgcattgggcgcggctcgccgatgggctcatgtgaagtgagtgaattaatacacaaacactgatcagaagcggccaggtctgatcactactgattcgatgattatcacactttctgcccattagtgatcatttatcttaagtgattaatgcatgtcctaattagttcatcgatcactatgttcggtgatctgtctgtcagctcattcaaacctcattaattagtgcatgtcctaatcagttcattcaatggatcagtttgtgaattctagtgatatatcagagcctgtcttaattaattagtgcatgatcagttcatcgatcactctgtgaactctttgattcatttcaatcatctatctgca

SEQ ID NO: 26533 - DNA, 1055 bp, Heterodera glycines
cttaaacaaataagtaaatggtttatgaaaaatagaattaaaaaatgtattaataatttttaaaaaattattaaaaatgctttcttttattaattaaaaataaactttgaatttacaatgattaagtattattgtattgaaaataatttttttgacaatttcaaatttaaaaaaacattaaattctttaatttaaaaaaaaataattatttttaaataaaattttcaccaaaaaataatttaattcaaatgaaaattttttatttattattaataaaataaaaatattttaaatgaataaaacctgtaaaagtaatcaaaaaatgtacagaaaaataatgtacaccggccggattcgaacctgccgccccccccccagaagatgactcagaatccccagtcacacagggattctgagggcttaacgatgtcaaaagtaaaatctgatcacgtattcgtgatcagcggcccaaataacccctaaagacatgtttttggaagatttttgtcgaaaaaatttttccactcaaaaatcctatgctcacccctttggtcccgaatctcaaaatcacttttatttttataaaaattcttaaaaaagagataaaaatgccaaataaaatttatataatagagcaaaaaattgcggatttttgtagtattaaacatttccagaatcacttttcagaaccgagttatgaatttttttctgaaaaatcgaaaatttccagaaattctggaataactatttttatttttgaacattataaaaccaaataaatcccataaaattctcccgattttttgctatttttaaggctttattcctgtaaaattgatcaacccttcgatttgttatgaattttcaaatattaggccaaaatcccgagggccaaaaaattgccaaaaaataaagaatttttaaaaaattccaaaaatcatgaaaacaaaaaaccaacatcatattcgtgctccgcacctccaaaataccccaaaaaaatattttttccccccaatttccaccccaaaaaaaaattcttgaaaatttcaaggggg

SEQ ID NO: 26534 - DNA, 1229 bp, Heterodera glycines
tttttcaaataatttttaattttaataaataatcccagaaaaatgctattttttttttggagaaaattttaatgcaacaaacgctctcgaacatgaaagaaagggcggtgcgccgtggccattttatttttcaaataatttttaaatttaatagatattccagaaaaatggctatctctttttttgagaaattttctatgcaacaaacgctctcgaacatgaaacgaagtgcggtgcgccgtggccattttatttttcaaataatttttaaatttaatacatattccagaaaaatggctatctatttttttgagaaattttctatgcaacaaacgctctcgaacatgaaacgaagtgcggtgcgccgtggccattttatttttcaaataatttttaaatttaatacatattccagaaaaatggctctctttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatacatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctctttttttgagaaattttctatgcaacaaacgctctcgaacatgaaacgaagtgcggtgcgccgtggacattttatttttcaaataatttttaaatttaatagatattccagaaaaatggctatctctttttttgagaaattttctatgcaacaaacgctctcgaacatgaaacgaaatgcggggcgccgtgggccttttatttttcaataattttaaaatttaattgatatccagaaaaaatggtatcatctttttttgaaaattttttatgcaaaaaacgctctcgaaaatgaaac

SEQ ID NO: 26535 - DNA, 1674 bp, Heterodera glycines
aaatggtgtgcaaggtggagatggttccggaggaggccaatgtcaagcgaattcatgggcacacggaagaaattcatggtcgttgaacgagtctgggggaggcaattttctaattgaaaaatgattttcgtttgtcgcggttttccaatgtgcggccttttcggggaatgtactggggagcgcaggaaacccatggcagggcgaaaaatggcagcgcggacttcgaagagagcattatgagatgaagataatggtggaagatgaggggaaaagcaccggggcatacatctaaagggaggcgacgaggaagacgaagcctaattagcgctaattagtgttgtaacgaaaagtccaagagagtgagaaaaggagagagtgagaggcagagagagagagggagtgggaaaatgtgaggggagagagagaaagttcgggaaacgcggggcggggcaattatccagtcatcagagaaaggtaagaacgctcagccgagagatctggtcccgagtgtggtgagcataattagaattgatcagcgggtaatatttgccttggtcggacctcgccttgtctccaaagtttttggaaaaggcgcgccgaaaaaaaagtgatgtgaaaaataaatctgaatttctaataatattcgatcatttgagtcaaaaaagtgattaattgtttgaaataactgaaataaattcgatttgaaaatttttattaatttaatttagctttaactttaggactttataaaataaatagcaaaataaaaattaattttgtattattttcaattgaaataaattaaaatttgaattttcttgaattttttgaatttttaaaaattcccttctgtcccggtaccggcttctaagttccggcttctcaagtcccgttttgtccaaaattcccagtcccactcaactctagtttaaattgtaaaaatttccaaaaattgcttaacaaataagttgtaacttcaaactttgaactaaagacatatcgccaaaatattattaatttttttaatttgcgtagtttaattgggacccacgcgtttcggcgctcccgtttcggcgccagctcgtttttccacttaagcttttttctttggcatccaaatctaacaatcttggtatcattcgaaagctcttaacatgctctattagccttatcaaaaaccaaaagtttttcaagcctgtaaaaattttattaagaaaaaacttcaaaaatttcgacttcgctccgaggccccaagaattttcggaattccgaggcccaatatttttcaatatctgaatccgttccatccctgcccccatccctttcttgggacagtattcgattccttcatcccctctggacccaaaggactagagcccggaaatttcaaatttgcggatcctgttgcaggattggaattcaaaaaattttgcaggaccggacccggccggattaatcctgcaaatcctgcattttaaatttgcaggatcccgcgcaggattgcggattcttagaaattttgaaaaaatttcaatgaaatttcccttttcgcaattttcacgaataactgttgtgataattgtctaatcgcaaagcatagcttacaaaaagcttctaaatagattaagctttccaacgacaccaacaatgttggatttggtttacaaagaaaaa

SEQ ID NO: 26536 - DNA, 1862 bp, Heterodera glycines
tgttgtgccgcgtgatgccacgtccgcgggattatcttttctgaccaaatgtttgacttcaaactgtccacgtatttttgctaatcgatttgaaacaaatcgatcgcatttattatgctccttaattcgttcaacggaacacaagctgtcagtccattctgtgttggtttgagtttgagatgttggagcacgtactttaacaacttcactcccagcgttatggattgtttccatttttggaattgttgccgcaacatctgatatgttggagggcttcaccaggctctttgcaaacaccaaattggcgctcattttttctgtcgattcccggatgtaaatggcaacgcctaagccttttccgctcgcatctgcgaagcaatgcatttccttgtccacttcgtcttcgttgtcgactcttcgtgcgaatcgaatttggacctctgtcccctctttcgtttgccaagtctccatgatttgattccattcatgaatcaattcttcttccaatccttcatcccagccgtttttggcttcaaaacgtttttgcaaaaaatgctttgctgggagcactgcaggcgccactaaccccaaagggtcataaatttttgcaatgtgtgacaagatgttcctcttcgtgtgctttccggcaaattttttaaatcggaagcaaatttcatcatcctcattcgtccacggaattccgagaacttttatctccttttggtttttggccaataattccacaggaaggcttcgtatggcgatcggcttactgcagaaaaattcctgcagcttcattcccccttgacggaacagctcgatcgattcgtggcaaatttgcgccatgtcttcattcttcttcacattgatcagtatgttgtccacgtacaaattctccattatggtttgcggtagaaccgtgtcgtagaatgaaagatgttcgcggatggttgcatttaaaagaaatggtgaagttgtcaatccaaatgaaacccgacagaaccgaaacacaacggttctcacatatgttgggcttgaaatttctgtcttttgtggatcctccagccacagaaatctggtcgcgtctctgtcctcctctctcactgataattggaggaaggctttttcgatgtccgccaggattagatccttcattcttctccatcttagaaggatcccggtcaattcgtttagcaacaacggccctgtgtgcaagcattcgttcaacgatggggctcctttgtggtttgctggcttcgcggatgcatccatcacaattcttatttttgtcgtggccttgtccatttttatcacgggccgatgtgggagataatgtaccggtccagttgtttgtgttggatccggcactctttcgattatcccgttcctctcccactcattgaaaattttttggtattcgtccaccaaattcaattctcgcaatttcttcactgtgccacaaagtcttgccctcgcttgttgaaaatttgtcggcaaatcctttactctttcgttccatggtaggccacattcatatcttccttctttgaatgtcaagccctttctgaacgttctcatcacttcttccttgtcctcttcttcaggattgtcgctcaatccgattatgttcagcccgaaaaatgtttttatctgttcttccatttcttcgtcagcatctcttctgctactggcacattgaaagagacttatgagtgctccaatgaatgtcacttgcacactcatgtccattgaggcatggacttggccataacaacttatcatccgcccgacacgaaacaatgacaatgtgaatccacttgggcacttttctgtttcgtctctttatttcagggcatgtctga

SEQ ID NO: 26537 - DNA, 1859 bp, Heterodera glycines
tagcaatcggttcctctgatctcttatgtaagaatcgtggtacgacttttgggggatttgcaacttggggacccgacggatcccgacatttggggacatgacttttgagaacccgacatttggggatttcaatgctaaaaaatattcaggctggaactaaaaaagaccaattttacccccgtttttcctggcttctccatgctaaattgtaggaaaaaaaattttattttgtgtgtttgcgaacaaaattcgggactttcctttacatatttttcatatttcgtgattttatacatatttttgacttttttttgacattttttacatatttttagtttttcgaaggtccatctattccgtgtgttcaaatttcctttccacaaaaatggtcgaagcaaattttaaagatgcgcgaaggcatggtatttttatgcgggagagtcgatgtccatgccccgtcgaaaaacttgtggccaccaagttcagcaaggtcaaattcaaaaaccgattattgtttgtctcttctcgttattatttcaggtgaagtgcaaatatgtagatgaaagctcgcgacattgttgctactttatgttagcctttttcatcattgtaagccctcgtctctaattaaaatttctccattccccccccccttaaggcatgcctcggattgactgcgctgtttaccattcttttcttcaattctacaacaaatcgacaatatctttttttattgcccctctgcttgctttcaatcccaattgtcgtcatattatcagtgctctgctgttacaattcatgttatggtaaaaactgcggataatgaaaccattaaaaacagttaaaaatccgcttcatcccccgcaatttgcagaacgcaaacacaccgcgcttgaagtgctgtacaaatgcgactcgtgtggccatgaagtgcacaaatgttacgaatgctttggtacgggactgaatttcctctaattttccgctttgtcacgtcacatatcttcctttttaagtctactccttcactttgaccgataacagagcgtatcaccaactcatccgtggccgaacttacaatccgtggggacggtacactggaaatgtcacgaaaacggtgctgcacaagccaatgaccatgaccaaatttgaggcggtggagcaaaaattcgatttgatgagcggtgttcagaaggacaatttcaaaaccagctgggcatggacgaacgatttgataaggcgccttgaataagccgaagtgttaattaagttgacaccacttttttgcacaaataatgtacatattatctttctgtagattaataactttgaaattaatacgtgactttcatgaaaaatgaatggtgaatatgaaaaattgtgtttacagttttggaaaaacggctgacataagaacggaattgagaaggcatcacaaattcgctgaactgctctatcgtgattagcgcagcacgcaactgaatttcaattacggaaccccgtaatccgtgatggcgattttctcaattacggaatacgtaattacggaggtccaaaaattccgtaatttcacggaatccgtaactccaagaccccgtaattacgtgcatccaaattatagctaatactaccacagaaattgcttccccttgtcgggatcatgagtttttatgggggcggcatgacggaaaagtaccgatttttttgcggcgcgctttttccaaaaaacttttgggaacagggggccggctgtggtgataggtgctgcctgggaaaaactggaaatttgaccatttttcagcagttttccactgaaaaatggcaattataggtcaattctgcgcgttgaaaatcatcat

SEQ ID NO: 26538 - DNA, 1821 bp, Heterodera glycines
agacaggtcggaggtgtccagtgaaataatgcgcactgtccgatccgccattccaacggtgagaaatcgcgagcggagttccccctccggcacttcgctcagactcatgcacaacacttccgaagtcatctcccgacgctcggaatactctctgagttggttgttcatgtccagctcaaagtacacaatttcgcctccaagcagtgagatcacgaccttcaaaagcacaacagtttcctttttagtaaggatgtctatatttccgctcacctgtcttcgattcatcgcacactttgaaattggtcgttttggaggcgctctccattcgttgactcgccgatcagcacggatgtgccgaattccggatgggtacacttggagcaatgaatcttcaccaatcaaaccacagccaagggttggggtggtgccgagaaagcccgagtcggtcacttcctccacagtttcaccgatagacagcaccaaagtggcatttgtgaaggaaacgatgatgtgagcatggaaagggtctgaaaatcaaatgaaatcgaaattcttccactaaaaataaatgggtaccgtccacatttttcttcactgtccacaccgccgttgggtttccgggcaattccgagacggccatttcggacacttccaacccgttgcgtaacacgcgcagcgtggaacgcggccctcgtccacaaagtgcgtaaatttggggcgcatcttcgttggccaaatcggcgatcttaagggaacaaagaacataacatatgccaaaagttggaaaagcattaaaaggcacgtgagaagtgatcatcgggttgagactgtcaatttggtcgacaaggatcaaattttgaagcccgcgtgtgtcgtagaaaaaggtttctccctcatccagaggtatccgtgaagagaactcgggctcatcatcgttgtcccccaaatgagcgatttggtagagatggctaaaagcaacaaaaccaattaaaaaatgggacagtgacacttaatgaattgtgctcactgattcccgaattcgctggccacaaacagaaagccggtcttcaaaatgcaaatggaatttgccaccggcaaagtatcgaaatatttgatgcgcatttcggtgacaatgtcggcatcggagtccaacgtcactttgaacacgtcgccctgctcggattggaccaggaaaaagtacaaattcttcattttgtgcgtagcggcacaaacgatcataatcggacgctcactttcgtcgaggtcattctgaatgttggcaatttgatgcaaaatgaaaatgcaatggcaattacccgtcgcctgggaatgggacaacgaatgtccggctgatcgcccaaattcttgtacaccaaataattctcgcagcaaacgatcactccactcggcccgtcatggcccccggggacgccaatcagcatatttccctgaaaaggtaaaaaagaagtcaacaaaaccccacacaatgtttaccagtttaatatgttgttattaattgtatcgtttttagcaaaatttaatttatcatagcaatgaagttttttcaaaataaagaaaaaaggttgatataattcggacaaaaaaaaagattttctcgtctcggccttttttttctcttcggcattattttctttttactacgctatttttcaaaaaatggtaaaaacaaaattttgtgccaaaaaactcaaaatttttacgattttgaattgcatttcgttaaatttttcacaaaattctattttgtcttttcctattcgttaaaattttaagaaattgaatttcgtttttctctttcgt

SEQ ID NO: 26539 - DNA, 1203 bp, Heterodera glycines
gaccaccaccgtgcacaaggtttcccgagcgccgacaaacaaatttttttaaactttttgcctttaaattattattttcctttcgatgggactcagtcgtcccagtgcttaagtggcttcggttcgaattcataccttggtttttagatttatctcgtcaaaagctgtcgaatgatagtaaatttgtccagctttggccctttgaaaaggttaggagagccctattctgttcatttttccactttttgaacctgttcaaaaatcggtttaaagttgatgcgcttaaaaatttttgatggtttaaattttgaaatcgctcaaaatttttcaaaaaatttttcctcttgaaacgaccgtgcccacacacacacacacacattaccaagccgctgtcctcgttgaaactgtacaggtccccatcgtcatgttgaatggtgcccagcttgacgaccagcgggaagccggtggcttcaaagtgtgccttggcatggcccacccctttgatgccggcaattggcgcgtacagaccgcacgcgatcactccgtcgctgaggttcagccaaaggttctccttcaggccacaccgggcgcattcccagtccgagtagccaattggtgggccggcacaagtaagctaaaggcatggacaaattttaaaattggaataaatttttaaaaatttcaaaattatggactgtccccctccacccccccccccaaatttccataaaaattaggtaagttaaaatttgcattttcgataaaatttatgctaaataatggtcagaaattcaaaattttccccggcagcgcctatcggaaccgcggggggagcccacccccccccctccctgctcccaaaatttttgtccaagaaaagggagcattggagaattatattccttcctcaatgcccctctgacacaaaaaaatgtttaaatttgttttctcgaaattttttactttttttgaatttttttttttggaaaaaatttaacaattcaatttttttttaaattccgagggtgctgctacatccaattttgacccaaacaaaatcacacatcttcaaaaaaaacaacacctggacaaggtgttttgccgcttttgcaatccttcgctgtttgccgccgtcccatggctgtacgcctatgccactgtcaatttgttgctgcacttcggcaccggcatgcgcaataattt

SEQ ID NO: 26540 - DNA, 1569 bp, Heterodera glycines
aaacggcctggcctgcccaactacacccaaaacttactcatatctctgaaccaagacaatgtacctattagagcccgccgggatcggaactcccgcgggtttttaagggattgccgatctcgtacttttttgcccagcgggttttgggagcgggatttttaagggattcctggtccccgctcccggaaaattttgaactcccgctcccgtaaaattattttttaccgggctctagtacctatctattttttcttgttaaagttcattgccaagtaaactttattggggccactgatcagcggcggcaaattctgatcacaactcacaagctagatcatccaccacccaatctcgaaatattaatagagttttcaaatacttaatttgtattgctcttttacaactgatcaataaataaaaaattattttgcataattttccaataaaaatcagtgggaatttgcgcaggaataatccacaagccctacgcccaattaatccgacaaattctcgcacaattttcacccgtaaatcgtctccaaatatgtattatgttacactaagattttgcaaaatccgatgccacaatttccagtttgggtggcacagagaattagtgccccccccccccgcccataaaataaagcccccttttgtgggggttgaaaaaacaaatcctccagggctttacgtatgttggaaaaatgcggtgattatctgctgttcacagcatctgtcagtcattttctgttcaaaattcaaatcaacattttgtttaagactcgagatcaagacaaaaacatataatataatttgaaaaaaaagttcgactcgtcaaatagccgaatcaattttttacctgtttttatccaggactatctgattttgatttccaaaaattatcccactctgcccatcatttagacctttttttgagttctctctgaacgcaaaaatggaaaaattctcacagtttaaaatttaaattcaaatatgcaattcccacatataaggacaaggacaacaaaaatgatgacaacatctgctggtgcttcactcgtattatttgtatctttagggggccccggggggacaagtgaaataaattgtggttgtggcggtggtcaatggccccgccaggcacggggttgggccccgaggggccggggacagtccccgcggggcaaaacaccagcgaccgacggacgacgcactccctcaccccatttatggtgaaggacgaaagtgtgagaaaatccacgatttctacatatataagcatggaagttttgtgcccgaggggtggtggagggctgggctttactccggcatttcgccgccaaatttaattatggacggatgaaatgccattagttgaaagagccataatggcaaaccgacgagggcacgacaccagaggcatgctggatggggatggacaatgatgatgattattcatcggatgaatgaatatgtggaggatgtcgaggacacatcttcgagagcgggactcagagatttgtctcgggattcgaacaataattctccgagaaatgattaatttaatta

SEQ ID NO: 26541 - DNA, 1419 bp, Heterodera glycines
taaaacaaacatttcaacaaattttctgactttgtcagcttaatttttaaaataattttatgttgaatttattttttgtctaattgattattacggaagtttttagagttattactgtgtttaaagattttaagtgtcttggattaatgaaaacaaaaattttattttgtgtggttttatattgctggataatccatgatttgtcttatatatctaaatatttttgagaattcgcatttaaaggatgttattagtattttattttaaataagttactggattcttacgccatacatgtttgacgatttttccttgaatatttttaaaaaaaaatttgattttatgtcttttaataagaataggttttataaaagtcatcctagaaaccccaagccaagtgaaaaatgcttttttcgtgcttaactgtgcgtattaagtgcgcaaaaatttaggtttttacctaaatttcccagccctaattataagtactttaattaatatttttaaaggcattttgtcattttgatttttaaataaattaaatttcgaccttttgttcgaattcggatccagggttcgaaaataggcgaaatgggtttcatattcatgataaacgactccgaaaaccacaaaaaaacatatttataaaaattcattattttcaaaaaaaagggggggcgaggatcggaccgttatctagaaaagttttgatttttgattattgactaaattctgatttcttaaagttattttaattttgaaattttatggcataatgtcaatattttatctcaatttttattttgaaaaatgcggcgccaaataatgttataatcgataatggtaggcgaaaaatataaaatctttgaaaaatcaaatcgaataaattgttttaaaataatacattttaaattagaagcaattttgcaaaatgttctgttttttactacgaaatttgattttttgtaattgagaatctgttttttttaattttcaatccgctccctggtgtaaactgcaataaaattggaagaaaattaatattaaaaagcaaaatatatataaagatgaagtggagttagagagaggtggaagggcccatcgggcggggcaatgccaaatggtgtgctgagataatgccaatggtgccaacgagtcagcgtcgttttgggtttggttttagaaaacctttaatttacaaataataaaacaaatataaattataataattcctttaaaattacacagcaattcatattaaaggaagttcctcgtaagatttagaagaggaaaataaggctccctattatttcgtcactgatcgtttcgtcactgttcagttcgtcactgttcagttcgtcactgatcatttcgtcactgagaaatttttttaaaatttgtttggcaaattgtcaaaac

SEQ ID NO: 26542 - DNA, 1266 bp, Heterodera glycines
ttccgcccactgttcttcgcattggtgtcgcttgtcctttttggcctaggcatagtggcaatgctttgctctgtgtacttatataaagtgagcgagcgtaacgcgtggccacaaaaattctttcccggcaaaattgtgaccaaaaaattgcttttaaatcaaaatccgatggattttttgatcaaattgagatttggcttttgtcactgttgagtttctgtgttcgcgagtttgtcaaaatatgtttcattaacaattacgtgattatgtcatttaccttatttcgttttcagttcaccgtctattttcatgccctcccttctgtcatggcctggtgtgcttctgcttggttctcagccgaattgctgctcgattggacggacttttggatttgcgtcaacttccaagcggatcgcacaaatgtgccgttggtcagtttggtgagttcgaaaattcaaatttttcgaatttcagattttgtttaaactttgtttgcatacacgaaaacgaacgaaaatgcattttttttggtgtcgaacccgggtttggagatccgaaattgttcaaaatgtgattgtcacagattcatgttcttcagcgaccgaaaagccttagaaaattattttgagtgactttaaaagttaatttttttttttcaaaaagggtactatcatatctctgaaaatattattaccctacattttccaacttttaggtgctcagcattgtgttggcgtgttcgttcgtcttcgagattttcttcaagaattcgctgctcaaaaagcagttggccacggaatgtgccatcgtgtgaacaatacgcagagacgagacgaatcgggaacgatgctgatgccaacaaaacacaatcaatgcgatgaaacggcgatgtaatggatgatatatatgtatatgataaatcggataacctatttttccgtcatgaactgttgtattcattatactagtatatatatatcatatatatatgcatagttgtataaactcactcagaaattatcgaaccaattaattttggaagaaatcaatcgcattttgtccgtgtgtaataatcaaaaatagcattttctccgaacattttttgatttagagcgacttagaaaaacacatgttttggcacataaaagcatgggtcctgtaaccggggtctgggttcgttttcgtacgcgggataatttgtaagcaaaattttataattttaattccacactcgtaaattttaatcgaaaatgcataaatttaaca

SEQ ID NO: 26543 - DNA, 1981 bp, Heterodera glycines
tttttattattacaattttccattttccttttattttttttttacggattccaactggatttgtagcggatgtttggatggacattctcccttcttttgaccatgctcacctcgccctcaaattggcatgcttttcttatcgtttcgatgctttggtggacacgcatttcgaatgaaaaaagcgattgacaaatttggcgactaatcagaattcgcaaggacacatcaggaccaaaaccgaaaatttgtgtaacgctggatgaaaataacaatgatatcgatgacgatgacaattttgtggattttccgttttcggaccgtcagctgcccaacaaaatttgctttaaaagcctttggattgagtaatttgaacttttcatgtgtatattaaggcattttaatttttcttcaggtacattgaccattccatcatcacttttctccattccaagaagcgaatcttcgacagaagtggcaccaatttgtatttgagtgtggctatggatttccagccgatttggaatgcttttgtccgtcaaatttggccaatttttgcgggaagtattcgccatttgagttttgacgctggcgatcctttggacaatttgcgtcgccgcatttcaccaacatttctcaccgatctcaatcaattgaattcaatcaattctggtgctctgttacccgacggtattgctgatgatgggccaaatgcaactgctggtcaggcgttatccaaatggttacacactccgacaaaaaatggtcagccgaagcgattgtatcgcaatgaatatgtgggtgcaaatctcgaatgggtcgacaacttcaaagaggtggccggcctaccatatttcgttaaattgttttgttttatcaattttgtttagacatttctccgtgccaccacttctgtcagttacaatattcaactttatttttatacgacaacaatgccaagtgaaccaccaagtgaaccatttgaattggtgaacgaacggactaaagaaaagctgacactgaaacagaagagcgaagaactaaacgaattagcggtagtgtataattggcggttggaacggcgtccaattggggagacggcgacggcggcagttcaatggaaagaccgctacaattcggatgtcaaagccaatttgaacaatatcatatttaatctgtggagtttcaataaatccattgggtgagcagcatttgatttgtcgaaaaatttaatttattttaggccattgtagccaccagcggaagaagaagcggatcaaagcatcgaaaatgttgtcgtctgactgcgcagaagtgaattaattaatttagaaatgatcgatctcaacctgatgctcattttctctcagaaatgccttttgttgattttttcgttcgaattatataaacgtattttttttattgttttttgttgggcaatttctttagtatcaattgaaaaaattgttaagagaaatttgttaatattttatgtggtttccggagtaggtcgtttcggcgccgtcgttttggcgccagcctcagtttttggactataacttttttctttgtcaaccaaatttacaatcttgatatcattcgaaagcccttcatgtgctctattagccttacaaaaagcgaaaagattttctagtatgtaaaaaagttattaagaaagaacttcaaaatttaaaaaaaatttaaaaaaaacttaactttcaaaacattttttcaaaaataaaaaaaatgatcagcgccacaaactaccctagaaaaattatttcaaatgtcttttgagtgctctttatagtgcggtcatttgagtcccagctgagtttggcactccaattccggcactttttggcctgaaaaagggcaagcgcgcccctaattctatttttccgacccacttcgaacatttttacatcgattctggccgtttttaagcaattttgagtttggtgagtatgaccaatattttccg

SEQ ID NO: 26544 - DNA, 1190 bp, Heterodera glycines
ccagaggaaactctgggtggaagtccgaagcgattctgacgtgcaaatcgatcgtctgacttgggtataggggcgaaagactaatcgaaccatctagtagctggttccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacatttcccacgccaggctagggaaatgacggttcgcaagagctgttttgcgcggtaacgcaaatgaactcgcagaacgtcgtgtggagtccgagccagagttctcttttttggtttagggtgtgcgggcctggaagtgggtcagcctggataggggatgttgcgcccgtaaggcaccgcggttcctgtggtgtctcgtgcgctccacacggcccttgaaaatgcgagggaagctatttgaatctcctgcctgatcgtaccgatatccgcagcaggtctccaaggtgaacagcctctagtcgatagaataatgtaggtaaggggaagtcggcaaattagattcgtaacttcgggaaaagaatggctctaaaggtcgg

SEQ ID NO: 26545 - DNA, 928 bp, Heterodera glycines
aaaaaatgaaattttgaatatgtatctttcttcggatttcactgaaaaatgggtaattttagattccaattttgaaatcttaggggaatttgtgggccgcgacgccgataggcgccgccgtaaattttttttgggttttttaaagagttttgttaagaaaacttattaaaaatttcaataatttttcctcttttctccctttaccggcgacccactccccgaaaaggtcatccttaacagtgtaaaaatttctcggtttccaagactaaaaacccgagaccgggaagcgaaaaacccgggaaatttcccgagtcgggaaccgagaaccgagactctcgcacatccctaggggtgggcactaaccgatcagcagcaacagaactgatcactgatcagggaaagggaaccctttgattgattgatttacctaaatgccattaagcattttccatcggcacttcttttctgctgcttctccttcttcttcttcttctcctcctcttctgcttctccttcttgttcagcttttgtttcttccgcttctgtgcttttcctttcgtcatactgccaatttgtgccggtgttttttcctcttttttttgctaatgataaacacttgccaaataacaataaaataatgaatctccccccccccaatctctcctctttctgccgctgtttcgccctccctcactttgtccatttttcggatgagttccgccgccctatcacattccttacgttcttccgaccaattaatcttaattagcctatctctgcgcacccttcccctccctttcctcccttttccctttttctctcttccgtctttcttttgtcttatctctccctccctcctctcttcctctcttccggtctctctatatacagggtctcttccttccgtcttgcgatggcattggcatca

SEQ ID NO: 26546 - DNA, 1543 bp, Heterodera glycines
ttgattattttttttttcattccagagaagcaaattttttcaaagattttattcaaaaaaataggggttttcctaaccatatgaccatgactgtagaaaattaagtattaagcagctattttaactattagtttttaatcgatgtatttaatacttttttagtttaaaagtgacttccaccaaattaaagaaaataattttttgaaacaaaaatgaattgaattttaaaatcctcttgaacctcctgtccagggatgtacaagcaaataaatcggtctatatctatttgtttgtgagctatatctgagatgaataaatcaatgcagcagctgattgatacacacaaaatgaatgtttatttgtttgtttatgttttgcgttttgaccgttttgggccgtccgtcgatgattaattgggggagggggggggggggggcttttgggggctttcgctgctgctaaacataaaataatattaacggggagggaaaagcatggaaataaataaataaatgcgaagcgaagaaccacaaaactaacagcggaggaagctaatcgattttgggaggttgcggttaaaacaccgccgccacacttttgttgtcggtgggagaagaaaaaaagaaagaaaatgggaatttgtttatgaaatttgaaaacaaaaaaaggacacaaaacgattaattaaggtaatggaattgggtgtgatttgagaaggaaaagagagcccatgagaaattagtttaattaataacatttataaataaaattatttggtaattaatgattaatttcggttggtattttaaaaatttcataaaaataaaaagaattttaaccgtagtgcgacatttgcggaccgacttttgaccgaaatttcgacatttgcgaccgaaatgtcaaaaaaaagaaagaaaaaatttagaatctacatatttacccaaaattgaaattaatgactagggatgtcaaaaatatgtacaaaaattggtcaaaatatgtacataaatatgtaaaaaaaatccccaaatatgtaagaaatatgtataaaaactcaaaatatgtacgaaaacatgtaaacaaatttttttaaatggttattttttggaagaaatcttcgtaaagtgttaaatagtataaaatggcataaaaatgccctaaatatgtttagaatcaccttttaacatttaaaaaattatttttggaggggtacattttaaaaaagtttttttttaaatttttttcactagaatttctaaaaattttcaaaaatttctcaaaatatgtataaaaaataaaaattttgccaaaattttggattttttttgaggatttccaaaaatttccataaaaaactcgcaaaatatgtaaaaaaaatcaaaatatgtaagaaaaagtccaaaatatgtaccaaatatgtataaaaccccgaaatatgtaaaaatatgtaaataaaagtcccgatttttgtttgcaaacacaaaaaagaaagtgtttttcctactatttagagcatggagaatccaggaaaaaatatgtattt

SEQ ID NO: 26547 - DNA, 1113 bp, Heterodera glycines
tttttatttgctttttaaatatgcgaaaaatttttaggctttacttttttttttataaactggtcagaagcgaccaagattttgcgagagcatcaaaaagccaaggaaaggcactgctatgatgctaatcacagtaattttgaatttaaaaatttttattaatttttaaagcttcactattttatttttttagcaaaatcaattcataaatattttttcagaaactgctctgaaacgcaccaaatgttaattaagagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggactaacttaacctgaaaaaatgccaacgcttgttgtttttaaaatttttcgaaattctgactttttcattacttatttattattttgcaaaattaattcataaatattttttagaacgtgctctgaaacgcaccaaatgttaattaaaagttaaataaggctctctgatgctttttctatcaaaagggagatgaataaatattttaaaaatttttaattcctttttaaacaggccaaaaagtttaggcttatattttaaaaagtttcatcgaacctagcgcactaaaatcgatataatctctccaaattttgcaggccttctccattgtaaaggacta

SEQ ID NO: 26548 - DNA, 1442 bp, Heterodera glycines
gagtcgaggggctggatcactgtgtcaaggcccaaattttccctggctccgaacgggagtgacggcaagtgcacactcaattgtctgcggtcgccggtgatcagcaattttcgcagatgtggcaagcggaaggcgagggacaacacctgtgtgtagggggcttgacctgcctcatcaaccaggagatgagtggtgccggcaaaaagttcggctgtctgttcagcaaatgagagtgtgcagaagcagatgcggcgctcggcatgctctttcaaagtgcgggccaccgtcgtttcttgggccaatatcgggttgcgcgcacacgcggcgacgtatttgtccacttttcggatgtccggtctttccaaatgctcacggaattcctcagtgtccacggcggccgctaagaggtgctgagaaatgcgcctcacctcctcagcgtagttgattttgcccgctccgctgaacagagcgatcattggctcgggttggccctcaacgcgcagcgcttcctccatttccaacaccagcttacagacggcaatgttcggcggtaccattgccaggatgcgtgtcgacgggtcctcgccgggtcctcgcgcaggatggcagccatgattgccgccgccgtaaaggtcttgcctgtaccagggcccgcctgttgaaagacgaccctcggcaccccttcgagcattcgttccgcggaatcgcactgtcctgccttcaaaagcccaacggcaccctttttcatcaccttttcctcaacactttgcaatgctacgttccggggcaccctccgtcccagcagaatagccatgatcacattggcaggcgatgcgtggtccttggcaatgatggagcatccatttttggtcagaagttcagctcgttccatcagtgcacgcgtggaaaccatgggacgaagctcaacggcttccaatgccccttcccgaaggaattcgaactgctcccacaccttctgtcctttggcatcctgaaatgccaaaaacacctcgactctgacctcaaatccgttgtcaagtgcgcgcttttcaatgcgtcgaacaaatccaagagcacacggcttggtctcatcattttggtcgacgcggcagctgattgccgtatcttcttcccaaatttgcaacatgtccatcatctcgcccacggagttcagttggtgtctgaacgtgatgttcacctgcgtctcctgcagttcttcgactcggatcagctccgtgatgagagtgaatcgttgcagctcttgatgaattgtggctcgttctgcagcgactgcgcatgccatgactcgctctccaaatccaatttgttcccaggtggagttgctgtcaaagggataggcagaaatccgggtttccggttcaaccttggcaattatgttagcaggtaaatgccgaaaatctcgtctccattttgaaggaaaa

SEQ ID NO: 26549 - DNA, 1209 bp, Heterodera glycines
ttcgcgatttttcttacctaaaattagcagctctaataataatatttaattttattttaaacgaaattttaaattaaaattatatactttactaataaattacaaataatttcttcttttttttgaattggcttcatgtttagcccgtttcgatggcaatgaaaaaatcgagcaaaagctgcaaagttggcgtaggcaatctgacggacgaaaatggcaacgtggtgatgaaaggacgattcaaaatgtgcccaaaaggattcaaaaaatgtgccaaaaatgaggcttttggcaccacggcattctgcgttgagctgttggaatgaatatgaagaaaattggaaaaatatgggaaaatgatacttaattaattcaaaatgttaataataatggaatataataaatgtgacattgttgtaataagtgattttcaatgttagctttatcataggattgtatccatctcgcggcgaaaaaatgtcgcgaatctttttgatgtctgcagaaaattgtaaaatgtataaaataacttcttgcgagcgggagggtgtaaaattaaaaaagttcaagaattttttacgacttacacctttaaggtctccaggaacatttgggcagtgaactccgacattcttattgactaatgtcgaagaattcaggccccgtactagaacaacaagtggaaaattcaaattttaaaattaattaagattatatctagtgaaatggaacaaaaaaagtcaaatgtacttcaaattggtaattttttttttgttgcaaaaattgatatcaaattttaatgacttcgtcaatcactgactgaacttttttttttaatatttcgtaattgtattaattaattaaaccttttctaaaagggcattttccaatataatcagcaacgtacttatttatttatttatcgagcaatcacaaggtacggaaaaagtacatttacagtggtgcaaaagtacaaaaaaagtaaaaacaaagcaaacgaaataaaataaaataaaataaagttcacaggatggtacaaaatacagtcaggtgcaaaagtaatggggaacaacaattttttttttgttgaaaaacccggttttctcaaaaatgaatggtgagaaaaaagagttatttacgccaaaagaaacattaattaatgcactaacaaatacccaaaaactgcaccgataacacttttgtcctcga

SEQ ID NO: 26550 - DNA, 955 bp, Heterodera glycines
ttttgtggcttgtttacatacatttctcgaacagacaataaacacaacaataaatacgctaattacagtattaaaacaataagaaaattcacaataatacagtaataggtaagagcctaaatgaatattatgcatagaaattgatttatcaacggtgttccatccttttctttttaagatgaagttcattagaagtcggcaggtgcgtccgttcccattcaaaaatgggtgtattctggcctagatttttagaaaataacttttttggcattcaatatcgacaaaatcattcattgcattttttgacctttttaatacaaaatttgagtttcagcgcagaaagacccgaaaaataagtcaatcttagagagcaatgaaaaagataaacatttaaatgcttttgattagcattgtgctagcgaaagataaagaatgagactcttttttgagaattctcttatttttgagcacatttttggcgttttttagcacatagcccgggccctgtttattattattgttataccattttatagtgagcagttgcggcaaaagtggcaacgtcatttgtttgggcgtcttcaacattgagccattccacaaattgcgtcattttctcaggcacttccgcagcagttgcctccaccttctgtccgcccacagtcacttcgtccactctgtattcccccggcatcgattccttctcccccgacatcacattggcatgcagcgctttgatggtctcaaaaatgatgtataatttttttattttgtttggatgaatcatatgggtaggaaaatcctaggaggtctggaaatttttctcatctagagggcgggaaatacaaaatttgccaaaaactacggctctatcaaaactacagtattaacactataataccaacgatcagagaagcaccgattagaacaatggcgagaagcggatttaataatt

SEQ ID NO: 26551 - DNA, 1598 bp, Heterodera glycines
atcaaatagtttcttgtgttttgccaagcaacgtacctgcctacccagacacccagcccaataaatttagggtccgcttaccaaaacaatttattttaacggttcctggggtgtgtgggctgcacagcatcagctatccgtattcatggcactccacgattgggactttggatgatcaatggattaacattcactttgaggacacagaaagtgatactgttgagagacagcgagtgatcagggttccggtgcccaagggttcccataaaaaggtggaacagctgagagactttattgttgcaacattacgccatcagagcagcaccattgaacagctaaaaaacgacacccaaacaagcagcagcagcaacaccaataatcagcaacacttaaagtaacacagtcgcaacaagcaatagcagcaataaatcccaaagtaacacagtcgcaacaagcagcaacaacttcagcaactataacagtaaaaaaaggaacagcaacggcaaaaccgacaccttcaccatcgccaccggttgcaccagcaacagcaacaactaaagctgctaaagcctccccagttgtgcataaagaatttaatgaaaatgcagcaggagtcgatgtccttgacattatgcttggaggatcaaaacagtctgttgtgagtggagaggagaagaagcagcagcagcagcagccaccaaaaactaatgtttccgttggtcgtccattgatgtctccaccggccacggagtcgaaagatgtccttgacattatgcttggaggaccaaaacagtctgttgtgagtggagaggaaaagcaacagcagcagtcatcaaaaactaatgtctccgttgatcagcctttgttgtcttcaacgcagccgaaagatgtcattgatgatctttttggaattgttcccaaaacaggtgaaaaaaatcgtgcacaactgtttctcaacgaaatgcttggtgggtctgatgagaaagaaaagggtccaccactggagctactaatggaatttgaacgtttcaaaattgtttttcacgatccagcaatcagtggtctatcgttctcgcctcaggtcggccgagtgtgctgtccgaactgtcactttgttcttctcactgtatcactgcaaatatttgtgagccactaagctttgattgtccgcgttgtcgtatccccgttccggtacaatagcgagatgcttagacttgagatggttggttttgaagtgtctcatggacgcagcttaatttaacggcattttattataaaatacgaagaaaataaaacaaaattaccggcaattgtcatggacgtacgtaaaacatcaattccaccatgcggttcttttgatgctgctctgttcacgtttccaaatgcgtcaactgggcgacaagtcacttccatgaactcagtacgaaatgcaacaagtgcgctcatgaggatttctacatcattggtgcagtacgaggccagagcctcctcaagccggaaggagtactgtttgttgtgagaataccattgatcaaactcctgtcgcttagcaggcatcattccatcggccaagtagtcagatttttctggaacacaag

SEQ ID NO: 26552 - DNA, 993 bp, Heterodera glycines
  misc_feature (979)..(980): n is a, c, g, or t
taaatgaattggccataaaaagagcagcacttttgggtcggcaaatgtgccgcagaattcgtgaagtgacatgagttgccaaatgaatgccaaagtgagcacaatttgcatcagcttgaagtagacgatcttcttctccatgatgtcgccacgtgtgacgccttcttccgtttgctgtgatattttgtagctgaaggagcagtagaacgatgctttgacgcaattggcaaatagaggcattaaaaccagacaggcgcaatgaatgagagcaaattttccaatgccttcccttttatagacacttacaattagtaacaaaaaatgaaaattcccgaaaatggaaaaatttagtggggcaaaaaaaagtgtataaaaggcgactaaatgccttatgcgtttttaattaattctatacaaaaatatttatgaaatttaaaaaacaaaattaatattatgaattataaaaaattttaagcaaaaataatataaggttttttgattatatggcataaggcaaaaattgaaaaaacccgaccccgaacgatttggtcgaccccacccgaaccccgacacttccaaccccgacggtcggcgacgcaaccctaatttaaatcatacatattagtaatgttaaattatgttttttaatgttttgaccaaattaggtttctaataactacaaaaaccaacagcaagtaattaaaaaaacaatattaaacaattacgcggacggcacttttgcattggcgccgcttttcagccaaatctatgtgttttgacaaagtgagtctgaaaaacgtatacgctgttgtccctcaaatgatcataattatgccaatttcaatcccgaaaaaattattttctcttcccgaaactatgaaatgctgctgcggccttagtttgtaatgaaaattgttattttcgtatttctttatgttaaatttatgcattttcgattaaaatttacgagtgtggaccnntgccaggcatgca

SEQ ID NO: 26553 - DNA, 1521 bp, Heterodera glycines
  misc_feature (1514)..(1515): n is a, c, g, or t
atggattccgttgttcagacacgagggcaaacgccgacagttccggtccaaagtaagactcattcccaactctgaaggacagcgagtgaattggcacggcaccactgactacgacctgggcatttgcaggtcacctgctgcccggcgtaactcagcggattcagaggccacgacaaatggacggagccatggaagaggcggcaattttgggaagccaagtcggcgacggacaagccgatgccacggtcctcaatcacataggatgccgagtggagtgtgaagttgctgaccaagtcggggtggacgagctaaatccgggcggaggacagtcaattagggccaattaaaagtggagaattgcctcgggcactccgcccatgcagcagacaatgctgaagtttttgggctgggaagatgaagcggaagagtcattgtcagcagagaagactgacgacaaatttgggaaagtgtctgaactcaaaggatggcaattaatctgtggcatggattggccaccaacagaccgacaaaggcctcagcatgggccgggctttcctcgcgcgctttctctcgccgcccgtcctccccaaaactttcgatggccgaaagtgtgaaaagccaaaagaatgagaaggaaaggcggcggtgtgaggtcaacgtaataataatcatcatcaaattgtatttgttttatatattaatgaattttttaaagaaagaattattaaggaaaagaacgaaaaagggaggggaaagtgaaattcaatttggtttttaagttgaaaatttggacgggagagggggaggcgcggggggagtggggcgaattggccaatggcggagaaaacaatcgatggaagaaatgtttgctgaaaagcgtgtgaattggaagtaaacacgcatgaatgtcagtcaacctcttctttagaaaagcatgaaaagctaacacaagtggagaatggcaaaggaaatgagaagaggggggggggggggaaggggacatcgaatcgatgctttttggcgaaatacgaagggaagggaaaggaagggatggcccggggggcaaggggcaacaaacactccgacccctcgcccgcctttgttaaatgatggatgaaaaggaggagcacagctggaaagccaagggttgagagaaaagcggcagattcgcggccatgccccctccccttctcccccaaggccatttccctttgcgcaccatttggtcccaccaaattcccccctttgcccattattccaaccggttttgtgtgctttgcgttgttcttccttttctgcttccttttaaggagagcggaaggaatgaaggacaacaacagcaggtctggccaaagacagtttgaaaggggtatttttgactggagagcaccgcggggggaagggggggggagcaaacggacagacaaatccatccttccaattcagcaaaagggagggaaggagtcgcgcaacaatccatgcactcggtcgtactcaactcaattgtctcgacnnctgcag

SEQ ID NO: 26554 - DNA, 1192 bp, Heterodera glycines
ttttttccccactacagggatgaaacgcaataaaataatggttgtagacaaaagaaattggcgaaaaaaattgcctcacaaatcagtgtgaactgaaaagaaaaaaacttcccccaaaaaaaatcggagctttttcgacggcatcagctgcatttccaacagttcaacagtataaataaatattaggcaaatgaaaaatttttttccttcctctttagaaactgtctaaaaatttttgttgttaatattcagaaaacgtgttttttttactgacaatttttttcaagagaaggatatgaacaatcacttataaggctcatgcttggagataaaggaatcggaaaaaaaaattatctcaacaatcagtcgtgaaacagttcaataattcggaagcagtgccatattgggaaaagatgcacaagtagagtaggctcgaaataaaggcaactgccgaagattaacaaaaattcaaatttattggccccgttctgctttgacaggccatatctcgccagggagtggcggtagaccctttgttgatacatttgaaaatgtagagcgcgtctagctcattcgaataacatcaaactggtttgtttttgtcacgaaacaacccgctgatggccacgtcgaagaaaagtcccaaaatttgacatccataaaactccattttttcataggccagcgtgtttaaagcaaacccgaaactgataggaaatttaaattgatcataatagaagtttaatttttatttgtcccatgcattttctgggaaatcttttcgcgaaaagttgaaaaatttcaaaacggcagacaacagatgcatttcaaacaattcaacaatataatataaaatttaggcaaaaatttttgttccttcctctttggaaatggtcttaaattttgcttgtaaatattcagataacaagttttttttactgaaaattttttacacactacaggatgaaacgcaataaataatgtttgtagacaaaagaaattggcgaaaaaaattgcctcaacaatcagtggtgaaactgaaagaaaaaaacttccccaaaaaatcggagcttttccgacggcatcagctgcatttccaacagttcaacagtataaataaatattaggcaaatgaaaaatttttttccttcctctttagaaagtgtctaaaaatttttgttgttaatattca

SEQ ID NO: 26555 - DNA, 1609 bp, Heterodera glycines
ataaacaacaatcacttccttccttccttctctgtgaccgtcacataaaataatatttaaatacaatgaaataattgaaacatataaatatgtattttaaacatttaaaaaaattttaaatacagaaatactttaaacatttgcaaaatagagaaatgcgaaaaattattggtttttcgcgggcccttgcctcgaaataattctatccacgacgatcgtgtggtcaaagcaagaagcagaattttttaaatcccatatatttattttttaatttaggacaaatcgttttattataatttgctaaaacccaatcgtacacttttttttattattgttattattttcaacgagcactgactggaaaagcgatgaaatttttgttcattaatttgatgcaaaaatatggacagtatgaatcacgcagcatcaatccgagttatcactggaaaaaacaggaatttgtctttaacaaaatgagcgatataatcagatgggattggatggggcaattggtgggtgattttataaatcaaaaaaagtgggtgggcaaaacagacagaatgattcatattcatcaaaaaattccaccaactgagaattccagagtcattttattgtgatcggtggcaatgggtcattaaaattctaatcatttttatttttatggaaaaataataattccgccaattcatttttccgttatatatttaaaatcattaacataattaattttagcattataaatgggtacagtctgggcattctgtgcactgttgtacaatgttcacctgttggctgcccaaaataacggtaaattccacttcaaaaccttaattaagattaaatttcttttaaaccatttcgacccacttgattaaaatggtctaaattttcggatcttatgggcagacttttttgaaaattgataagataaagaataaattaaaattgaaaataattttaattggcagcatttaatgccgaagagatttgccgtcccatcgatggcacaccgttccacgcccaatgccttctctcttctgtagtcaaacagaaaggcttcatcccaaagcatttgcgcccgccatggctcaactcaccgctgtttgaggacaacaagctgagcagcgaggccaaagaatcggaaaatggctgtttttcctgctacagagggacaaaggcgagcaatggcaaaatccaggacgaggattactgtgcatgcgtggtacggtgttgagaatactgtataataaacttatctttaatattatatatcaaggtacaggactagattctgtttatttattaaaatcccggaaaaattgaaattttatacttttcgtaaaaatatgggatagaaaaaaaaacaatttttttaaagtttcggttcctctactattaaggataaagccaacgcagatatatcaatgctctgaatttaagtacaaagatcaagcaccgaatgatggattctcgaaaataattggaacatttgatggcctaaactgtctgcaggatttgtataaaatggccagttggtgaaaaaaataaaaaaattaatgcttgtcatttcacttttcaataatttagatgccaaaatgtgggaaat

SEQ ID NO: 26556 - DNA, 1625 bp, Heterodera glycines
  misc_feature (1523)..(1523): n is a, c, g, or t
  misc_feature (1564)..(1564): n is a, c, g, or t
  misc_feature (1605)..(1605): n is a, c, g, or t
cctctcccgcccccccccccccctcacccgacggaaaatgctttatttcaatgactaatcaatcgtataaaaaaagacggggcatatttcttacggctatgcgaaaggaaataatgaaaaaaactccttttctaatagctttttgccgccggcgcagggaccaaaaagctttcggcaccaccggacccgcaacacaaaaatactggcttggagcctagttcattctgctggtcatgatttgtatgaagagaatttggatcgcgaaaatgatagaaacaaaaaaatgtcgacctggcatttgccattttgagatgtgtttgctttgtgccgagtttgaactagcgccatttgctgctgctgttcatttttggcacgtcagtgtccgccgatttgttgaccgctccgctcatgacttaatttaacaaattacaaaaaatgtatttaaattctgccaatgtttctgccgactttgtcatcatgcgccccggtggcgacgccgtccgctgcagttggcgcaaactttgcgccaaacagtcggtgaagtgcttgtcgtggtcaggcgaaaacatctttttgaaaaagaaaattattttgagtaaaataaaaaaataccgtattttcaaaatgaaaacccaccgtatttttccaagagaaaaaattacggtatgataaatttgaattttttaaaaatgaactcaaaaaattgttttgtttttttttcactagagctagtaaaactttaagaattcccaatgattgcaactcgagaagttttttataagccatttcttcgcaattatacaattgctaaaaaaagttattacatgaattgcaaaaaaatacgaaatttttgtagttttttcggcgctacttaaaaggcggtaatttttgaaatttttttgcacttttttggtctaatttttttttgtttattttgatgcagaattttttttaacagatggtacgcatttcacgtgatttaataaattgaaaaaaaaaatttaaaagaaaatttggagcattggatgaaagatccaatttttcgagtgaagcactgcgcagaggcagctgcagaaacaaaaaattaaatttaagttttaaaacaaatttgcctcggcgtctgccgtctctccgccctttgcgttgtcttttgcccctccgccgatggcattggcatccatggaaagttgtcagagccgttccaacgcatgaagaccggctaagaaatgggcactcagaccagagaaacaattgctgaaaattttttcaatgttcccttgaaattttcttggattttttgaaaataaaaaattgaaaaaaattttttttagtgttgaaacaaatttaatattttttgatagaaaaacttaagttagacaattgaaaaaattctcattttatttatttctcactttttgtgcgtgccgttgggggatgatcgtgaattatcgcgttgtttgttgtcatcgcaaattggtgtgtagttgctgttcgtcatttccttctcctcgtagaccaacacngtaatcgatgatccgtttggcatccgaaaatactccgtttnttgtccaggggttcggtccgggaagggtgggccgatgcaangctattggaacaaaaaaaaa

SEQ ID NO: 26557 - DNA, 1230 bp, Heterodera glycines
ccaaaaagttttttaaaagcgacgccgcaaaaaaaacgttttttttttaaaaaaaaaagtcgtagacttgccaaaaaatcgcaaaatttggcagtttttggtgaaaatctgttaacaaattgcactcaaattttcaaaatttttcccggcggcgcctatcggcaccgccggaccaccccaccccttctcaaagagtttcttgaaaaaaccgcgccgcaaaaaaaaaagaattttggaccgtttcgaaatccctatctccatctttcaagtggaaattatttttataatttgtcttaattactagtacaaaaatagttccttctttgccttcaactcaaatgcaaatgccactgacggcgccggagggttcttccaatttgactttgcacaccgcttttgacgaataaaatctctatgttttttcaagttttaaaatgaataaaaacaatggcgtataaaaattggtttatttgaaaaaaaggtcgctgtagaaaaaattggaccttcgtatgaaaaatcggtcccgagacacccccctgtcccaatcgtccgtcgtatacatgccattgcttttgccttcaaatcccccaggtttctttcactgttcgccttttgcctgggccaatgattgcgcattctctcgtgtcttgtgattttcctaatcattctatgatttttgggccttttaaaatttagtgccaattcattccattcgaatcatttgcgcctttcttttctcaaattgcttttttacaactcatagagccgcctgaacagcttcggacacgcattcttgcgattgaacgcgaactcagccaaattggcggaccaaaaaactattcgctgttgctgcaacaacagaaccaaacaaaccgacggtcggactccattttgtaaggaatttattcacgcaacacaattttcgaaatcacttcatcattctaatccgttcgctgatttccatttgtttgattgggcattgacacactaacgcttaatcggccttcttttctagctcattttatctcttttttcctccaatcgtttatttcgttatctctctccctctctttgtctccctctctctctttttttttcttccccttttttccttcccacttacttttttctccacgtcgagagagattattacccactttattgcgtcgttgcgcacgcaccgcgtgtgagcagccagcgaacagaaaggaggaggagatgataaaggag

SEQ ID NO: 26558 - DNA, 1596 bp, Heterodera glycines
  misc_feature (110)..(110): n is a, c, g, or t
cctaattattgttaaggcttttctccaaaaacgatgacctcggcgactcgttggacgcggttgaatcgttgctgaagaagcacgaggactttgagaaatcgttggccgcncaggaggagaaaatccatgcattggatgaatttgcgaccaaactgatcgagggcgggcattacgcagcggaagacgtggccaaacggcgtgaaaaggtggccaaattaaattttaaaattaatttattatcgaatattgattggtggctcattaaataaattatctatagaaatctttataatgcattaagttgataattttcgcttttcttttgagagaaattatttttaatttcataaatttgttttatttttttttgttataaatgccttaaaaatcatttttatagtgatttgctgacttttttaaataaaaaataatcgcaaaaatatgaaaaaaaaatttgtacgttgatttgtacaacaattaaaattttattctatagctaattgtcggaattaaaaattcttttaattatttccttttcagttgctcgcccgtcgtcggcatttgatggatcggatggcacagcgccgggagcgtctcaaggagtcctaccgcctgcacagctttgaccgcgactgtgacgaaatgctaggatggatccaggtgaagctgaagacagctaaagaccaggtcaaaaaatttattaaaaaatgatcaaaattttctggtcacttcttgattttttccgatcacttagtctgaactggtcgagcgattctatctctctctcagcctttgggtttgagtttttcagatcaaatcagaaattaactgctctaacagattaagcaatcataatcattttaacttaaatgattattcttccctttttgcagagctatttggacccgacgaacattcgcggcaagttgcaaaagcacggcaactttgagcaggagttgcgcgcaaatcgcaaccgactggacgaaaccaatgcccccgggcaagaactgatccaatctgggcactacgccaacgaacacattcaggtggggaaaagaaaaataaaattaataatataaggggtaaattatctgatctaatgaatttttctcccacggcgcctagttttaaaaaataaacttgaaaagatttatttccagaaacttttttcgggtttctcgttcgtcactagtactggtttaaaaaattgtttatcgcttttgtaaagttaggaatagctcttaaacatattgctttaaaaattaacatctttcctttgttatttgcaatcaaaattaggatttattgacgattttgcctgtttattttgagtgttttaaaatttttcgagttcgcccgcttaaaacatccttttcataaccattttgtgcatctattaaattccatttcgcttttttaggagtcgcttggcatgacttttaaggagttattcaaatgttggtgtgttactgcgtcggatcgctctgtaaattatcgtcgtttagttgccggttggtcgggcaaaaatatatttcggaatttctcaatgcctaaggcgatgtgttggcaggaggttggccggaagcgtcacctttt

SEQ ID NO: 26559 - DNA, 1302 bp, Heterodera glycines
tttttggggaaaaaaagacttttctaaaataatacccctgggagaagggagtgggaaacatgatttcaaaattttcaattttttctagtctaatctactcaaaccggttcagaattcaataaaaataacattcacggtgcgaaaaatggggtttgacaagtttattgggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattctataaaaataacattcacggtgcgaaaaatggggtttgaaaagtttattgtggaaaaaagactttacaaaataatacccctgggagaagggagtgggaaacatgatttcaaaattttcaattttttatagtctaatctactcaaaacggtttcaaattcaataaaaataaaattcacggtgcgaaaaatggggtttgaaagtttattggggaaaaaaaaactttacaaaaaaaaccccccggaaaaaggagggggaaaaaagattttcaaatttttatttttttttagtctaatccactcaaaaacgggttcaaaattcatataaaaaaacaatttcccggggggaaaaaagggggtgtggaaaagtatttttggggaaaaaaaa

SEQ ID NO: 26560 - DNA, 1467 bp, Heterodera glycines
  misc_feature (1285)..(1285): n is a, c, g, or t
tttcgaatttttaaaaaattctaaaatttccgaatcaaaaaataagcatcatattcgtgctcagcacctcaaaataccccacaaaataatttttcacccactttttcaacccaaaaaaaaatttcgaaaatttctagggggcctagctcgaaaatttttgaaaattttacatcatgtagtacaccattcgatagagcttcaaaagctctacaattttgccctaaggcgttttttcgataaactcaactcctgccgagttatgggcccgggactcaaatgtcccgcttaggccaaaaaatttttctatttcctggaaaaaatcgaaaattttctaaaaacatcactaatcgatagagctcaaaaaacgatgttttggaagtggtctccgttttcccgggaaaaatcgttaaaaaatcataaaattcaaaaaccgaaaaaccgaattttaggcctaactcgaaaaattttgaaaattttcgaaattttaaaatttgtaaaaatcgagctcattgagctctacaataagtctgctggcaccccctcgctcagttcaaacccttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctctgaaagcaaaagcaaaaaatttcgtaacactgagactggcggcaaagtcagttttcgagccgctgggactcagttggcaaccggaccaaaaaatccgtatttttcccggatgcgccgtctcgagttacccctgtgtgcaaaatttcagccccccagctattcccgttcttctcaaattagtttttgagatgagttgccttgtcaatataacatatatataatttgcaatccaaaaaaattgatttggtccaactctatggctcaattgagtccattatcgaaattttgcgggattggaattgcagcgaagtttttgaagaagttttggaggagacgcgcaaactgtgtgagcagctcgaagttgaggagaccctgcgtcccaccgagcgtcgaacagcaaattctcctgtggaatttgtccgggatcaaatttttatcccatatttggagaatttggtgggcgaaaataataataattttatttatttcaagaaataatttttattttatgttttaaagttaataataataattttatttatttcaagaaataatttttattttatgttttanagttaataataataattttatttatttcaaaaaataatttttattttatgttttaaagttaataataataattttatgaaaaaacttcagaagaaattgaaaagagataagatgaaataattgacttaaaaactgataaaaataataagcgttgcaatatttacttaatttagaattattta

SEQ ID NO: 26561 - DNA, 2004 bp, Heterodera glycines
  misc_feature (321)..(321): n is a, c, g, or t
  misc_feature (1945)..(1945): n is a, c, g, or t
aattaaaaaggacaattcccgaaaaaattaaaaattatgaaaaatcaaaacaaattttttccgattaaaaatccagtaaatttggaggagaatttcattccagcggattacctttgggattataaaacattcattcgtttattgttcagcaaaaaaataagagcgaacggcgccccatccgttgacgatttttagagagttacatgggatcaaactctcgaggaaaaacgggaccagaaaaagggattgggacacgacgccggggtgaaaaaatcgttatcaggattgagttttgtttaggccgaaagccattattatgcncaatgagcgacagttcaattcggagacttagcattctgagcattttgccaactgatatgagtcgtagccaccaccacaaaggcgcgaaaatggatggaagaattgtggttttggtttgtccgaaagcaattaataaagcagattaacgtattctttatgcaaatttttaaaattttgcaatcacaaacagaagtgtgtcaacctgcttcagcaggttgtgatcgacggaagagcgagaactgtgcaatgaaacagtctcttttaactcatttatgattaaaatttgggcagtgcgacgacgctaaatgatcgtctttcactcacgaaagatgattttgagctttgaaaacttgagtttacattggcactttttacagtaagccgattattttccttttattacagtaaccgagtgattaaattattttataatatgattgaaacattttaaccattctgtcggcataatacgatgcaaaaagtttaatttatataaaaaattaattaattaaactttgcgagaatgatttacgtttgattgaaattaattaaattatttttttaaattcgtaataatgtcaaattgtcattgaaattgtatgaaataataagaaatgaccataacggagaacagaacgaaaggggcagtcacaaacagaaaaatgataataatttttacagaagggcattcccccgggcgatcgacgtcaaatttgacaatgtcttctttgttcttctttttgctcttctgttgcacttccaaatttccaagacaaatttctgaaaaagacaaaatatttcaaatgcattctctccactaattaattattaattaccatcaaaagctgctgtatttcgggctttaaaagttgttgtcatttatatcaatcacttaattatccccaggcatttcaatttgctaagctgagtttttcaattttatttgggagtgatcggtcggtagccatttccgtcggatttgagccaaacaaaggaaaaaatattttaattaaataaaaattatataaaatataataaatcatagtctttaaatggttaatttatgttagttaagtcaatttccggacttaaaaagaaaagtttttttaggttaaactttgcccatacgtcagcttcctctttgttaaaaaagtgttgaaaaaatgaaaatgaacggatacaatcataaaaagagcgcgagatcgctttttgtgtcggcatggaaacaccgcggaaaaagcagtgacaaaagaaaaaggtaaaatgacgaaaaattgaaaaagtgcgaaaagtcaaattaattggaatagataaaaaatttaaagacaacaataaaaaatgaatggaaaagtcaaaataaattatgcaatttttagtgttgaggcacaaatattggcgtaaatacataaaaaaaaagatttttaaatttaatattttgttttaaattattctttattcttcgctgctgttttgcaaatgctttctcttccgcttccctttgtccgcttttcctttccgttcatcggtccgtccggttccctttttggttggcttattttgctattgtatttgatatattgaaaatattattttgcttttccaaagatcgcttttgcgggtcgcnccgaccaattccaaactgggaagaatgtgccccaaaacccttccgtttatttacatgcg

SEQ ID NO: 26562 - DNA, 1720 bp, Heterodera glycines
aatgccgaaatgtcttgtttccgccgattttgacgtctttcttgaagccatttattaaaatagatcaaaaaatttttaccttaaaaacgatttcaactgccatattcgtgatcagtatggattcatttttaggcacaaaaaatcgcgataggcacaataaaaaggcagaaaaaatcgcattctgaatctatttcgaccaattccggattcggaaaatccaatctcgaaaacttattcttattcagaaaatttttgtcattctgtttgttgcaattttcaaaaaatgtaatgcggattcctcttgatcccgctcaaacctacgatattaattttttagatattagatactttttatccattttcacataaatactctcttacttcaaaatgtggaaaaatccgaaaaaagccaagaaggaatggaaagaaatgtgagttattaaatcttattttataaggtttttgaattaaagaaaaatatttttcgtataatttgatatttcccagctctctctgcggcgactgttggctgtcagtgttccaatttatcggcccctatgaactcgggttgaaatttgcgttgctcagtgatcgatttgaccatttggtggacgagcatttcaagacgaaaaagtgggcgatgggtttcctggaaattcgtctctcctcaaggggaaaacgcgcggtgattgtcaacaattttggcgacggacagcgcagtttttatccaattccacaaaagccattgcccagcaatatcgtcggatttgaaagcattcgtataaggtgccaaagacagacacttggcttagggggggggctgaattcaaaaattcaatttttagggtttcatttttttagagtctcgaattaggcggtctatttagcaggaatttgtagctgcttctcgccaaaaatgctattttttgccatttggtctccatttttttaatatggtcaattgggtgtccggtgcgggtgctcattttttcaattctcacatttttaaattggtaataatttgctaaaatgttgggaagggacgaaacacaactaccaggccaactcttaactgctccgacttgtaaactgtttttcggccaaaaaacgtagtactttttcaaagtcaacaaaaaaaaatacaatttgaaattcaatcgaatattttgggtagatttttgtcagatgatttttgggttgaattttaaaacaacatttaaaggaattggttgtccaacagtatagacaagttcgtctgtagaaattgtgaaaattccgataattctagcaaattcggttttaattgtggaatttttttgttttttttccactaaaaatagagttaagctctaatctaaccctaatggccaataaaactatctttttaatcccaccaaacgcgcaaaatttttttgttccaatttgcagttacgtcgaccaacacgtcgtccaatttctccaccgcattcgccgccttttcgactctgtcccgacaaacctttacattgcgaccgccgctttggccgaaactgtctaccgcccgaagcactttgtccgcagttgcgaggcgattcgccaacacattttgccgctgctccgtgccaatgtccgcgccctgtttttgtcctctcccattttcgaccgtttgctcaaattctcgccctcctttctcgtcgattgcccctctctgggaacatcgattcctaccaagtttttccct

SEQ ID NO: 26563 - DNA, 818 bp, Heterodera glycines
ttctcaaaaaaagagatagccatttttctgggatagagtataaatttaaaaattccgtcaaaaataaaaggtctattgcactccgccatccctatcatgctcgagagcatttgtatgtgtataaaatttatcaaaaaaagagatagccatttgtttgggatacacctctaaatataaaaatcctctgtgaaataaaatggcgattgtgcacagccctccgtctcatacgcaagcgcttttgtgaggtataaaatttctcaaaaaaagagatagccatttttctaggatagagtatcaatttaaaaattccctcaaaaataaaaggtctattgcgcacaaaagctcagaaagtgtttttatgtaattttgagttggtaacgtattcggcaatttttcctaattgaactgcttttgcaattcattttgcgagaaaataaattcaaaaacagatttgagaggccaatgattttgtttttaaagttaatagcaatggaatttacaaaaataataatgctttatgctattgcttaatttaatagcagttgaagctttcttatttgtaaatttccgaattatgatcgcttggcgaaatgaatgaatttgcgttagtttgcgaattttaattggcaaagtgaatacttagcgaaaataaaattgctttacattcaaattaaatgattagacccgcccctctcctccagcagattcttcagactcgagtttttcttggttaaattttgacttcagcagtataaaagaaaattgccgaaaaaatcattttaaatacaaaaaataaatatcagttttcaatcttcaaa

SEQ ID NO: 26564 - DNA, 2434 bp, Heterodera glycines
aaaatccaggctcctcgagactggatccagggctggactgggattttttgaaattgttttaaaaagcaaacaaatgcttgaaaaaatcaattatttgctagaagcatctaaaatatctaaatataataataatgtgtttttaaatttatttaatctgtttttgaaaacttgaaaaaacatcggtcacttgaaaaaataaattctaaaatttcgtccaggaaaatccaggtttttcctgttttgcctggagttttattccgtattattcatcggttgggtcccctttttggaagaaaaattctttttatattcatgcttgtttagtatgatagttaatttgttatcttaaaaattttctttgcaaaaaatgaagggttttttctaaatataattatgtgatagtacaaattttaattattataataaatctatacattgaacttatttattttttaatttacattttttttatatttatagaaatgattattttttcaatgtttttgaaaaataaattatgccaaattttaattggtaaaatatacaaatccatgtttttggcattagttttgtaattttgttaagaaataaatttattcttttttttctattcatttgaagtttcatgttccgtgggttgaatgattttatttggttgataagctgttttttaacaacttactatattttataattaaagttattaaatgattggacacattaacaaataattattttgaaatgatttcttaattaattatataatttaaaataaactgtcatcagaaaagctttttttctcattttaattttaaaaatttgtttattattttccatattttgtagataatacattcctgaaatcaataaacttcaagtttcggaatttataaatacaaaaaaagaaatattaataaacttttcctggaagctgaaaattttcagaaaaaattttaacaatattttttctattaatatggatatatatttttttattgcatctgtaaataaataccaaatattattcatttacatccttgaatttttatgattttttgcggaccatgccaaaaactgacattcacgcgctactttttggcgaatttaaaaaaatcgattcaatgtacaaaattttagccttgttattaaataaaaatatgaactcacaataaaaaaaatatttattcatgaagggcaaaataatcttttttttatataagatcaaattatttaaaattatttcagtttcttaatggctaaattaatatcttcagtttttgataatgggtcataaaccatggaaaataaaataatgtcaaaaataaaccaagctttaataaaaataataatcataaaaccggagaccaaattgttatttcataaaattaaaatctcatttattaaatttcgggcgtgacacttttcaccgatttaacaaattcacgctcaaaacatgattataatcaaaaaattggcaaataagatctaatgaaatcttattcaagacaactttacttgaccaatttttaatattaattgtttaattttggaaaaaccgattcatggaaatattttaaccttaaaattttgataaattaattcatagattcaaacatataaaattgcgccgatattaaattagaatatttttaataaatctccataaattagaaaactattaaaaataattgaaattatagaagattttatgaaagccttcctttttcgaattagttcaatctattttaggaaaatttttaacaatttatttaaggatattttaatattaaaaatatatttaaaattttttatttcattagcgttttatgtgtaattattagtcacaaagaggcctaaaaattcgcttatattttgtgaaaaataaaaaaattgtttaaaaattaaattttaaaattttaatccttcaaccccagaaatcaaacttttaatgggctggatgacatgataaaaatatactaaaactagtctagttattgaataaaaacgtaattaatgaacttaaggcggcgttgtaaaattatgcaaattaattgtataaaaaaatataatactctgtccttggacctttattattttgatttatattaacgatcttcctgatgctttgccatcaggagtaagaattaaattatatgctgatgatgttaaattgtatatttgttataaagcgagagttgacacagaaattatgcataaagcattgcataatttatcagaatgggcaaataaatggcaaatcagaatctcaattaaaaaaacttttgtactttacttggggaataaaaaccccaaagaaatatataaaattgatggaaatataataaatgttgtggatacaattagggatttaggcataaatattgataataaattgcaattttccaatcagtcgcacaaataataaagaatgcat

SEQ ID NO: 26565 - DNA, 1013 bp, Heterodera glycines
aaaaattacgaataaataatgtcaaaataaatataactctttgaaaatatgtaaaaataaaataatgattaaatgtcaatgtcaatgaaattccatagaaaaaacgatgaccttaatatgacgagttcgattattagactaagaagttaataatgtaactcattataagatttccagataaatatttacttgaatatttcttaataaaattaaataaaagaaaccgaaaataaatctcgtagcaacggtttgatataattgaaaaaaacagattaaaaatttgaataaaaaatcataaggaagtttttcatttaaattttttagctaaatgttgttcaaaatttataaattttgctaaactaatatcttcatttttaaaaataacaaaaatgaatatttcttaatagcaatattaaatttatataaaaatacattaagaaattaaaaataatttctaaaatttacaacaaatctgtcataacaaaataaaaatataaatcaaaaaatctttagaaaatttcaattattttaataattaattcataaaattagtaacatttttacgtcaacaaaaatatactgttaacattcttttcgaaaaatgaaaaacctgccacctgccgtgccaagaattaattgcagcttaattaagtattttttaaagttattaaatataaactgataaataaagaataatataaataatattatatatcttcaacacataattagaatttaaaaaattaaataataatccttgaatagcaaaggattttttaattaaaaaagatcgtaggcaattaaaaaatcattgtttaaacatttatttaaaattatattttttagagatgactttttaaatgatgagcgcagctctggtctttaaattaataaaagcacaaagtaatttattatttttaaatggaatatgaaaaacaatttaaaaaataatcaaacgctattttttatgatgttgaagaagtttaaatattatcttttgtattcttggcaag

SEQ ID NO: 26566 - DNA, 1419 bp, Heterodera glycines
ctaagttaattttgttatgcttttctattgttggcacctccactgattgcctttgcttcttcttcttcctcctgtgccgttctgttcctccccgcttccccctttgcttttcctccgtttgcttttccttttcctttttcgtccgccatttccgtcccattttgcttctgctgcttcttctgtgccgcttctgtcactgcttcgtcttcgtccgtttctccttccactccgccaaattgggcttcctcctctccctcctcctccagttgttgtgcccgtaacaattgggtgaccagctccaactcctcgtcctcgcccgtcactttcgcgccatcttcatcaacggcatcatcaacattgtgatgctgttccgcttgtgttgtgatcaccggttgctgctgtttctcagcgatgatccgtttccgatcacaatttgtctacaaagaacaacaatgaattgttggaaagttaaaaaatttaatgctttacgttttaaacataaaattaaacaaaaatgaattttttttttttttttggtaattatttttaatttatttctttcaatttgcttttgtttttcacccgtgggcatggcgttatcgccgacggcgtttttccaattcgttcctcacacctttctacggtacactcaaagtggatgacgctgccaatgttcaatcttcgttgatcaaattgggtattgaaacgaaacatttgcggaattttcgcagtcgctacagtaaccaaaggcagtttttggtttgcggtagtcaaactttgcgttgattgagttctttggtttcgctgaattatcattgggagaggcgtggaggaaaagctgttgaacagcagacgatttgattgctcaaagtcggtgatcaaatgcttgtccatgctgcaaccgtcggagtcgatcagctaaaaaaaggggcttaacaaagtcgaaattgggataaaaataaattttgatattaaaataattaaaaactggaattaggttaaaaatgaaaacaaaaagaataagcatttatttataaaaattgtttgtttaaatgaaagggcaatttcaaaaaatggtaattatttattatttaattatacagtttcaaaaaatgttatttttcattaattatttattaggtatttttaattaatgttgataatctatgttaaaaatttgagtgatgttgcgcaactcattccaaacaatggctaacaaaaccaaattgtttttacgtttttgcccatcagtgaatggcaaacgaatgggtattgtggtacatggtcattatttgtgcctgttggtcaccaacagcagaaggaaaatgcaaaagttggagctgttcttttattgggtgtaattaggcatcatttggaagccataagggacacaaaaagagtaattatcgctaatatgag

SEQ ID NO: 26567 - DNA, 796 bp, Heterodera glycines
ataatgaaaaggtggtttattgaaaaaaatggtgttaattcgagtgcaggatctataaataaattaatattattttaatcattaaaaatattttagttatataaatgataaatcgaaatttattaatgctctgataaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaatataggaaatagtaaagttcatgtgatcttgatagaaaatggataatgaaaatgtggtttattgaaaaaaatggtgttaattcgcgtgcagaatctataaattaattaatattattttaatcatttaaaatattttagttatataaatgataaatcgaaatgtattaatgctctgataaaaaaagcatttgataatggattcaacagaaacggaaaaattagcactttgtggaaaatattttacttacagatttgaaggcttcagacgcggtgtagaatcttaaaaaattaatattatttaaatcttttttatgatttacgcgataaaaattaaggaaatagtaaagttcatgtgatcttgatagaaaatggataatgaaaaggtggtagtagttaacccccatatatcgtcgtcatgattaattgctttttggtgacagctgccctttgaggcgtgccgccgcgcgcgggtttaccgcgcgaacccgtgcctgtggcacgggttttgg

SEQ ID NO: 26568 - DNA, 1047 bp, Heterodera glycines
  misc_feature (19)..(19): n is a, c, g, or t
tgtgatgggttggtgtacncggtgcaaaagcattggctgttgaaggacagttgtacaatgtgtcgtcagcacagctaaaactgcctgccagggaagcaaactgaaaaggaaatttctataaatgaaataggggatagggcagtccaaattggaatccctgaggggggggggggggctgctattaaagagggggaattcaaacagaaatttttcaacaaaaaatgaaaaaatttcagcgattttttcgaaaatttatatgaactactaaattgtaagtcatcgaaaaatctgttgaaaactttttcaagaagattttttattgaaacattcttataaaaaaatttcatcatttttttttgaaaatatcatttttacaagtttaaaaaaaaaattttctaacaataagaaaaattaccgcttttgttcctccatggtacacacttttttcattggcatacattgtgcggactaattgacgatattcgtgtctttgttgctcattcaatgcctcaatttgatgggaatagttgatgcaaacttgctgaaaataatttaaaatttaatttttttttcaaaaactcttttttcaacccgtaatttttcgttgagcatcgaaatttcataggaatgtttgtcaaactcggcggcatcggcgactgattgggcaagtgtttgctcacaagtgagtttgatgcgttcaacctcaaagttgcgcgcacggaccaatgaacgcatctgacaaaattgagttaaaaaattatgatttttttcgtaaaaaatttattttttttcaatataaaaattgtacgaactgccatgatatcaattggcttactctacaaatggtgttaaaaacatatggaaatttggatacaatttttttctaattgagccacctggggctctatttttaacggagttggacaaacagtcactggacgagtttttttaatcatagtttttttccttttcaatcaaattaaacattcttggtacagtttgaaagttcttgataaacttttgttaactttgaaaaataaaagaaaa

SEQ ID NO: 26569 - DNA, 1672 bp, Heterodera glycines
  misc_feature (928)..(928): n is a, c, g, or t
ttaaaatcataaagcaaaagtcatttttttaaattttctttcaaatttaaaaatcaataaaacgcttttttgaggcgcgctttttccaaaaaaactttttgggaagagggggcaggcggcgccggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcccggcggtgcccataggcgccgccggggaaaaaattggaaattttggtcatttataaacgggttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctgcaccacaccccgttaaatgttgccatcatcattatcttattttttcatccataatataccgtagtgcgacatttgcggataatttagtgaattaaaaaaaataaatttaacaatatgaactaactacaatttaagtgaaacaaataaatgattctaaaaaaataaaaatattcaaatatacgagtaaatttaaaaaatgaaaaatatccaagcaaaaacagttttgcttacaattagcacataaatagactgttatttcattcccaaagtcaaaattattagctgcgaggcgatattgtattgctctaagatggcttataatctgttcgctaaattgctgctntgtttgaattgcctgcggcttcttttgaccaaatttgtttttatggttaataaattaaataattattaactttttaaattttttttgtttaggtgttgatgggttgccaaaatgaattcagaaagaagaaaagcaacttgcactgttgcttttgtatgcatcacacaactttggcaaattgaaattgtttaaatgcgattactactgacttatagcgtagaatattttgatattaatcacttatatataagtatttggatatattttattttttaaacttatttggatatttttattttttaaagtcatttatttgtttcacttaaattgtagttcatattgttaaatttatttttttaattcactaaattatccgcaaatgtcggctaaccccgaaaacatgtctagccaacaaaatagtctgcataagagtgtcgaataaacaccagcagagacgggaaaattcaaaaatgagttagtttcctttgagaaatttctacttaataaaaaaataataaattgtttttcgataatttttaatgtccgtttttgttaatgctgttttgaagaacaggcgagacggatgccccagtcacgtgtaaccaaaattgaaaaaaaaacaatttctgcagcatggagcaaaatgtgcagttgtttttttaaaagaaaattgaataaaaatattttcttatttgaattttgttatttaaaaaatattatatataagcccaatttaaattggct

SEQ ID NO: 26570 - DNA, 2520 bp, Heterodera glycines
aatggcaaggttgttattttacacgccataagtataatcgtctaaggctagagtgatttaaaataataaaaagaactttttgaaacggttttaacaaaattattaaaaggcaatcagtgagtgatcaggttagcaaacatttctgataacaaccgcataataaattaaattaaacaatatgaaacgagttaaatactgagaaaatgataataaatccaaacaatccgttttctacccatgaagcatattgtacagctccttccttttagcatccggcaaaacactaacggcattccaacgactggcttccaaggcagtgtggaattcggcactggaattgtaaagaatggcattgtgctcttcagcagacaacggttcaacgtctaaaaggaatttcagagaaacagtaacaaacgaaatttcaccttcatacaacggctgaggcggaggcatatttgccatgacagtttgcgatattggaggctgtttcatctgtggaggtccaactacgccggcaactgatgggtaaagcccaattggagccatcatttgtccggtcggatgaaccatctaattgttaaaatacgtgaaaaaggcggttaaggctagagattgattaagggtgggggcgcctaaaatttgtgaagagtaccagccatgtaaacatgattttttgcttttcaccacattttttcaagtgagtttttctaaaataaattggagaataggaaaggcctagcggcgttaatttagaaaaatttagagttttttgttgaaattgttactagtaagacatcatacattcttaaactttcatttctataagatgatttttgagtattttggtgggtgataaacccggtaagtgaaaacgaactgtcggttggatgaatccagcattttgcggatatccaagaacaagcggctgtccaatgaactgttgcccggcaggcactcctctgccaaaaccagcaactccatgatttggagccaattgagcgccgaatgacggtgaaattgcaagttgccctccagccgaaaccattccgtacggtatgcccccgatcattggcatagcttgaacaggcgcgactgcggggatgggatttgtggatgaatatggtatcgtcatttgcactggtctgtgaggaaatcccatttgcaatggcgcatgatttctttgctctaggtatttagaaaattgcgcctgatctcgtttattcaattatgacatttttaccgaatccacctgcagctccgtacccgtgacctaacatattgggggggccaccatgacccggaaatcgtttctcggcaggtccaccacgagttttcggtcttgcaagcttgagaaataaatcgcggccatgaaatttgtgtttgttcagttcaaccttaacaaatcggattcattagtatttcacatgtttaataccaaagccttttgttggtcagtttcagaagtaaaccgaacaatccttgttccttcgatgctccatcttcgtttctgtaaacttttgcacctcggcaagacatatagcgttcaccaaacaactaaaacaaacaaagggtaattctaagaattgtaaactttactcgaaacagtgccacatcatcaacatctggagccaaattgttcacaaaaagattgtattcaatagaccttagagttttaaggtgagaaaaaaccaaataatacttacatatgatggggcgaatttgcaaaggccaaattaaagcgcgacgtcccacttggatcattaggtaacttaattataacagattaatttcaatagacaaaaccccaagcgcaccgtcatcccattaaccctcaacatcgcagttcgagcagttggtccgtctcggaattcaacgaaacaataagtcgaccgcttaatttgttcaaataaaacgtggctattatgtatgcgttctcgtaataccattttgacattagtaacatcgcctgcattttctccaaacgcttcacgaacaaaatttgcatcccattccggtttcaagtcgcccatccacaaggttgattcaggaggacaaagtgtttgttgttgttgcattgcgacgcttgaattatggaaatcttgatgtggtgtcatcatcttgattaacgtcgactgtttgtattatcctcttgaaatagaaaattttattttaattccttgtattactacatacataaataggtaagtataatatatgtatgcggtaatactggagaatctgggctccacccaaaaaaaaattttcttgtgaaaaatgaacccggggttttcagtgcttctgatcacgaatatgatatcaaaatttgcaaaataattgactttatcatttattttgaaatcatagattttagaaattttgaccaacatggcagggtaataaatgttgattgtttatgttttcgattgttctatgatcatctcattgtttaataaatagtgctgatcatatatggttgcctcactcgaaaaaatgcagcatttgatcatgttggtcaaaatt

SEQ ID NO: 26571 - DNA, 1445 bp, Heterodera glycines
gttattattattggggatagtattttaaaaaaagtgcttgggaggcagagagtttctaattttcaccatccccaaaattacaaaaatgcgaattaaaataattttttcagaaacgaaattaaaaataagcacctgtttaaatatttagaaatgattgggaaaaatgtagggtgcactgaaaaatatcaacaaaaaaagttattttgaatcaaacaattattattattgtcaagaaaaccttaacacaaaaaaaaagggttgggtaatttcacaaaagaacggggatgatgggctactgtggggaggaaattttttttggtttttcttaatggaaaaataaattccaaataaatttttcagataatgttttaacctgcatattattaaataagttgtggaaataaaagattaaattatttaaaggaaaagaagcgaaagataaggattgtagatgtgtaggtaaaaaaaagctttattgaagatatgatatagatgtatttgtagcgggaaatagctgaagtggtaaaaaattcttgagtttataattttgttacagagcatacaatggcttagactaagcctaaactttaggattaagcttaagcctaggctgaagacttaggcttgcttgggcctaggcctaaattgagactttattttttgtatttctataacgattcgggtggtataaagtttccgattaatgtttcgaaaaacaaacaaactgtttttgtgacgcgtaaaaaaccgactagaaccgatttcacaactttttctagtcgataaaattttataaactgacatcattcaaaaatgcattattccgggtttaaacatacgtaaacaaactgaaaaactattaaccctgcaataaaagatcgtttaggccgtttttagacgaaatgaaatccgaaaatttggattttcgactttttgttcgagcaacaatctaattcccaaatttaatacctattaaattattttcaatttcaataataaaagcaataaaaaaaaacacctgaaaatgtaaaagacatgacaaattgagatttggataaagataaagcatactttacatacaataaatgaacaaaaaataaagtgggaccaaagactatccatgcactattttttgtttttcaaatagcaattatgcaatgaaaatcctttgtgtgtcttcgttctgctgttcgtcctcgactttagcgtatgtattgactgcctttttcagtgctttttcaatgttaaaaatccaatggtcacgtatcatcgaggcatttagctaaaacattcgtaataaaacatatccatcaaaaaaaataacctggatttcgtagagggcggtgtgttttatccagcacaactccacacttttgttgtcagtgcatgtcaaatgcagaagatggccaggtggtcgaagatgctgaaatacgataaatgtgatt

SEQ ID NO: 26572 - DNA, 908 bp, Heterodera glycines
acttttttaacgaaaaaacgtcgttataaattcaaacgacgaaaaagtcgtttattaattataacgatgttcacaacgccaaacgatgttttaacgatatttttttaaaaataaattaagtatcgcgaaacaatgattgtagggaaataaggcgtgaaattgtgaaagggtcaaagcgattacgacgataatcataaaccagcggtgaaaaacggctaaaaattcgttcacaagatgtggatgatgcgggaattgacaaccaccgggtggctacagggacaacaagtgcgcctttcagggactgtcgtattggatttattcgccttgaattttagcaggtttagagtggggttttggatttttcaccttagctcaacgaccaaacactgcatctccttaattgcaaatccgatatcggttataatctgcataatttccgcatcaagttcggtatttccgtagggttgcgttaaatgcctcaatatttgcactttactattaaaaattcccggagaaacgtaaggtaaataccgcgaaattgttgccaaaatatgcaaaaaacatcgttaaaacatcgttggcgttatgcacatcgttaaaattaacaaaacgatgttaaatcgtttcttttttttaaacgactaaaacgtcgttttgtcgttcactattcccaaccactcctatacacccatcacacacacaaaaacgcacgcattcaatcatgcgtgaaaaccgcacgcgttcggtagggggtcaactgcgtcttgccaactgcatctcgccaactgcgtctgatgagccaactgcatcttagtaaaagggccaactgcgtctacgtaaaaaatcaattacctaatacccaaaaatctataaaattcgataaataacacttacccttatcctgttca

SEQ ID NO: 26573 - DNA, 1975 bp, Heterodera glycines
aattttttttcgattttcagtagctacctaatactgtcgttggtagcccccctttttataaaaaagaaaaatcaaaaattttttttctagataaagttgtttttggtggttttacggtcggagaatcctttttgctcaatttataaatttaagctacagtatgtgtgaacaatttaaacaaatgactgatgtcgacaaatgggtgggttggcttcactctaaagggattcaggtgacatatgaaatcaataagaaattcattcattaaaattgtaaatttttcccaaggtcgagtcccatcttcgcttattcactgccgaggccgtccgctacatgaccgatgctgagttccaccgatttcggctcaaatacatcagtaattagagcatttttaattggaaatatgctttttaaataaggaaattggaattttttaattggagaacctgaaaaaaaaaattgtttaaaattgtgatttaacaaaaaagcttagcaggggcatttgttgcttaaaacaaagtccatttacaataaaaatgatattgctttcatctccccaatccgttggcgagaggacgcgcgcgagttggccacccgttgagcagccgatcagcgaatggttggttcagtgctgggacagtgcggccgcctacggcgagcagtgccgtcgcgtgtccaaggcgcgcctattcaatgtgtgtgtttgtaccgtccgtcatcggcattttaaaccggaataaaattgatagttctagataaatgcttggtatgaaaagcatcctgctgtagtgctagttaattggtcaaaaagatgtcagcttctgctcagggactcccaaaaccccggaaagagtttttacaaattattatcataaaaaattgcaaaccaaaagggtttaataaaattcacaaactgtcactagtaatagcgctgaatttccgaaaaagtgccaacaaatttcagcatatttgcatgcattgccgcaactgtccggatgccatcgttgaaatgttccgtttggtggcccggtgtaaagacggtaggaatttgcaaatttttttgtgcttttgaatttttatgccgccaatttgcagacgacccgcaggcgtacaaagagctgctgctggtcgatctgaagagctttgatttttacgcgcgaatgttcgacctcaaaggcaatccgatgaaaatggacgcaatttcgaaggtatcaatttgtggggtggcgaggttcgggggttggtcctctcaaaatgtcattgcgtacgctgaattcactcgtatccgtccatcccattgacacgcagtcgatggttttacatgaatttcaatgcatcgcataggactcactttcgcttgcttttttttatcctcgtttaactcattttccaactgcttttccagattctcgagccccaagtgcttttcccggtgtttcgtaagctgaatacacacgaatatgagtccgttgttcaacgcgctgagaccttttacaatctctcacagacgcgcggcgccaaaacggaggaacagcagagatgggaaattgcgaccagtgagcgcaattaaaaacaaaacaatgagaaaagacactgacagagtatttgatatttactcaaaaaaggaggtctcacaataagttggcatttttgattttttttttttgcggtagttgagacacatttctcctcttttggcagatgaacttttttgcgacatttcggcatgtactcttttgcgggggttgcctttctgcaccgatacgctggtggcacctgttggcaaaagtagcggtttggtgcgtgcgagtgcgcccgaattaggagtacgtaagaaaatttctggggagaaggttttgtgtatcacttcctctacatccccttacaaaacacagtaaatttgctgttttaccttcaaaaaatgatttttttaaaattaaagtaaacaatgtcaactataatttaaaatttcaaa

SEQ ID NO: 26574 - DNA, 1275 bp, Heterodera glycines
ctcaattatatctcttatctttaccattctctctctctttctttctttttctttacagacttcactttcagtctctctctctcctttctctcgctctctctcacttcctctctccctttatcttcatctctctctactctctcccttaagtcaatctctctatcccattttttctcatccctccaactctctcttgatttctctctctctctcccttaactcacctcttattcaattctctctctcttcctttctttctcttatacgccactttcattctctctctcctctctctctctctctctctctctcgatttctctctcgctctctctccccctaaacttaatctctgtctcccattttctatcatcccccccactctctcatctcctctctgtttcttctctctctagctctctcacttcctctctctcctcactctcgctctctctctatctcttaacttaatctctatatcccatttttctctcatccctccaaccatactcaattttcactcactctctcttacttctctccttttcctttctcttaatttctctctctctcttctctctgtctcttctctctttctcacttcctctctccctttctcttcatctctctctcctctctctctaacataattcaatctctttatttcattttttctctcatccttcaacctctctctcatttcctctctctcttccttttttctcgtttcatactcaattttcactcactctctcttacttttctccttttcctttcttttaatttctctctccattatctcaattctctctcttctatttagcattctctctcttcttttctttctcttatgctccactttcattctctatctctctcaatttctctctctttctctcttacttcctctctctcgcccttaactcaacctcttatttttaatcttcctttctttctcgtatactccactttcattctctctctctcgctttctctctcgctctctctccaccctaaacataatctctttatcccatttttctatcatcccaacatctctctcttctcctctctgtctcttttctctctcactttctctcttcctttctcttcctctctttctcctctctcacataattcaatctctctatcatatttttctctcatccctcctactctctccatcttcctttctttctcttttcatactcaattttcactcactctctcttacttttctccttttcctttcttttaatttctctctccattatctc

SEQ ID NO: 26575 - DNA, 1154 bp, Heterodera glycines
tcaaaattgaagtgcccatacctcagccggtataagtcttttagacatgcgtttttttgaatattgtagagaattttgtgctctataaaatgggcctactcaaaatttccagaaaaattttcccaacccctagaaattttttttgaaatttacccctcgttcccagccaaaatgggctgatcagatcaccatgaaggagtgatctgatcaacttggtgttgctaccttttttgatcagcatccaaagttatgcttaagcagctgaaaccgagaagaatcgaatttgatatcgaatatacctaaattatgatttatgacttactggaaaagtctgtatgtcggaatcacgactttttttggtgggggaggcataacaaaaagagcgagagagtgcacgtggtataccggaaagaggctagagcactaagaaatagtgttccaacaacagagagtgcacatggtaaatggaaaagaagaggcaaaagatgaatttctcaacttaaataaataattcaatttatatatgttcttttctcagcaaataggggagtaattaatatgagctaacaataattaaggtgtttatcaaggtcccttatcacaaatataacctttttgttctcatcagatatcatctctgacaaagactcaactaaatgaaatgaatttgatcagattttatgcaattcattgcctttatcccctcccgtgactggacaatccgacagtggacaatccgacagtggacaatccgacagaagtggacaatccgacagtaaatttctattttaaaaaatattttcaagtcattagatgcattttactggccaaatgcattttgaggtgtccaatcaaaagtaaacttagttatgccataagtatggatgcgatttacagtaactaaaaccgccaaaatcgttagtttttaggttctaaaaaactataaattgcatccctagtcatagaaatagagggtgatcatggacgccaaaatgctctattggagcgtaaaattcaatgtaaaatgccaataaaatacatcagactaaccatctgcaattgggctcaaagcttcaaagctatactcgaacccgtcggccaataaaatttctctgcgctgagatgtttcggaaacaaagaagattttttcattt

SEQ ID NO: 26576 - DNA, 1181 bp, Heterodera glycines
aaaaattcataacaagaaaactttttttgcttttatttcgtttaaaggagctcaaaaaagcatttctgtattgaaattttcgattctgaagtcactatgcgtcattaaaaatcagactttgtcagcaaaatattaaaaaattttggctttatgtcattattttagagtagagcgggaccgggaccgggccgggaattcccgttcatccgaggtccctgttcccggtcccggattttgaaaagctcaggtcccggtcccggttttgctcaaaattcccagtcccgctctactctacattattttattaactatttcgagatttttcatcactaaaagtcgcggccctagtcattaaaaatctgttgaaaaataatccccccgtctccattaaaggccctgtctccaattatgtccccctttctaaagaggttgaaaaataatccccccggggccttaattagagaaaatacggtagtcataaaaatttattctctggggtttttggggtccccgatcacgaatccttcaattattttgatcaattccgatttcctaatctaaatttgaacaaaaaatcataattttaaaaattcaaaatttcgatttttattcgagttcgggttagggattagaaattagtcaaaatacatctcagattcgtgattagcgaccttttaaaccccggataaaaaattatcatggttttttatcttaaaaaaattttgcaaaacaaaagggtccccccttttgtttcaaaaagggccacttttacagtagcgccaaatcaccttttccgccgaaaatcaattatcgtaatgctcccaaaaaaaggagtataacctaattattaaaataagtataaatgaagacttacttaacattttgatgcctattgtgtaagaccatacacattaaggcagtaaggcctccgttcgtcaccacatccaaacattgtggccaattcacgtaaattagtcgaagggttggcacggtcaagctgatatgaagcgcggtaaaccccttcgaagtcttaagcaaaaaaaaaacgatgattaagtgttatagagagttgtgacggaattttacgctttatatcttttaattgagaggtactagttgggtttgtatcccccttttgggtcaaatttttcaaaagcgtaaccagacagtcagacagtgca

SEQ ID NO: 26577 - DNA, 1491 bp, Heterodera glycines
cttagagtaaaaaattgaaaattttgaaatcatgtttccttctgcgttctcccaggggtattattttgtaaaaagtcttctttttcccaataaacttttcataccccatttttcgcaccgtgaatgttatttttattgaattctgaaccggtttgagtagattagagtacaaaaaatttaaaatttcgaaatcatgtttcccactcccttctccaaggggtattattttgtaaaaagtctttttttccccaataaacttttcataccccatttttcgcaccgtgaatgttatttttattgaattctgaaccggtttgagtagcttagagtacaaaaaattgaaaatttcgaaatcatgtttcccactcccttctcccaggggtattattttgtaaaaagtcttttttttcccaataaacttttcataccccatttttcgcaccgtgaatgttatttttattgaattctgaaccggtttgagtagattagagtacaaaaaatttaaaatttcgaaatcatgtttcccactcccttctcccaggggtattattttgtaaaaagtcttttttccccaataaactttgcataccccatttttcacaccgtgaatgttatttttattgaattctgaaccggtttgaataaaattcttaaaattttttaattggttttaaatatgcgaaaactttaggcttagctttttagtgaaaattcaatcactcatagtttttcgcgttctgatcagaagtgcaccaaattttgcagggtaacagctgagaagaagaggtaattggtttaaatttccttcccattttgtggaatttgaaattttttcggtattcttattttgcgtacatttcgaatttttgaaaaaataaattcattaatattttttcagagagtgatctgaaacgcaccaaattttattttcaagttaacaaagccctctgatgcttttactatcaaaaagggcgatgaataaaaattctaaaaatttttaattggttttaaatatgcgaaaactttaggcttagctttttagtgaaaattcaatcactcatagtttttcgcgttctgatcaaaagtgcaccaaattttatttacatgttaacaaagtcctcataggcttatatttgaataagggtgaagaataaaaaatttttaaagttttttccttatattttggttatttcgttctactttcggtggggtgcttggaaaagtggaatcatgcgtacccgtcggatctgacaagttaagcaacgctggcttactagtcaaaaggatgggggccgtgatgaaacgaaaccagcactgcttaccccgcggcacccggcacggtcccccgaaggaatggatttaattgaattctctccttcggtgatttttttccattaggtcgaccgttagctttcgattggtctagtcaaatttttttattttttaaaaaaattttgttttttgaagtgttctgatgaagggcgggggggg

SEQ ID NO: 26578 - DNA, 1576 bp, Heterodera glycines
tcaatcagaaccggctaaattttcgatccatccaaccaatttgggtatttctgatcacttattctgatcaaaagtatatgttcagtcagtagcaagaaaaatgttaaaaatatatatatccccagcacgaaactttgggaaaacgcaaatggcacaattccattaattagactaatcaccaaactttgcatcccaggcaggccatcacgccataatgcatcttggcattctcctcaccacagacggcacaccgcgtttcgctgccaaagtctgaagcatttttttgtttaaaatccaatgaatgataatttcaagaatttctttaaggacaaagcgttccttgaaataaggactaaatttgctataattgggtctttccggtgatcaagcagcggtcacactctttatttggaatgtactctttaacaccatcgggggtctggtgaatgccaaggccatctctcctccatcgcggcggcgcggctccataccatcgctggttcagaaacaacattgtcgccaccggcggtggggcgagcgggcgggcgggcggtgagagtgaaccgctcgcgggcggcgacggccggtcgcgcaccgcccccggcagcccgtccgcccggcgacgacggctaccactaccatcgctctccgtttccatcgcggacggaccaccagttcagcaggagtagtagcaaaattcgccgaaatgtgtgtctgtctgtctatctcttctagcgggggggggggggggcggaggcggtggccttgttctttcgcgatcggatgcactgattagaagaagcacaatcagaccattagtattcgtaatggggtggagggggtggtaatgaaaaaagaattttatttgagactgtaatggattgagattttctgagttttcaagaaccgaaatgatggatcgagaattatttggttttaaatatttaaattgatcaattggtttttggggatgattccgagactgaaatggaatactccgagatttttttttggatttagaaaatgaattttttgggtcgggattttgacttaaatgggatacatattctttcgagaattttgaggtcccgcgcaaatgaacaatgatcgaaatcccagagagttagttaaaaaattggttttttcgttgataatttttcaaaaaaaaacaactaattttttgaaattttttattgaaattgagaatcttaattgctttcaaatgataccaaaaaaatatttatttggctgactttgacaaaagccatgccaattttttgccgaaaaacagtacgcatcggggcagtacgagttggcctagtatgaatttgggtttcgtctttagtccatattctcaagaaattatttagctaacattttgatcaaaattccaacaaaaaaatattcaagaaaaagtgaaaaattgaaaaaaaaatttgctttaactaacaggggacaaaaaatgaagattctcagcaaaattttcaatttccctagcccaaatttggcgaaagttttagtccaagatcaaaatgttaaaaaataagtctcgagagtctcgggaattatgtaattc

SEQ ID NO: 26579 - DNA, 1256 bp, Heterodera glycines
tcaaaaatttgtaaaaacaaggcgaagaccataaatttattaaaaacccattccgctgaaaaacttgaattgtaaacctaagaacttttcagaaaaccgttaaattttttcgtctacgcagctaggatgatgctcaaaaaatcaaaaataccgattgaatcggcccacttcgtcgagaatacgttcacccgcctgaaactcaattggcaacatcaaaacagaaagtgcgggacagtaaattgccgccaattgaagaatttcaatgattcgcgaggtctttcgatttgagtaaaaattctcagttcgacgagcgcaaatgttaaggatacgtaatgagtgtggcaatgcggaaaaagttaacctttccgggaatttgtccaccggaaaacgaaggaatataagttttgcatttgaaagaaacatgttcaaatttgaagagcaactccaatcctgagattaaaataaacaaataagcagtgttttaatattcgcaaatcattacaatgtctgagaaggccacacttttcaaatttggcagttgcgctgcgatggctttcactgtgtcagacgaagttcgtgtgtcatcaaaacagagatgccgcaaattagggacatatgaccacagctgatcgccaacaaaaacttttcgtgaatacatccccttcagtttcagttcgtgcaagtgtcttccgcaccgtccaattaatgaaatgtacttgccaaacttaagaaagcatgatataatcgggatctattcagtttacacgaccataaaaaaagtcacgataactttctaaaattccacgactttttgaaattttgcagttaatagaggattagagccaaaaatttatcggtacttatttagtttaggggctacttttaacatacattttcagatgcctataaatgtattcattttatataatttttaagcatggatattttaaaagactttaatattcaaaatttattaaccctttgcaaaaactagactttcatcacttattaaaacaaaaatttttttttgttaaaaatgtatattaaaagtacctcctaaactaaataagtaccaattgatctgccgattggccgatttttttagcgaaaatggtttccatatattaaaaataagagattttaaatctaaatcgataaaatttgataattgatgagatgaaaaaagattgtgagattagagatcggcctgtacctggattcgggcctgttatttttcctggatccgggtacgggta

SEQ ID NO: 26580 - DNA, 1963 bp, Heterodera glycines
atttttatataaaatattttgtgccattttcccaccaaattgcgcacccccctccccatttggtgccgcgcgcgaaaatggctttttcccaccgagacaccaccgtccccattttttgttttacaccccttcgttttgtgaaaaacctcactttatatgttttcccaagctttaaccgtttggcatttccacttatgtgcgcatgaggccctaaatttggagaaaaaaaaactaaggcattgagcagcagaaagcacagtatatgtaggggtaatatataaatttcccccaagcctattggcttaatcactcagaagccattaaaattaaacccaccggcaccactctctccaccgtaattaaatcccaacaaaatcccctccttttcgtttttatacaataattccgccttttgccgctttttgtcccaaaaactgtgctacagtatttttccgaagctggcacaactcggcatagctgctgaactgcttgcatttgtggccaagaaaccaccctccaaacaaattattcaactttttaaaacgcaccaaaagcgagtcctgcattggtcaccgaacaaatccgaaaggattatgaagcggataaacatcattctcacataaaggaaaggatgatgttccatgaagaaagggcaatgagtcggcggggtcatgacggaagtaatcatcatggatggcaacaaaagcacaactgctgtccacgacgccgccattctccagcagagaatgatgccatcatctacctccactcagaaataaagcgacaaaccggcaccgacaaaatgccaccaacagaaagaaggcaactgaagctaaagagcgcaccgggcaaaatgctgatcaaagcgttcactgccaccagcatggcatttttcgttctgtttttggtcgcccactcatttgaattggctcttgcttttgctgttgtagacaaagatgaagcacaatcaacaacaacagaagcaaaaaaccaagccacaacatttattccaaactcgaggcaggatgatttggaagcagcagatgctgctgaattgttgggtgtacttcttgaagaccatgacgaaccacaacaacaacatgaatggccatataacagcaacaacaacaacagaagaaaagtggtgtcatcatcttcctcagtgttctcttcttcatcatcatcgtcgtcgtcgtcatcttatgaggataatgatgatcatgaccataatgccgatttaaagccggcatcattgccgagaatggcacggcggataattgtgcagcaacaacagcattacggcaatcggatgccacaacaacggcatcaacgtagattccgcatagatccatcacatcccatccacattctgttcccgttgccagcaagggaggggcgcaagactcaaaaccctttcggcatcaccattctgaaggcacgaccggtggttgatgaggtcggttttattaaaaaaaaatatgagcccattgattattaaaaagaatggatttatattccaatcgtaaattaggtatctaaacagatgttaaaaagttaggtaataaaaaccgaataaagtgcccaaattggtgcgatttttaaattgatttcttattttattgatcacattaaaaaaaattttggtttaaccaattattaacaaaatttttatattcaaccaaaaataagcacaaaattaatatgttaaaatgcgaattaagttcgagaacttttttttctcatcaagaactttaaacatatgtaaatattttaaatctaaaaattccctattttaaaattaatttttatgcaaaataccactatttttacaatacatatagggcattctggaagtgtaccggcgccaactgttgcctcgaaattcattgatcacccatttttaatgactcaaaaacatcggatgcgcatggacctaatgtggccattaatatgctggtggaaa

SEQ ID NO: 26581 - DNA, 996 bp, Heterodera glycines
tcgagaaaagacatcatcaaaaaagaagatcattcttgtgctagatggatatgaatatggatttgacaaaaatgagtcgatcggatcccagtattaaattaaataatattttatttcataatgaatttgagatttggaattctatcgctgcatttttcgaggcccaactggtaaaatttattgtccagcgaggcttcatgttcgatcagattggcatcgggatgagcaaggcagatataagattgggagaaaaacaaatgcgggacattgccatgggcagacggatgaatcggcacgtttaattggaaaatataccattgaatatttctgaaataaagatcagagaagcacaaatgagacttcggcaacaagccgcttcacaaaatccattgccaacaagacaagcaattgccaatgttcgtgagaatatgccatttgaagccattattgctggaccctcttcttcgagtctggcaaggaactacagaaactatgttgtccaagaacggggcgaaaggggtgatgatcagctgatttggccgataccgcacaaattcaaattcccgaaaatcttcgggtaaactttgtctttgatggatttgtcgataatctccggatgttggtttttgctaccgaatctggaagaaaccttttggcacggtttgggcagcatgcggcaatcgatgggacttttaaggtgtcaatcctatatattaaagttgagtgcctgtgtgtatgtgtcattgtttgaatgtggcgtggcgttttgtttgaattttgcgttaaaaatgtatttgaaaaaagtagagggagggaaaggtgggaaatagtgcactgtctgactgtctgttgatgcgggcagcggcgggtgggaggggtagacagtgaacagacgcgtgctgctgtgcagcagcagtctgctggatgcgtgcatgtgtgtgggagagggagggagtgggaaaaaagtgagagtaagtggaaaagtaaaagaaataa

SEQ ID NO: 26582 - DNA, 1000 bp, Heterodera glycines
tgtcgcactgtcttgacaaaatgccatttaaatcagtagcaattctgccaattttgaattcacaaaaacacctcggatggcctgaacagtgcgtccaactgttgcctgtccatcgttggcgagccgtacagctgccgataggtgtgcttgttccaccgcatcaccacgctttttgggcgcaaaagcaatgcatttgcgaccgattggcatgcgtcccgtccgtgctttactgtgccatgaaaaatgtatacaaatttgtgtctcaatttatgtcgttaacaggaaatgtttctagtccggtctggcctcgaattttagggtcatttaccagcgtcgactcgagagaagtcctcgtgttttggactggaacttggggggttttcgtcgtcaagaaaaaacggatgaaatttggttagaaccagggcatgaaataggtaaaaataattcgcaaaactcacatttaaattgacaaatgtgcaggtattcaaaatgggaaacaagcagatgtgccatcgggtgcccattcagcgattggagccgtgccgaacactgttgacgacagcgcaacacggaggtgtaaaagccgaaaaagaaaatgccaaaaatccaaatttgtttggtttcagcttcgagtcaaaatttactggcactcacatacacttactgcatttcctttttcctacaggcgtttaccggattaaatttttgaaatgccacttaagtttcaagtgaatttgcctaaagctagaccacaattccgagaaggttttgctaaatttttggagaattaagcgttttttggaccgacttgcagtgccgtaatccgccagccagggaaaatattaacattttcgtggatttgtttataattttcagaaccctttcccaagaaactttcaaaacattttttttaacattttaagtatatttctagcgattttttaaaatttcatgatgaattgatgtttttaaaatttccaaaaaaataaaatgacttttt

SEQ ID NO: 26583 - DNA, 2312 bp, Heterodera glycines
  misc_feature (1666)..(1666): n is a, c, g, or t
cagacagtgcactatttcttcctttctctccgtggctatgcggaagaaaagaaggaaatagtgcactgtctgactgtctgcctattttcccagcgtcgctggtatgagcaaaaaaaaaaaaaaggtcgttcgggcgaaagtttttcaaaaatacacccctaagaaagaatcgggcgaagaattttcaaaaatacacccctaagaatcggacgaagaattttcaaaaatacacccctaagaattgacttttcggatcggtaccccccccccaagcccaaatcctggatacgtccctgagtacctggagtaattatggaggagaaaagaattgtaaacacctgtggaaaatgataaaaaattagggacggagaggaaaagtaaatgccaaagggaaacagcaaaaaattatagcaattttaataattaaaaacgaaaatcattcattatttttcatttgcctgtctcgatagtaacaattaaattaagaaataaaaaccggcgaagttgttcacgttaatgtccgcctcaagagtggagtacgggtgggcaaaattcatcttcagaattggcactttcgccggaatgtattcgacgtgacgcacaatgtccagggcattcaaaacacgcctcactttgcgcaaatgtttgcccgcgtaacttaaactttgagcttttttcttgaaaggaaattgagcgataacccttttgaggtgttaaagtgctcaattggacacggaattcccaggcagaggtcaatgtccgaattgtaagcaccacaaccattgactaaacggagaaggaacgaatgcattgggaaacaaaggccaacgttaccagtcgaaccaacgacgagcaaatgcgaattggggaacatctaaaagaggggcaaatggagaagaaaagaaaaggggagaaggcaccagtcggatttggttgtggagcataagacggacacgcattttcctggagaaaataaaaaaaattaaaaacgaaaatatatgaaagcagaaaagaggcaaaccatgtgaaagtgtggtcattctaaatcggaatgttattgaattaattgctctgaaaacacctggagattggtggtgaggtgtgtccaaattaatttgttgaattcgttaaattccttcgggaattgatttcggcaccccgaaatcgctttcataatgcgtctctccgcattcgagacgactccgtatttgctggtcttaaacaagcattccttacgtgctttctagttggttaaacaaccattgggcttggcatgccaatgtccctccccaatgtgtctcttttggggggccatgtggcatcaattccattgaaaagctcgcgttttacacagttttgccttccattgacaatgagctaaagaggaagaaaaaaaaaaattgagtacggcatttaaaagtcactttgtgagctgaaaccacagcggtgggggccgtctcaaacagaacgaccaaatcgttgtcggatgcccaaccgccctcatcaccattttgcgttcgttcggccgcatcccctcttttcgcgacacttttccgctcaacaggcagtgccgtctcaaggtcctcgccgtcggagacttcgccagcggctgtgccctcctccccctccaccgccttttgctgtgtctcaacaactcttttctttntcgtcatcaacttctttttccgcttcgtcttcggctttccttccggcaacgcattcgccgtgttttctcttctgcgctttcggtggacgaatgggagggctttttcacgggaaaccaaagcattcttttgattttgaggcgatgcgcaccaatcgtcgtcgccgtcgaaccactcgggaggaggcaaactggatattaaacatcattacttggatttaatgtactcaagcgaaaggtagcgggtaaattaaaactatttattttctaaaggttatttctccataatgctgattgttcaattatatgcctgaatttaaagtcactctgaaacaaacaaaaaaaagcttatttttatatttcgcagttttgagaagcaaaggatcatatagtgcctatcacaacttttttttgtgagggggagagaggtggagggcagcatactaaacgttttcccaattgacggactcacttaagggcgtaggccgtacctgacatccatgtcctcctcattgtcctctgtgtccagccagttctttcttcgtcctaacaatcgctgcttttggcgcgggtgcaatttcctcctcctcgtcgtctatttgtataaaaggtacacttgaatttgctctctttgcgacatttgccgttt

SEQ ID NO: 26584 - DNA, 1315 bp, Heterodera glycines
gaattttttgaatttttaaaaattcccggttggtcccggtcccgaaaaaaaatcgaggtcccggcaagtcccggtcccggttttgcccaaaattcccggtcccgctcaactctattaaaaatcaacagcggacgagtagaattgtaataaatgcttgactcgtatttttgcgaattcctctggcttgaaaatgtcaaaacccgtggagtagaccgattcgaagagaccttatttgttagctcaaattgtgatatttatgtcaccgaaataattttgacgcgtaactttaacatttctacgcgccagctgttgatttaaaaaaaattcaaacattggccccgaaacggaaaagtaccaattcggttacggcataaatgggaatttttcttttgttgtaaaatttatgtataccttcaaaacaatccaattttttcaaatagaattctaaggttctatttcgaattcaaattcgaacgcatttctgttgaaaaaaataaaaataatttattatctcagactattgtaagacagtcggtagtaaaattcgtttaaacttatgtttttgaaaatccttagttctgggctgtacagaattagaaaaagtaccaacgaaacgccccgtcactttttgtgaatcatcctaaaaattattagaaagtgaaaatcgccgccgccgtttatccatccgttcatttgtcgatgcattttcattctgctgaaattaccaatattttcatttattagaaatactttaacatattttaatttagtaatttttaaataattaaaaataaagtgaataaaagcataataaggaaaatgagtgctcctctgctgctggtcatttgcctttttgtgcctttcactcattgtcagttccatttggcggcgtcaaaaagtgccgaaatcgaaacggacggtgactttttttgggagaggggcgggaggggagtcgggggcgtttgggcgccggtattgggccgctcaactgaggttcaacggtagtgctgccgagtgatgagtgcgtcgtggctggtttggacatcggaatgaatgaaataatcatttgaggctcctaaaccaataacaacttaaattagccatcgtccattggttctttatcagttttctcgcctgttttatgatcggctcgggttgactttgtacggctgctaattgtgcattttgcgatgcattcggtacgttttgacgtcgatttgtgcgttcgtcgacggaatgaggcgccgatttaccgacattaggggcggcaacggacatcgaacgcaaattcagacgaaggaaaaggccacgactg

SEQ ID NO: 26585 - DNA, 1779 bp, Heterodera glycines
gtcagtgtagtgcttttcgccacttgtttttttttcgtgttggctttggtcgttggagtaatgaattaggagtcgctctgtccacttaattatttaaattagtgatgggtttgttgtagggtttattatgacttttaatttatgtttggctttttatggtgtcctttttcggtttttttaattgggtttggcgatccgtgtgtgtgtgtgtgtttgttttttttaattgggtttgtcaacccttgattttgtatgggcttggtgacccttatacttccggatgacgagcagttggggagcggcgattttgacgtggcacaggtgcagaccgaacaggcagcacagttgaacgaacaggtgcagaccaaacaggcagcacagtgaaggacaagcaagtcaaacgggcacaacaggacgaacaagcacggcaggacaaacgggcagagcggcaggcacggcaggacaaatgggcacagcggagcagacagacacaacagggcgaacgagcacagcgggacgcacggcaggacaaatgggcacagcgggaaaggcacggtcccgggtcgtggcaccaattcttgtcgtggcgacaagaaatttgcttcgaactctgcggggtgaaggggacgggaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcagaaatggaaaaatgtggcaaaatcaaaaggggtcagaacggcgaaacggcgatgggaaaaggaagggcattcgggcaacggctggtccaaaaggggccacacaatggcaaaggaaagggagggcactcgagcaggtgcggacagggagggcactcgcacagacagagagcagcgaaggccgggtgcagtgaaaggcggtgggcgggtgccgggaaacttcggagggaaccgtttgtctcgaatctgaaatttccggaaaagtccacccctttaaatacgattttttttgcaccaaagtacgctacaatttctcattttaattaaaatatgtttttgtgtgttatccgtttggatttgccatttttccattaattgtttgcttttccgttttccctttacaattccaatttctttaatatattaattattaataatttgtttacgaacaatccttaacagaattcgcaatttaatattaattaattttcgttcctttcattcctgaggaaatgcacttttccttttcaaacaattttccgttattcatttcaaaaggttttttcatttttatgtaattatattttcgatagttttttataatattatttttccaaaataaatgtaaaaatattttttattatttatgttttatttttccccattttattttctattgttttttatttttcctcttttttattttgggttttatcttaggatttcgcgttgtcgcgacactcccgcgcgaaagaggaaggcaacgacacataattctatatagaataggtagtagacatggaattaggaaaatcataatgagtatgaatatgataataataaatatggtgaaaaaattggttttaataagagtgt

SEQ ID NO: 26586 - DNA, 1493 bp, Heterodera glycines
tttgaccattccatgggcgagaatttggacatctgaacttcttgcatatttttcaagattttcccgatttttacctgctttacagtagtccgcaatgacctcacggaggtcaaagggcgtgttgcggttctcctcgtaccactgctccaacttcttgcgctcctcagggaagtgcccgccagggtagtagtcctcaagcggcggaagagtgtccagcacaacaccataatttgcagccttaattattgattatttttggttttatttattgattttttttactttgttgaacttgtgcgggaagtatttcttgttgtccactccctctatttccaagccgaacgtcttcacaaaggaagccaacttgatggggatcagtttgtaactgaaaaataatcgattattttatattattttaacacagtttacctgtcccggaagattgtcgttgtgatggctcccctcttgcgggccttcatctccagcaggtgattcccctggcgcacgagttcgggacgcacacccatgcgcagcatctcgccgtagatcagcacgtgatcgtaacgtgacccttaaaaatcgataaattttcctttttatttttgttaaaatttgtttacctgcgtgggcgtaggcatatgtggtgacggagcgtggtttctctccctcctcatcatagccaagcatgtagttgttttctgcatcgttgtcatcgctgtcgtcgtcttccgcttccatgtcgatgaaggcatttgcagcaggattccgggccttgttgttgttgtctccattcgcacgcttccgtttgcggcgcttctccgcagggtcaaggccgaggacatcagcttcaaagtgcaggagccacttggtgaaggccgtcagggggtcgtccacaacgtaggcggtctccacttcggtgttgtagaactcgaacggtgcccatgcgaaggtcctcgtcagcccacagattccacagcttcggtccagtggctggtcccagatgccctttgcaatgcattccgggcaagtgtcgtgcgcgtagcagaaattcacctgaaagaaatacctaattttagtatattgtgtgtcttatttgcctcatactcgaagcgcaggagttcagggtcgggattgaagtccgtagtgcattaaaaatggaaataaatgatacactgtaaatttttattcctcggactgtacgggaagcagcattatggtagcacttggcaaggttatcatttcttgctcagattccaacaatcattgatgaacttgcaaatatctttttccaaaagtctgtggactctttctgaaaataaattctatactcaagtattttccacttattagattttgcaggcttattgctgcatgttatttgacacttcttcaaaataacctatgccctttattcgttcaaaacagcatctttgttgtttcgctttggattgacaagacgcgatgataaatagctcgagcgcaaaacgcgtgca

SEQ ID NO: 26587 - DNA, 1596 bp, Heterodera glycines
ttttagtttaaataaatgattatcaaaattaaatggtgtcggtctccaggttttactctgcggaaatcattttggcgcttcattttctccattctcggggcatcatttaccgtgatttgaagttggataatgttctccttgacgccgaaggtcacatcaaactcactgatttcggcatgtgcaaagaaaacattggccctggcgatggcacttcaactttttgtggcactccgaattatatcgctccagaaattttgatgggcgaagagtacggttttagcgtcgatttttgggcccttggtgtgcttatgttcgaaatgatggccggaaggtcgccattccatctcccaacaacggaagaggacgaacaaactgctgaggaccttctctttgtgagtttttgctggaaagggcggggaattacgtgatgggtgttttacgttcgccccttccccatatcattttcctgaatcagtccctcgaatttctcacaatcagtaaaaaaaatttccggcgggaaacgatacgatcctgataagcaagtcaaattcttacggggattcatggcaattcgcgaaacttttgaagaaaaccgaaattttaatgaaattggatttttctgaggctcatcgacacctcaggaccccctgccttccaaaatattttgaatcacggccaaaaattactaaggaaaaaactgtcgcagaaaaaatttgttgtcctttttaaatttagctaaaattttgaccgcgatgtgggaaagtgagtcgaagtcctctccgatacagccccatagaaacattagggcaggggggaatgtaaggggattagaaacattaacatggaagggggaataattaaaaacaatttagaaaatgataatggaacatcaaattcgcattccacgccatttaagcgtgagggcagcgaatgtattgaagggatttctaaataaagtatgccaacatcgcttaagggaattgggatgttttccttttggttttcagagtccttctgagcgtttgggctgcaaaaccgacttggaggagggactggcagacattaaaatgaacagtttcttcaagtcgaacatcgactgggaattggtttgccggaaattctccttttccccaattattcaattcaatgctttgagcttgaacagcgacagatagcgcctccctataatccaaatgtgtccggagacagagacttacaacgatttgacacgagtttcaccaacggaaatccttccctaacgccgggtgagccaaaaatgagtgaattaagaatggtgaggtcgatttatctgcaccgcaaatagattaaaatttttggtttaaattttaaatgtacaatttacgaaattaaatcaactatttgattagatgaaaatttcaggtgtaatcacttattgttatttatttaattctgattataatatttcggattgaaacatacaagaagccgatttttaggataggtgaaaatttggaaaaaattcttttgagaaaatcttacctattatattaaaaaaagccaccaagaaaatttgaaaattaaaaacctcagtttttttctaaataaataaattta

SEQ ID NO: 26588 - DNA, 1030 bp, Heterodera glycines
  misc_feature (821)..(821): n is a, c, g, or t
ccccccccccccttgttcagcaggtatgcagcagaagtcacttaaataaaattaatgtgtttatccaggggaaaacagaacaccacataggaagatgaccagcaagcagttcacaattggaatgaaatgagaggggcaatgctgctatgttgccaacagtatcgtatccaggaaaaatttttggggggagggcttaatttttcaaaattttcatcgccctagtgatgaagcaggaatttgtggcggttttgttccaaaaatggcattttttttttttgccattttggggtcaaattttcaaaaatgatggtacaatgtgccgttaaggcgccatcgggaacattttttgtaaaaattttcaaataattttttttgccaatttttaaaatttttcacgggatacgggcctggtttacaatagcatagcgaagagagcaatacaacacacaaaacaatataataataattaatgaatgaatgtcccgtccatcatccagcagatacctccccattctcgcaatctccgcaggcattccaatggcatggcattttatgcgtcgttgtcccggaccaccacatttgccgatttggaaaggccggcgtcagcaaaagtgccaacaacagagtcggcatttttttccaccaccgaattagcagcagcggcagcaggacaaaactcgctccggtaccagtcgggcgcgcagttcaattgtttgaccgggaaattggtgaagagagagaaattgtcgggacagtccggatggatgaaggcaacatcgaagagacgctgtgaaatggaggaaatttaacaccaattttanagaagaattgagatggggtggtgggtgctacactacgtttcccgagtacacccccaaaatgaggcctgccaccgaatttatttcattccttgaattttctaaaacaaaaaaaatttttttgttcgaattagggctagttaactaaaaattttgcggtgacgtttcggtcggcgacgtttgttttgtccctattccctcacccggaaatt

SEQ ID NO: 26589 - DNA, 977 bp, Heterodera glycines
aaataaagggacgcgtcgatgcctttgtgggtccccgttcgtcaaatgagccaaaatcattccaattgagatcactctgcacacttatgcccaattatggatccatcccttctctcacgaataccaaagcgtacccattgcttttccttttctcacccccccccccccccccccataaagttccccaatgacgtggccaaagtgaaaagtttggcactgagtgcgactgctcgacttcgcgaggtttacggcacaaattacaaagttggcacaggagccgaccttttgtgtaagcaaaagggcacaatgcaagcgaatgatttgtttaaacagcaccagcgtccggagggtcggacgactgggccaagcagactttgggagtcaaattcgtctatttggtggaattgagaccacaactgaggggtaagttcggctgaatacttgcaaatttggctttttaaaccgccttataccaaaatgaatctgtgccgtttcagtgtccaatggattcattctacgccaggaggaactcgtgcccacggcgatcgaaactttcgaggcgatcaaagtggtcattcagggggtactcgtggagaatgtccttccatccgtccctcttccctcctttggtaaatcatttttggattcgcattttctgttgaccaatcatttccaggaatatcgatgaaaaacgccgcaaattcgcaaccaaaaagttttttaagcactgtcacagcgaaaataacaattggcacaacggaacaaatgaaaaaaggaaccacagaaggaggaggaacagcagaggaggaaggaggaaaggaagaagaagaagcacaaaaaatgcaagaaaaaggaagagaaggaaaagcaatggaagaaaaagtaaaagaagaaaaaggaagggaagaaaaagcaatggaagaaaaaggaagagaagaaaaagcaatggaagaaaaagtaaaagaagaaaaagcaat

SEQ ID NO: 26590 - DNA, 1018 bp, Heterodera glycines
ttttcagcgggtttaaaaaatctagaaaaattagtaagcatttgtagtgctccgatacgtatctctgcaaaatttggtgagccgctgatcaattacaaattatttatggacgatcaaattttttgaaatttttttaagtgcaaaagtggtgggtgtctgcaaaaaattttcaccgggtttaaaaaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcatttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaattagtaagcatttgtagtgttccgatacgtatctctgcaaaatttggtgagccgctgatcaattacaaattatttatggacgatcaaattttttgaaatttttttaagtgcaaaagtggtgggtgtctgcaaaaaattttcaccgggtttaataaatctaggaaaattagtaagcttttgtagtgctccgatacgtatctctgcaaaatttggtgagccgctgatcaattacaaattatttatggacgatcaaattttttgaaatttttttaagtgaaaaagtggtgggtgtgtgcaaaaaattttcaccgggtttaataaatctaggaaaattagtaatcttttgtagtgttccgatacgtatctctgcaaaatttggtgagcccctgatcaattacaaattatttatggacgatcaaattttttgaaattttttaagtgcaaacagtgatgggtgtcttacagcttaacaaggcccaattaagattat

SEQ ID NO: 26591 - DNA, 1336 bp, Heterodera glycines
gatcccaaaagaggcatcgatgggcacgggacgctttgaggatcggtacggtatttaaattttttgattctcaggccaaatccaattgtgccaaaataaaaaataaaaacatagcttaaaaataaataaattaattacatccatattcttcggcattcagatgaaatttgatgcataaattatacatcgagaaactgtggcacaaagtttcaaaatataaaagctacacttttggaggaaatcccacactcgcagcataattttaaattattttggcattaaaaataaattcttcgccgacggggggtgggactttatagcaattggctaattatggcattaaaataaatctcgcggccaatgggggaaaaaactttattgctaagatgcaccaaaactttgactaaattttttttcacaaaatttcatcgtttacttgacaaccgaaaagatactagtttaaatcattgtttaaaaatgattgtatatttatttgataaccgaaattggatttttttttctttttgtaaaaaagttcgctttttgtctgagtcatcgtatactgtaaaagtggttacggtttagctgtgacaatgggacacagacattgaccatgtcgctcgacaacatttctgaggcaaaccaagtgattttgctccgattgttaactgacaaaatgctgaatgatcagccgcccaataacacaattatgctgaaaattttagaaaccattaatggaaaaaaaggtaaacaaaataaaaaaaaatttgtaatttggtttatgatttttcgaattactggaaatatccgaaatccggatttttggattttgacatttttatgtcgatttcgactaaaacaatttgtctttaaattatattttttgtggcaaaagctttgaacttttttagaaaacattgtccgaaaaaataatttcaccgatcagtgatcagaaaaattatcggacccgccaaatggacagaaaaaaaatgtgccaaatttttcaaaatgccaaaaaattgatgcgagttaccaatttaataaattttaaaatttttcgtattcaaatttgaaaatttgtttagattttgaacagctgagtgctcattttttgattaccgatgaatcggtagaagtctacatgaaaaagtatcgagaataaaattaacaaattaattaaaaccaattaaaaaatttagtcaatctaaagaaaatgaaacgtttaatcacgattttgaatttccaaatcaaacttttgaatttgatctgcaaatttggatacaacagtacagctacaaattacattgcgaaagtcaagcagcgcggatattttccc

SEQ ID NO: 26592 - DNA, 1305 bp, Heterodera glycines
ccactgatgatgccaataacaacagcgacgacaccgactccaatgcggcactttgcttctccacatccgccttcgctgtacccacttcgggttacatcgcaagcaatgttcgcccgttccatcggttctccactgcctccacggatgactttgccggactcgatgatgcattttggtccacctcatacttctccactgcctccacggatggcgccgccggttacaatgatgcattttggtacgtctcgtccttctccgatgccttttcgtatggcagcgaggcaaatgttcccatctgccgctgctccaccgcaacggatgacggcgcccacttcgtttcttcccacaatggcttctccccctccgttgatttgtgctccatcctcttctgctgctgctccacgactgccacaaagccaaccaatggcagcgacaactgatgccaccacgccacaatcatcgaaggtagagcagacttctgatttagcaacaattttttgtgcaatgtttgaacctatggttgggttaaatgcgcagcgtggctgacttgtcctgtttaggctgctgagaagtccggacaagatggatgcaactccgccgccgccgctgttgatgatgatttggcatgggcacagatggaaattccgcccgagtttggactgcccaccaaattcttcagcaacaaggaattgtgggaagataacaggtgtgaggagagggagagggttggatcgctgttattttacaacattccatggcttgttttattgttaattgttccaagggttggttgctcgtcggcaggcggcagacgcggcggtggcgcgggtcgaaaaggcggcggacgcggaggccgatgagcaaattgacactcaccgattgaagcaacccaattttttgtgatggagatgatttgcgggaacttccaacaaacttttcgatgtccttgacttttgtttgtgtgtattattcgtgatattatttaaatgcgttttgtgtaattggctcttttcagattatgcattagaggacggataaattacttcagtatctctgtccatttatttaattttcttcgctaattaatccgtatttttttagcattttttgattgtttttttaattgttttcccatttttgatggcatcaaaaattgttccaattgccgtttcgccctctttcaactttttgcgtcgtccattgccttcgttggtctctcttcgttctcttttcaaatcgccattggacgcgccgttctgtggcatttacaggacaaatggcgggatttgccggacggatgacatt

SEQ ID NO: 26593 - DNA, 663 bp, Heterodera glycines
  misc_feature (60)..(60): n is a, c, g, or t
aaaaatcaatttggccgttcgttggcccttttacgtcgctccctccactcagccttctgncctttgtccttcattgcttgctgtgaattttaaggccttttgtatccaccaatcgctgctgccgtgccgttcttttgttcaaattcctagagtggagggggaaggggaaccagagggggggggggggggttaatttgcactttctcatcattttgggtcattttaaatacattccaatcgtcttagagcaattttgaattggcagccgatttttccaggaaggcaaaggaggaaaataaacgctagtcacaaaaaagagtaccccgtgacactttaaaatgttcgccttcgcacgaccgacgaagcccgactcggcgagcaaactgatcagttcattccatccgcagaacagataaagcacactgactgatgaagccaaagcacaatccacgcgatcacgagaaagacgaaaagcacgagggattcggaggacggagaggaggagggacggttgggagaagagccgacactgaaatgggaggaagaggaatggggggggggggaggtttatttcctactcacctacctttttagggcggggtttcactgttaaaaacataaaaatcttttataccgcatatttatcttaactgctcacatttt

SEQ ID NO: 26594 - DNA, 967 bp, Heterodera glycines
tagaaatttttcataaaaaattctcaaaatttcaaaaaaaaatcgctgaaaaatttttcaaaaaatttttttcatgaaattttcttactaagaaatctcctaagaattttattatgaaaaatttctatgtttgaaattttttttttaaatttttcggggggaaacgacgggggagggggggaatgaagtgcacccggatgattcaaaatttacttaatcccaaattttttgtgcctggtaaaaaccttctactttttgaagtttcattttttaactattcccattttttgcataaaacattctttattggtgggcgtttcaactgcgtctttttagataaaataatttttctattttatttttcccatttttataattttcttttttcaaccgtttttgtcagattgtcaagcgtgagttggccaaggacggtttcgacattgtcatcccgcagtgcagtccgttgagtccgggcgaactgctcggctgtactgcgcccgttctgcccaaagatgtgacggcacttgtgtaaatttaatttaaacgaattttaatttagacataaattactaaaaaataaatgcctttaattcaaaaaaccttcaattttttaatttcttaaaaaataaatttgcactttttcgggtgggcgttctgctctctgcataaaatgttcattaaatgccatttttgttttaatctttcagctatttgggcgacggtcgctttcatctcgagtcggcgatgatccaaaatccgtccgtgcccgcctaccagtacaacccgtactcgcgtgagttcacccgcgagcggtacggcactgagctgatgttggccaaccgtgacgcggcggtcgcagtgacacgcgacgcgcaatgctttggactgatccttggcacactcggacgacagggcaatgccaaaatattcaatgtgagtgagcagcagagggggagaaagagagaga

SEQ ID NO: 26595 - DNA, 1077 bp, Heterodera glycines
  misc_feature (971)..(971): n is a, c, g, or t
  misc_feature (977)..(977): n is a, c, g, or t
gtagggctgtgcgagagtctcggttctcggttcccaactcgggaaatttctcgggtttttcgtttcccggtctcggatttttagtctcggaaaccgagaaacttttacactgttaaggatgactatttcggggagtggggatcgccagcgaagggggaaaagaggaaaaattattaaattttgaacatattttttaacaatattcatgaaaatcccaaaaaaattccccgtcggcgcctaccggcaacgccggacccccattttccccaaaatgtttttggaaaaagtacacaaaaaagcgtttttaaaagcaaaaaaatgctgttactttaatgttgagactcctacgcaaaaattctggttgacctaccctctttttaatgtgtttttgattaaaaaaaatacatttgaatcaatttaatttaaatttctcggttctcgattcccgagtcgagaaatttctcgggttttttgggtctcggttctcgtatcgtttcccggggtcatttctcggtctcggtttctcggttcccggtaaaaatcacttctcgcacagccctacatgttggacctggacctggatttactgaacaaaatccaggaaaatccaggtccaggaaaaatccaggctcctcgagacctggatccaggactggacctggattttttataatttgttttaaaaagcaaaccaatgtttgaaaaaatcaattaattgcttaggaacgtcttctaatttataataataatgtttttataaccaatttatcatttttgaaaacacgaaaaataacagacatattgtatctaataatgcggtaaagtagggttaagccccgagccctcggggggcaaaaagtcgggggccggggacctcggggggcgacaaatcgggggccggggcggggaggagttaattgtcggggggtcgggaccccgatcggggaaaatgacaatttatttttaaccanaaaaancaatttttctttttaaatgctcgtaaatggtcatttttttcactttaaatcatatgattcgttagcgccaataagagtgagtccaagctggccttttatc

SEQ ID NO: 26596 - DNA, 861 bp, Heterodera glycines
tccgaaggattcggtctccccataatctgggcgcatcggtcggggggactgccccgaaacaaaaaaatcgattttttcaagtgtccgtttgggtactcaacaattatggggagcaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttaagctcttcctttcagtatccctgcaaagtttggtgccctgaaagtcagtttctgaaaaaaaagttaagcctaaactttt

SEQ ID NO: 26597 - DNA, 1394 bp, Heterodera glycines
aaaaaacctaaataaattaagaaaattcaatgctaagaaacataatttcaataattctttaattgattttattgggcaatttcgcgacatggaaaaaccttttcggcataaatttggcgtaaacccgagcaaaaggtcgttaagtgtttccttaagtgtctgctgctcttgcgaagaataagctccatgtcttcaaattgagtttgaaattcaaattccgtcccctcaattacgtcattttgccgtatccgcccttttccgcgtcgccgtactctcccggcatcgctgaagggtccgtccccacactttcgatgtacagaaacagatgctccaatttgtcggacttcaagttgcggaccagcaaatagatgaagatcacgatggggataacgtggatggtcatcaccacggtcatcgtcgacttggacagcaccgagtcgtggatttggcccgcacatggcggcttctgttcagggagctgttgtcagaaagggcttttcagcatttgacccaccacaatgtcgtcgtcgttgaagaactcgcactcgaagtactgctcgatgctgaagcgccctgctctgttcacctccagaagaacgccgagcaatttgacgagcagaaaacggacggtgtaaatggactcagtgacggtcacgtgaatggtcaatgcttgggtaatgctcaaaatcagagccaacgcgggacagagctgagaagcgcaaaaaataaggaatatatgtaataaataactcatttaaaattcaccaaataaatgatttggactcgggacggaaacctccgccgtttgtctttgacaatccaagcgaacataaacagattgattactgggaaaatcagctcaatcacttccgcaatgaataagttccataattggtcatggtactgaaaattaatggcaatttaataccaagaaaaaattattaaaaattatttccatttaaaataatttttattattccacagtaagtttttggcagctttcgccttgttaattacattgtcaattttggtgattctgtccacatttatgcccttgtattggaattgcactgtcgagtttggcattgtgatgttcatggcgtccgttttgcgcatgtaatcgtccaacatgatgtacagcttgccaaagttgtaggcaaatgaggcgaaaattattgtattggcaatttgacagattaaaatggtggcggaaaccatagccggcaaataataactccatcggacaatctgagaaggaatcagaaaaatattaaaaattctaagcaaaaccttttccttgaccctttggtcagcaattcacgaaattttgtaatgcgcctccaattgctcacggcgttggtcccgacgttgtcatttgatgagaaagacccccc

SEQ ID NO: 26598 - DNA, 1857 bp, Heterodera glycines
  misc_feature (1584)..(1584): n is a, c, g, or t
  misc_feature (1796)..(1796): n is a, c, g, or t
  misc_feature (1834)..(1834): n is a, c, g, or t
tttgatcagtttcatttccttccattttttcattttcccatttttggccaaatatttcggcaaaagttggccgaatttttccattctttatgcgcaaattattatcaactgataaagtttcgtctaatggattgattattaaaaatattagaaaatttaaattataaattttcatttcaaaaacaaaataataaattgcttttgctttttttattaatgaaatggtgacatttaaaaaatataatttaaaataatatgaaaatatgacttcgtcatattacgtggaaaatatattaaatggctgtaattatttaaaattggtaaaagattgatttacaattgtttaacatggataaagtttaaaaatgagcatcactgtagaaaatggaggaatcaacaattttcaattttatgtgcaaatttatagttttttcgctgccctaatgccaaaaaaatccggcatgtttcgaaccagcaaccgcaccaacccgtaccatggtgtgcaaaaaccaaaaaaaaaaatgcttttcaaaaggaacgaaatatttatttttcacgaaaattaaaaaccgaacgaaaagaaagaaaaacacacgaaaattttcaaacaaattttacgcataataaaatcctcaaattctgatgcaaaaattaaatttttcaaaatgttcgggtggagacttttccgcatataattaagatgaaaaatagcagttgagaagcatcgtttaacaactattggggtgatggagtcctttggataaaattttaaaataattaacaacaaatatttttaattactgagaattgttggagaataagaaaaatgtacaaaagtcttacattttttaaattttattcatattttgaataatttaaaagagcaaacgttgtgaagcgtcatttcccccaacctaattttatttttctgactgatttgtgtggattcggccctccttttatattgcctagggcacaaagtatccgatattatttgatccattagcattttatgtttgtgatgccaaaaggaatcggtgtctgtgagagaaagtgggataaatgagttcgcaatacaaattttggaaacgattgaagctggacatcaacttcgtaagctttttaatgaattattgtattttacatattcctttataaattatccctttatcatggaggcagactgttcgtcgtcaattatgatgataaggatacctaaaatagaaataattcaccaattgtatttttattctcttttcagttgcgtcacacttttttgactcaattgtgtcggaagtgcccgatgaaaggaccaagcacatccatttcgttgaagaaagccactattcggtaaaaaaccagtcgatgctttaatccttttgaattttggtcagcttgtcggatggtaaagaccgtagtgcacaaagggactacgggcacacattcgtcaattagctgagtccgactgactttgcctgtacgaagtaaatgttgctcaacaaactggatcgtggactgatcacgtggcattgagcagaagtgaaaagagaatgaagcgaaataagtgacaaggaggccattgtngggaagggtgtgattgacggttgaattacgcaattttggtgattatattcgaaaataaatattagaatggatgaattcattatactcttttagctgtaaaacggaacttgatttgttctgtcttgaaaccgacaaataaaatgttttattggaggagcaaataaataaacaatttagaataggcgcataaatattttggaggagcacaatanattttaggcgaagggaaatgagtatacaattataattngtatttgattttcataaaaaata

SEQ ID NO: 26599 - DNA, 1624 bp, Heterodera glycines
  misc_feature (122)..(122): n is a, c, g, or t
tttttttttcattaaaattcccaatttaggatccccaaatatagggtcgcaccaaatgccggaacccgctagtttgtgtgtcgggtcccgttacaaatccccaaattcgcgccatgtaaatntagaatgggaaagagaatggggaaacgagcggagagaagcgagaggaaaatggggagaaaggtgcactctctcaaataatgcctaatctcttttccatccgtaaaagcatgtgctatttcttttctctgtccgtcggctttttgttaagtctttactagtacataattgtttctctatatctctggttaaaataaatgtgagagaaaaaagaaagaatttaaagcgtaaacaaagaaaatgaaaagggcactttctctctccctttcccactgcttcattttgccaaagtgaccacaatcttttttgaggtcaatccattttttctcttttccatattacttctttgagtaattataaaatatttttagctaattttattaaatatatagcgaaaccatagaaaatgccaattaatactgccactttggccgatcggattaagctgttgttggacaacgcagctaatgacggcgatgtgcattttttggtcgggaaaggagagcaaaaagaggcgagttaatcatgagaaagcgattaaaattaactggcaaaatgtcagggtttcaaaccaaattaaagaactaaaagccgggaattaatttgtcgagattcacatacatattggctctgaaggcgctacgggaaatttttccattttacataaatttattttttaaatttatttgcttaatttcaatttgattcaggagttatatttaaaaaaaagaatatcggactctaaaaatcagattttgggtgtgtgtttgttaatagattttgacgattaaattgtcaattttgattcatgttttaaaaattttcaaagggattgagtgtcaggcggtgccaaccgacgcggcccagaaacatttgagcaatttttatcagattaggactttccaaatcttaacaaatctgataaatcagactaaaaatgactcttgatttaatgatatttaaatttttaagcttttgtccgctcacaaaatgattctgaaaactgtgtccgatgagtttaattcattgttccaatcagctgaaattgaaaatggggagatcgatggtgcaaaataaataattattgtttaaaaatgcattaatttgatttaatttactcattttcgctttgttatttgaccccgtggtggtcactgatgttgagcctgacgcgttcaaagcaatgctcaaattcatttacacggacaaattggatgagctcagtggagacacagtattcaaagtgctttatacgggtaaaataaaaatggttttaaattaatttaaattttcaatctaattttaatatttagctaaaaaatatggcatcacctcactgatcaaagcgtgcgcagaattacctttgtcagagctggacaatgtgtttgaaatgctactcaaagctcgttccattgaagaacatgtaaatgtgtcaataaaataggtggacagggggggagctatttcgcaaaattttcggcgaaaaatacaaaaagaactgatt

SEQ ID NO: 26600 - DNA, 1419 bp, Heterodera glycines
atacgtcgtgcccggctcggtcaagccgtagatccgatctagtctctcgtgtccgtaccttctcggcatggtccccctttgggcagactggctcggcgtttcgggtgggtcgtgccgggaagctctgcggcgattttatcagcggcaacaaaagctggtaatcaaattaacaatgctgcgctgttaattattactattttttattcatggttcttcagataatttcccgacaaaaaccaattttcacgtagatttccccaaataaataaattcccttcgaaaaatgccaacaccgtttttaaatgacagagcaaaagaatttgatttgatgaatttggcgggttttgttagaagataatgcgaaattgaagtgtaaaaataactgctggacattctttgatacatacaattagaacaattaaaacaaaaaggccctcgggcgaatgttccgaaaataaatgacacaaaatcagtcgaattgaatcgaaaaagtctacgaattgaacgccaatcgccaccaccagccattcgtccgtcgcttcgcttctcctcacgggttccgtcaagctgaggtagtaggttgtatagttctggaacggtatctgttggaggaaactaagcagcctgctcactcgccagacggaacccatcgcggacactcggcacggcccgcggcacagtcattccgtctcgcctttctcacgctatattatcgtcgcatttgtggaccaaaatttaaaatgattagccacaaaagataaaaaggaaaatgcttggcacttcgcggacatagtggaatgtagggctctgtgttgtgtttcacaacgtttaacgggtgtacggcttgaaacctaagatgccataaacttaaacacctaattaatcagtctctttcagttgccatcgcgttttaaccagtgctcatgtgcacgttttaattcttatgtattttgtagaaatgttctgattattgcctgaacagagggtgaaggcacgatgaccacgacaaacgatggatgaataaaattgataaccaaagtgcaataaaaactttatcttctatatatattcacgcattactgcgatgcatattgcgtatcaatattgtattatcacctgtcatcgtatattaattaatctgctgaaaaagagttgctaagcaattaattaaaaaacagtaaaataacacaatgcaactcgatttcattgaaggaaggggaagggggcaaaaacgaaaaagctaattatatggtcatcattatcaccatcccattttcattgttttcataaggacaatattgagcgtagctgtttatttgctgtttgccgctttcaactgcttcattcggttgagtgcagagccggctttgaaccactcaatttggccttcgttcagcgtgtgctgcagttggatttcgt

SEQ ID NO: 26601 - DNA, 1601 bp, Heterodera glycines
caaaagattagtccgtcggcgagtcgtgcgtcggcgagttgccatgtacccctgaaaataacgtataaataaatgagtacctattcccggtttgaccgggaagtcccggtgaactggactagtcccggtttttaaacctgagaagtcccggtttttgtcaaagttcccggtcccgctcagctctaatatataggattaaaagaaaaatcatttaacagtggtattttctccaaaaattctatcttcaggggtcttggtgctcaaagaagtgtacaaaagtatggaaaatccatatattcaaaaaaaaagtaaataaatttttgaaaacttttttagcgatttttaaaaaaatttttgagtaaatttattagttcttcgtaatattctgaaaaatcaatatgtgattttttttaatttattttttttctgaggagtaacatagtgcatcccgaaatgcggcataaatgttttctttacccacctgctggcgcaattgctgctgcttctgctgttgcttcatttggaagttttccttttttcgggcattttctttccgctgcttctcctgaaaatataacaaaaatcagacccttcttccaccggcggcaacccccgttttttaaccatcaacttcgttcttttgctatatcaccaatttgcataaacttatttttatttatttacagtatgcgccatatgtatgtatataatcaaacagtgtggctgaataaaatatagcgtaaaaacccgaaaagtttgtttatcaatagagtcgcaatttttaggtttcttctttttttactcaattgttttaaagaaaggagcttaaaaaacgcatttctgcgttgaaatttttcgatcaaacataaaattttctcgaagttggcgaaggaaaaatttttgactaatcccattggaaagagcacagatttgctaccaaattgctttttgaatgatgagtctacgatttacactctcgcagagctaaaaagggggtcaaatgaaaattcttttttctcccatatttcaagtgaaaatttttgtcatttgataattttgtaaatttaattatactaataattaatttaattgaatcaattattgtagatcaataaatattcttcataagtgaatctaataatttaaataaaatattaatatttcatcttttctttttcaagttttcataacgattgaaaaattattgaaaattattaaaattcacttatgatgagtgaaattgttcaagaataaattgtttaataaataattcatataattaaacttaaaaaaatggtcgaacgcaataaattttgccgctgaccccacgccccttgcacacgtatggttcttttgaaagctcagggataggacttaaatttttgaaaattttcttagcttcgtaatattcctaaatattaatagaaatttaaaatttttcggggggaaacgtagaggatccaaaaatgcggcataaatgctttctttacccacctgctggcgcaattgttgctgctgctgcgcttgctcctgctgctgcgcttgctcctgctgctcctgcgcttgctcctgcgcttgctcctgcgcttgctcctgcgctt

SEQ ID NO: 26602 - DNA, 1025 bp, Heterodera glycines
gacatcatatttttgtttgttttttattatcttttacattacatgtcatggaaattcgtgcatcacaccgttccatgtaataataataataatttttaagccacccaacgcgccaatgaatcagacgacagcgtggcaggtgctgtcatctccagcggcggtagcaacgtagcatacagtgtaacagaagctgcgttgctgaccaacaccaccagcaaactaatgggcacgacgtcggccgccgccgtgacatcaacgacggcgatgacagcggcgggggcaggagtggatggggctgttcaaattttgtccaccctgttcctttttgccaactacgcaatcgtgctgccaatgttcctactgtgttggatgatggttgtacactggctccgccgccccggcctcatgccctcgcctcatcagacaccgtcgacatcccaacacccccaccgccacggtggccttcacaccatatttgagaacaccgttgagcagaaggcaggacaggagaaagacgtacggcaacaacaacaacaacaaccacaacaacaacgccacacatcagctgctgctgctgctgctgctactgtcattacagaggccatggtgcgtgaggcgcaccggatgacctcccaacttgctgccgcaattccggagcctatgcgtagcgctgtgacctcctccgtggccattcctatgcttgtgtcggcacaaagtggcgctggtagaaaagaagcaacgcaacaaaacagtgaagaagaagaaaaggaacgcaattgatatagtgatggaaggaaaaactcaaatgtgtttaccaatggctcagtgaaataaatgtgtgtccgccaacggatcatttcctgtcccgtgtgactaatgcgtaaaattgaggagcgaaaaatggtgaccgcaacacggttgcccaatttattgcacgctccaaagtggtgccctatgctaaattgggaacaatgtttccaacaccatttcacaactccattcttctcaaaaaacattttattttt

SEQ ID NO: 26603 - DNA, 932 bp, Heterodera glycines
cgtttgtttatttattttattttttatttttttttctttattttaaaggaaataaattttattataaaaatttgtttcaatgtcgtgtccttccggttgcactcacaaaaattgattttttctaaatttgtttttgtttgtgaatttttcatgaagcatttattaattattttgtttttaagaaaatattagcagaaggtccgtgttgctcttcaatttttgatcaatttatattaattttttttcacctttcttctgttatgtatgaaacaattaaaaaaaattaattacgaaatttatttaattatttttatgcactttcgctgcactcacatttaatcacctgcaattatcgcgtttgtctagtgacacactaattactttgccaatagtaaatattttcagtttttaaattaattttttcgcatttttttggattgcttccaaagatgacaaatatttcacaaaatttcatcatttacattgttttttatataattattttaagaaaatttggctgggaacaataaaagtaattatttcttgaccgtaaatcattttgtttaattaagatcaataaccataaaaattgtaatcgataaattaattagaaaaaattaaacatttattgattaaccattttctagatcaaaaacttaaaataaaacttttatatcatttaaaagctcagaaagaaataactttacaattataaaaatatgatacatatattaaattgacaaaaataaattataattaaaatgtacaaaaatatgtgggcggattgcgcgcagcttcaccccaaataggaaacaaacaaacaattttatattttcacattatacatatttaattttaatatttttattttcattattttcaatcaatttattggaaacgctttattattattatgcttttgctcagtgcaa

SEQ ID NO: 26604 - DNA, 2138 bp, Heterodera glycines
catccatacccaactcatccaaacccaactcatccatacccaactcatcctatgattttgaatgaatggaaatttgagaagctgctgaaagggatgagaagtttttttaattggcttcggttgttgggggtgagtggcgcgaattggccgccaaaagaatggccatttaaaatgtgacgaattgcgaggccgacagggggtgaggggggggacacctgcacattttggggagaaatgaaaacaatgcacggatcggggaaaaggttttaacctatttttcggatagcattggtgagaccaatgtaaaaaaatattttcttcgaacattttccatttagagcgactttttacatggcaactattttcactattttggttattgtgtattgctaacaatttttgcttataatttttttaaacactttaccatgcggaacccattagttgggcccagccatgtttttggctataacttttttctttttcatccaaatccaacaatcttggcatcacacgaaaactcttcacatgctcttagccttataaaaagcaaaaagaatttttggctttgaaaaagttattaagaaaaaatttcaaaatttttggcttttttggtattttcatgccataattagcaattgtctaatcgcaaagcaatatcttagaatagcattgaaaactgttaagctttcgaatgataccaagattgttggatttttatgacaaagaaaaaagttatagctaaaaacatggtggggcccaaccgtgaggacccaactgacgtagtccgttaccgtgtggtggtcatttgtgcgtggcgagtgacctcaattgtgaagaagggcacggggcaatcgaaagtgaagcgtcattttttaacgctattgattccctaattattcactatattacccttccccttacattatttactttttattaaaatgtttttttaatttttccattcattttaattttaattttttattatatattttatttttttatttaaaataaatatacaaaatataaattaaaataattaatataaaaaatacgctgtctaacagcctccccctccccccacctattaacatttaaatatgtcatatttaatatttaaaaataaaatttcaattaaaataatactagcggggttagcgccttcggcgcatccttccaatcactgggactcaatccaccagcattccaatcgctgggactcaatccaccagcattccaatcactgggactcaatccaccagcattccaatcgctgggacacaacctaaagcattccagtcactgggactcaatccaccagcattccaatcactgggactcaatccaccagcattccaatcactgggacacaatccaccagaattccagtcactgggacacaatccaccagaattccagtcactgggactcaatccaccagaattccagtcactgggactcaatccaccagcattccaatcgccgggactccaaaagcattccagtcactgggactcaatccaccagaattccagtcactgggactcaatctccggcattacagtcactgggactcaatccaccagcattccaatcactgggacacaatccaccagaattccagtcactgggacacaatccaccagaattccagtcactgggactcaatccaccagaattccagtcactgggactcaatccaccagcattccaatcgccgggactccaaaagcattccagtcactgggactcaatccaccagaattccagtcactgggactcaatctccggcattacagtcactgggactcaatccaccagaattccagtcactgggactcaatccaccagaattccagtcactgggactcaatccaccagaattccagtcactgggactcaatctccggcattacagtcactgggactcaatccaccagaattccagtcactgggactcaatccaccagaattccagtcactgggacacaatccaccagaattccagtcactgggacacaatccaccagaattccagtcactgggactcaatccaccagaattccagtcactgggactcaatccaccagcattccaatcgccgggactccaaaagcattccagtcactgggact

SEQ ID NO: 26605 - DNA, 1875 bp, Heterodera glycines
tttcctagactgtgggaggcatgaaacgcacgaaaaacatgtttttagcttggtttgaagcttctaggatgactttccatatgcatattttgcatatttcgcgatttatgtgcatatttgcatattttggcatttcgtgcatattttggcgtttttccaaaaaacctctaatagatcggcccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaattttgcttttcaggttgatttttcgctaaaatgagtaaattttaagctgtatcgtgtttttttctcctaaaatgatttttaataccacatttagccatttttgaagattttactttatgtttaacaaatttgaagaaattttgagaaattacaccctcaattggaaaattttatgtgcatatttttcacatttttggtgcatattttatgcgcatattttgcgattttatgtgcatatttttgccaaccctatttataaataatattgagatttgtgccaaaatgttttgctaatattttttgacatttttctcttcttccttctaatttttcttataatttcttttttaatttgccatatatttcatcaaattgctttattttttatatttttgctcatccgaataactgtttttagttataagtccaaattcacttttccatttgtaaaccaggcccctgcgggccctgtgaaagcgccgggggcgctttcaacgctggctctagtgggagatataatttggggcgtgcaaaaagcatctattggccgctaagcgatccgcatagtttaggaatatgagaatttggaaatgaacaaataattaatttaaaaacgatattgttttaaatataatttacctaaatgcgatatttttatttatatgcttgtgatttttataagattttttgttaaatgttataattctaaaataaataattttcgagttgtcgctctttctgttcctcttcctgttcccctttctgttcctcttccactttatcttccactttctgttcctcttccactttatctttcactttctgttcctcttccactttctcttccactttctgttcctcttccattttctctttcactttctgtttctcttccactttctcttccactttctgttcctcttccactttctcttccactttctgttcctcttccactttctcttccactttctgttcctcttccacttttcactttctgttcctcttccactttccttcctcttcttctttttcttcctctttctcgttctcttcctatttctcgttctcttcctctttccttcctcttccactttctgttcctcttccactttatcttccactttccgttcctcttccactttatcttcctctttctgttcctcttccacgttctcttcctctttccttcctcttccactttatcttccattttccgttcctcttccactttatcttcctctttttcttcctctttctcgttctcttcctatttctcgttctcttcctctttccttcctcttccactttctattcctcttccactttatcttccactttccgttcctcttccactttatcttccactttccgttcctcttccactttatcttcctctttctgtttctcttccactttctcttccactttctgttcctcttccactttctcttccactttctgttcctctttctgttcctcttccacttttcactttctgttcctcttccactttccttcctcttcttctttatcttcctctttctcttcc

SEQ ID NO: 26606 - DNA, 1494 bp, Heterodera glycines
cgttttcgcgtgcttccttgtcgcgtggccattttcgcgtggccgtcgcgtggccgttttcgcgtggttgcatataaaagagaattcataactcacatttatttaacgaaaatttgtttcactcttttttctaacgaatatttattttataattaagtgagtttataaacttaattaaggctgtttcaattatataatatggaccagcagcaaaaaattaaaacaaaacgaaacaaagttaagttagaacatgacggcgcactctatgttttcgaccaattgagcgctggttgggtatttccaatttgctactgtcttttaacatcgaagtgtgccgcaatttatacgcgcatgttacagcttcttttggaacgatggccgaatttcgcgccgcagacaatttcgatggacttcgagttggcaatggtcggtgcggtccgcacagtgcttccggcatgcagtgtccgctactgtttttttcatcttgtccgcaacatgaaaagacagatcagaatccttggcctcacacatgtcaattgaatttttcagatgataaatttttttcttagtagtttaggcttacaacactgatcctgctttcgccgagaagtctaagatgatcacttcattggcctttctgcctgtgcaccaccttcaaaatggccttaatgttcttcatggacaaattccaccacaacttaacggcgttttcaattggttaagtccgaaggcgaattttattatttttttatttttctaggtttttggacaactacattggccgaatgcgtttcaatgttccaatgacggcgcctctgttccacccgcacgaatggaatgttcatcagcgcaccttagatgatgctgatcgtaccaacaagttcgccgaggcattccatcgcaaacttcagcggcaatttatctgcactcatccaacaatttggcgcttcattgacacgatcagatgtgagcaaaaggcaattgacgcggacatttcacgttgtgtcatgggagaatccgctccacaaaagaaaaagaagtatcgcgaagccgacgcacggattctccgactcgtccaccgttataacgacatcaataacaatcacctcccccaaaatgatcacaattatgcaaatgtcaatgtgaatccgaaaacgttaacaattttctcactggtgtttcccgaaactatgaaatgcgaccttagtttgttctgaaatttgttattttttgttatactatttatgtgtttttataaattaattattttttccgtttgacgcacacccgaccaaactgacaaattattgtagaagatactagccgcaagaaataaaaaattaaaaagttaagaaatttgtccgaattcgggttcgggattcgaaacatggatgttttgcacaaatccgaccaatttcagtcctaaataggtactcacgctaaaacgtccccacgcgaaaacggccacgcgaaaacgaccctgaccgatttttt

SEQ ID NO: 26607 - DNA, 1580 bp, Heterodera glycines
acctaaatagaaaaatggcagattaaaattgtatgcatttcaaatcaatccaccaaagtgatcagcgggacattggtggaatctgcgcggaaattggtgcaatgccagtaggacgtccagtggagcagcaaaacagatgaaaccagggcaggacagcaccagagcacagcacaaaaagtggtccgttcgtagtcgatgctctgaaagtatgcgaaatagtgatcaaggtgctaatttcttttttaaacacacctcatatccccaagagcgcggttggtccaaaacgtgcatggcaatgacaaacagagacagcaatccgcagagcaattgaatggcaaacaaatcagcgaccttctgcagatgacttttgttgtcgcgaacccagggcttgacgagagaaaactaaaaaaataatgggattagtgtcatatgtattgagagatcattgaccgcaatcggaatacagtgacggccaacagtcggcaattttgacgaaaactcgtccatgtgattctgttgctgttcatcaattggttggccactgccgctgctcgccatgagttgcatgtgccacttctgcttgtcgggcatggccccgtattcgccagtggtggagtccattccgatgagcgtgaactgttcgcaatggctggaggagactgcagagttgaagaaggcctgaaaagaatggaactttaattaggttgacaatcaaatgcgaaagacacccttaggctcgtcaaactcgccacagaattggtgcgttgagagaatttgccacagaaaaacagaagtgagcacggcttggcacagtttgaagtaggcgaacttcctcatggtgcgtgacgattaccgatgaagcagaacgatgctgcggctgtgacgtgtgattggaaaataagaatactgctgggagaatggacattctccgttatttttctccttttatagcaaaaataaatgtttccgccggaaattcttctgtgtttcactaacaaataagaaacaacggattgattataaatacacaaagtttttgttacatattctttcattaatgggatttgatttcaagtgacattttgcctataatttcttaacagtaaagaaagcagagaggcgctatttttagattccgcattatgaataagttggcgaattaaaatgaaagttcatacataatcgtttaaaattgaaaggcatcaatcttgctgcaataaaagatcaattaggtgaattatttttaggtgaaaaattcgaaaatttaaatattcaacttttcatttgaatcgggttcgggattcggaattggggtacaattggcaatattacgcaattttattttcttaaaatttatcaattgatcttataattttgggtcttttggggaagtatgcttggtaaaaattttctaatattagttaccttataatttctgaacagactgagctccattctttattttattagggtattggagtccgtcatttttatttgtttgttatttatttgctgacatggctcaattagctgttgcagctcctctgccgccaacgacaaatgcaacagcggccactgct

SEQ ID NO: 26608 - DNA, 1485 bp, Heterodera glycines
  misc_feature (27)..(27): n is a, c, g, or t
  misc_feature (42)..(43): n is a, c, g, or t
  misc_feature (49)..(49): n is a, c, g, or t
ctgtccgtgggtgggtgtaccttgatntttggaccaaacttnnggacanccgcacccactcagtcccgtttcacgcgccagctgctctctaaccttcaaatgaactcatttatcaaatgagtcacttctctgtctgttacttttctgctcggttttggccctttatcgaacgctattttgaacgcctttctctgtggggcgttcagaatcgttcgtggcctttttggcattttctttgaccgatcgttgtggtgaaaaattgggcgttggagtgaagagaaattcatatcagggaacgttgaaatgtggtggaaacgagacggatctgaagtgatggggaagggcagttcccccaattttgccattttaattttcccattttaagatgtgttttctcccttcaaatagcactgtttttgggcgttccattggttttattcaccaattcggtcgtcgctttctcttcccacccattgcccaatgtgaacacgtggccggactcaaaatggacaaaatgcttcagctccaatgccgattttgttttttcactcgccgaaatggtcgttggatagtcgaatgcaccaaatttggaaggcacaggcaatgccaaccaaattaacaccgactgactttccctttaccattttaggacaattttacgcgatttcaacgccgatctctattggtgatgtgagaggaaagactaaaaattattttcgaatgtggtcgaatttacaaataaaatttgttgtagaaacaaaccgaaagaaaaacgatcgaattgtatgaaaatttttctattttatttcaaatttgttggaattttgaccaaacctttgcgtcacggtaaaaaataatggtgcccataaaaatgctgtgagacgtataaaatagattgggtggggtgtctttggagagtgtttgagtttgtgttcctcctcctacccggtgctgctggtgtctctctctgatgaatgcgtttcgtcccaatgtcccccgtccgcaattggtgctgcaattgcattaagttgaggtcgcgttgacagatgagtgctccccccgtgttggtgtattggtcgccttttgcaagtgcatttccgcagcacgaacatttgaagcagtgcgtgtggaacacgttgaacagtccgctgcggaagacgagttcggccggttcgattggaatggcacagcgggcgcagttaggctggcacgacgaagtgccgaaagatctgtcgggggcggactttggtaattatttgtcgaaaatccgtccgtccgctgggcgtgcaaatgagcaaatattgcagaagaatgccccctcctcaaatgcttattctgttttactatcaacgaattcatttgtttgttaagcattgccaatttccttttcctttacgatgccccgggcaataaaaagtaatttttcttctcgaagcattatgagagggatccttcaacggtcagtgagtgacggattgatgataa

SEQ ID NO: 26609 - DNA, 1725 bp, Heterodera glycines
tagtcgagtgtgcggcggttttttagcgcaataagctaaattcaaaatttatatttgacgttcttttcccatttttctgactactggtttaaaaatagttaacgattttgaaaacccataacatgcgtcggttcgacttcaggataagtcaggagattccatccctttttctccttttctttctctttatctctgactgcccgatttcgcttttcttttaaaaaatcaccaacatttttaatgtttggacattttcatatcaattcattagaatcttgactttttgttttttttcaaaaagacattcgacagaaatttgggaagtgtgccgggcccgaaaaaaagaaaatcccaaaatatgaatacttccggtacggacggaattttgggtttagttagccctccatatttattacgctaattctcttttgctgtttcccttctcccctcttcgttatttttgtcccctttcttccatgtctaatggaaagttgtcgaaaatgaagaaaagttctaaggagtggcaggtggtcggtcctttgtagagcccggagcaggaccggatcctgcgcaggattttgcaggatcccagtccgcaatcctgcattttttggaaaatgcaggatttgcaggattgcaggatttggtaatactgacttttactggtcccataaaaaaaggaaataaaaagacggccttttacgattattcgttctattcgagggttatcgaggccgctgatcacgaatatgatatcataattgtcatatgacatcatctaatctttgattttcttcaagtatttttttcattttttagaattatagtcataaaatattttacggggttatcggggtcgctaatcacgaatatatcatccatttcgactaatttctaaaccaggacccgaattcgaacaaaaaacgaaagttcacatgttaaacgaatttcgaaatttccgtattaaaaatgcttttatgatttttattgcaggaatgatggctttcggtttgtttttaacccattttcttaaacattgatcaaatttcgaaatttgatttttctgttagaattcgggtccataactccgggtcccgacccgttcccgtgcaactctacttctattttattgtagaaatttcttatcgatcaaatcaacagaaaatgagtgagtgattggatgagagcgcttatccatcggtcaatttgcgctttgtccctttttcttcttccacaataaaatccatggacaatctcactatgtccgcttcactgtcataaaatcctttggtcggatccatcaattccttaatttttgcaattttattaagcacaaaaagctattttgactgtcactcactgtaaaagtaatcattataagtccccagcaagtcgatttgttgttaaaagaatggtcaaattttttagtaaaatcctccgttcctttcttttgtgaaacaattcgaaaagtggcagaacatttgcagctccaatctccatcttaattaaataaaaaatatttgatttagcattttataatttactttcttttggagcggtacagaaaagaaaaaagcccagccatttctccgtgctgtctttcttcgtatttatttgtgcccaaattttccacggcaatccttttaggtaaatgcatttgcttaatcgcctgctgtccactccttaacggacaaattccgacaatttctcaatgtccatcgaaag

SEQ ID NO: 26610 - DNA, 2147 bp, Heterodera glycines
  misc_feature (33)..(33): n is a, c, g, or t
  misc_feature (62)..(62): n is a, c, g, or t
  misc_feature (131)..(132): n is a, c, g, or t
  misc_feature (134)..(134): n is a, c, g, or t
  misc_feature (190)..(190): n is a, c, g, or t
cattaatgtatcatttcggatcttctagcactnaatattaattagcaaacaaaaaattatanaatgaatcacttaactgatttgactgggatcgggaatttgtccattatttcagttttggctggctgtcnntnttctgtcgacgtcgttctgcccttgccagtgatgggtagcattgtgagcacgctgnagataaaattttaaaaaacaattaaattaaaattgagtattttggtaaaataatataataaataatatttattaggactgccaaaaatatgtataaaaagggttcaaaatttggtaccaattttgaagaatatctatcataaaatatagagatatgtaatatcatagctcattttcaccttcgaaaaattcgtcaaccatttcctgcgcatcttcctttgtgtacaatatgtcatcagcttccaatgggtcgccctttcttttgctgatgtccgctattgattctgatttaaaaagcaattttcaccatggagtgtgactgagaacacttaccctgaaaattaaaattttcatatttttaatctgattgagattaaataattaagtaaaaacacactaatggaacgcgaggggaacgacgcccgcatgtacatgggtaaggttttttggcgggtgaacagcactcaagaagttgttcagccttgagtaacaattcccgggttgcttggcaatcctcacccaacacatcgcagcgggatggtgaggtctaaatgcaaaagcacattggacctgcaaaaaaagcccattgcccagcttaatgaaaaggaaaataaataaattccgaaatattatcttggtatgtcgtttttatacaggggtgcgatctgttcttatttataagaaatgttctgatttggagggagtgacccaaatttgttctgatttcttaaataaactcatatttttgaaattttgtggcataatgtcactattttatcaagaaaatataagatttgcggcaaaatttggtcattttttgacaaaaatctattacaaatcgctttaaaaagcgcaaaaattttcccggcggcgcctatcggcaccgccggacccccccccccccccgtccatcccccaaaattttttgaaaaaatgtgcggcaaaaaaaagcgttgttaaacgcaaggaaaagtcgttgcttggcttttaattgcaatttggccttttttgatgaaaatctgttaacaaatcagaacgaaattacataaaatttaccggcggcgcctatcggcaccgccggaccctcccccctcgcccatttcccaaaagttttttggaaaaatgcgccgcaaaaaattcttaaaaatctgattttttgatcccgagtgcactgaaatttacgatttgttaatttcctcaccaaaatttttaaagatgatcatgggaggtgaaaaatataatatttaatacatttttgatcgaataaattgtaaaaataaaagatttgaagcaattttgcaaaatgttctgattttcgaccccaaaatctgattttttggacccgatgttctgattttgaaaatttttcgatccgaaccctggtatagaattggtagaccaaaaatatatatcaaaaaaagatacaaaatattaaggaacatttatgagaaattttacaagactcagaggtggatatatcgaaattgatttttgacgtataaaaagacgagtctgaatttgactataaaaagcttcatcgaagagctgctactgataaaaatatgacgcacaactgtctaaaattttcgaattttgaaaccgtttacagtttatgacaaagttttagttcagcactttggtcaaataaaaatagcggattgagatgatccaccatatcaatttgcaatttatttaaacaaatcataaaataatcgatatgctctgggaatactccgacttatagtatcatcgtaaggacctgtttaatatattttcttactgggaacataaatttcgattgtacaaaaactcaaatggataaaatttagaataaatgttgtataatcgtattaaatacaaccctaaaaatgaagaatttttctcaaaaattgattggccagctttcatttttttcaaaagttatggattcttaaacttgcctgggaagggagttggca

SEQ ID NO: 26611 - DNA, 1443 bp, Heterodera glycines
  misc_feature (1429)..(1429): n is a, c, g, or t
aaaatttttatcgtctccctaacttcttcctacccagagtcaaataggttgagaatatgatgatagatttcccctttaacagaattgtttttagtatccctggtaattacgactgttaccgtgtccagaaaattaacgctgtcatgcttgtaccccgcttgaaatttaaaccgcaaaatatttctggttcataaaatgcacgacgattttttcgaaactcgttcaattcaatttcacgtccgaatttaaaggtcgaaacaatattttcaaccgtgtgtccggtgtaagaagccccggacaccccgagcccttaattatttctataaattttttaatagcattttcacagtctatcagacttttcgtccccagacatatcattttcccggattcccataataatgccgtggatttgatgggagctgtgcatttgataactgcggcattgaattttctagggttatacttaaattcgcattcggtgatcgtcagagagtttagtttaattccggtaccgatattagcgagagcaattatatttacgattatcggtttttgcatttttgatacaatgtaccaatcaaatggtcctttcactccctttatataccccttctataaatagcaaccaaaaataaaattaaattgaaaaaaatgaactgtccacataaaattaagtgttgtcattactgcccctgtcattacgagatgtgtaacagatgtaaaaaacacagtcttttgcatttcggtacatcattttttgataatttctggctatgccccaaatgcgcgaaacatgttccctatgaaaatataaataggtcaaataaataagatgcattaaaaatgtttcgcggtccgttcactctaattctctcgggggctactgggagtggtaagacccgttggctattacggtttttaaaacatcataagaatctaattgaaccatcgcctgaaaaaattctttattgttatggtgagatgaatgatagtattttaggattaatcggggagggcgttgagacttttaacgggattccggacatgaataagattaaagaacaggaaaaaccccttttgttaatacttgacgatttaatgcttaatatgcagaatactttcctcgatctactctttaccaggggctcccataattggaacgtaagcgtaatttttgtaacccagagtctctatggtcgggacattaaaacggcaagagcgaacgcccattatctggttttaatgcgtaacccctccggacaattacaagtgaggacactggggtcacaactgttcccaaaaagactaaattatttcatggatgcatatcatgatgcgaccaataatcaatttagttatagcatgattaacatgcacccaaattctgaggaggacttgggagatgtagcaaaatttttccagatgnagactctggaaatt

SEQ ID NO: 26612 - DNA, 1441 bp, Heterodera glycines
aaaaaatattcttttttttttgtcgaaaaaccgtttaaattcctgccttttctccccggcactgaaaattttgaaaaataacatcgtagaattcggatcatccctcctaaattcgtgatcaacgaccccaaacattgaaaatgtgccaagtaaagcagcaacaattttcgtacttgaatgatagctgccaaataggacggaagtgaccaaccctcgggcagtcggccggtatacagtgacaattccacccaaattgcgttgatggtcagccaagtgctaaattgcggaaacacaaattttttgcggcatttttcagtgtcgtaataatttaattttggggctattcaaaaaaattttttgaaaaaattgaacattggcaaaagttggtgcaaaatttacggcaatggtatcataaaagaaagtaataaaaatgttatggccgggggatggtacgttgattggacgcgtaaaagtcatttgaaccaaactaaaccaccttgaaccgaacatgcagacgcagaaataatttttgatgccagccattccttaatttaacgataaaaaatgccaattatgtaaaaaaacaaacaaaaaatgcacttaaaattgaggaatttccaaaaattttatttataaatttggtgccatcaatttttttttgttgcgcttttattcgaattttaatcatttgagaagaattggagtgccgaaaaagaatggcacacaatttgctttttctgattttggagtagcgaccaaatttacgctcagataagcacgaaaaacggtaattttggtaaagaaaaaaaaagaaaaattaacagaaaaattttgagcaagtcgccaaaaatgttatcgcgtcaataaatatttttattttgaaaattttgccaaaatgttatcgtgtcaaaaatagtttattgcgtttttgttaacgaaattctggattttttacgtgaagaaaattttttattttatttatttatttatcgataaagaaaaaattgccatcagaagggcggagaccacttactctgatgactgatcacagtaaaatagtcacagagtaagtgaataaatatcaagtgagatcacaggttaaaaataaacaataacgaaaaatttatatgaaaataaaatcgaggtcaaagtcaataaaatgcctcaaaagttaataattgctttatacattggcgctttcagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaatgacttgtttcgagtatttaagttcggtcggggtcgttttcgcgtggaaaagtcgcttggccgttttcgcgtggggacgttttcgcgtgg

SEQ ID NO: 26613 - DNA, 665 bp, Heterodera glycines
ttgagtgccagtgattgtaatgctcgtgggttgagtaccagtgattgaatgttggtgggttgagtgccagtgattgaaatgttggtgggttgagtccagtgattgaaatgttggtgggttgagtgccagtgattgaaatgttggtgggttgagtcccagtgattgaaatgctcttgggttgagtccagtgattgaaatgttggtgggttgagtgccagtgattgaaatgttggtgggttgagtccagtgattgaaatgttggtgggttgagtcccagtgattgaaatgttggtgggttgagtcccagtgattgaaatgttggtgggttgagtgccagtgattgaaatgttggtgggttgagtccagtgattggaatgctggtgggttgagtcccagtgattgaaatgttggtgggttgagtcccagtgattgaaatgttggtgggttgagtccagtgattgaaatgttcttgggttgagtcccagtgattgaaatgttggtgggttgagtccagtgattgaaatgctcttgggttgagtgcccagtgattgaaatgttggtgggttgagtcccagtgattgaaatgttggtgggttgagtgccagtgattgaaatgttggtgggttgagtgccatagattgaaaatgatggtggattgagtacca

SEQ ID NO: 26614 - DNA, 2188 bp, Heterodera glycines
  misc_feature (39)..(39): n is a, c, g, or t
  misc_feature (77)..(77): n is a, c, g, or t
  misc_feature (2181)..(2181): n is a, c, g, or t
aatttctcatctttcaaacatgaaaaagaatcgttgcancggcttttgcccgaaattgacgtgtcgtccttgtttgnccaatttcaccgcttttctcagcgaagacggaagtgccacgacggaggagtaagtgaagaattaagaatcaaaaagcagcaaattttaattattgtttatgttactattatttgtaaggttcagacagggcctgggatccggcaaaacgcattggttttcatactggaaactctggccgagtttcatttatgggaaatacataattcctttgcatttttatacattcaactaatcaaaccatttgtattttaattattattgtgttctaattcgtggtatatttgagagataacaataaattgaatcgtccgaaatttttttgaaatttgcccggtccctgagcatgggtttacccctttgttttcataatttaacctctaaaaataattgtttttttctttccatcgtcagatgtcttccgcgaatgctcccatgcgaccatttaagcaggttttgaactcaaaataaaaggaaaaacagaaaatgggggcaattgaaacattaagatttcgttcattctccggatggtgcaacaatctcaagtaataagcaaattattaccaaatttgctaattatacaaataatttagacacccattttatggcaattcgttcactcccttgcgccatttgttgccgccggtttatgacgacggtgaaacatttaaaatcatattaaaagactaagtagggtaatttgtgacacaatttttaactccatggctaatgaatactgattgttttaattatactaattgaattaattacttttcaggttttgatgcaccgcggaatcgtgccaaaagtggtcagtctcaatttattgggatggagttacgccattcttttatcattggggaataaccaacaaatgtgatcattgatttgaacaaagcaaaaaattaataataatcagttggatgatcaatcatcgggagtctcgagatcaaacaattcttagtataaacaatgattttgattagttatcagtgggggggggcatatttaaattttaaaaaaacgacgaaaaatgtgtatcattttagccaaaaagttgctacgtttttcaggcgttccgttgccctccccccggcgcatttccaacgcggtgcacgtcgaccgcgacttcagccatgccaagttcacacacatggtcatgcagttcggccaactgttggaccacgaactgacccactcgcccatccaccggggaccaaacgacgaaattctgaactgcacgcggtgcgactcgcacgagacaatttcagtgcattgcatgccgatcagagtggagcgcggcgatccggtacggtgcgggggatttgataatttgatttattgaaatttacaaaaaaaaataatcagaattcttattgatgtaaaaaattcgatctaacaaaacttcaacaataatttgactgaatttgatattgcatattctctaattggattaatagcttcaataaagtccattataattagggattggatttttatgttttccctctttttttcttgtaaaaatgttcttttggggcttttcaggatcttattgttagcagttcttttgaacttttccaatattttaagtataaaaatgcaatccatcgttataattatcccatttttcggtatttttatacaaaattcaaaatcattgaaaatttaaaaacctattattgttaaagatcattttccattccctgcagcactttcccacccatttgccaaatggggagccgcgctgtttgcccttcgcgcgctcattgcttggccaactgacgctgggctatcgcaatcagatgaaccaaatcacagcttttattgatggttccgtggtcagcaaatttttttaatgggacccgaaattatacgttaattaaatgttcattttctttcattatttaaattgaccctttcagctgtacggctctacccaatgcgaggccaatcagttgcgtctgttccgccaggggctgctgaacttcaccgaccttggcaattggaatccgatggcattgccccagggcaaccaggagaaggattgccggtgggcatttatgagaaattcagagccattaattaattaaataattagccaantaaataa

SEQ ID NO: 26615 - DNA, 1257 bp, Heterodera glycines
agaattttattttataattcacaaacctatccatgttcctttcggaaatttttttttattaaattcgcaataaatgaaaaattatggaattgtgttggtaaaactgtagtggaagaattgaaataacaatgtcatttttaggtaaaagaataatttgaaatgacaatggcatttttttttggcaaaagaacagtcttgaaatgacaaaatggcatagtgttgtcgaaaagatttagatgacaaaaagaccgacaaaaaatggaaaatgacggggcattgtcaaatgaaattgaaatcaattttttttttttgctcaatttaaatttaaacataaaaacaatacgatagtttgactaaaatattcaaatatatttaagtaaattgattccattggcaaaatttgaaaggacaattgcaaaccgataatatggaagaagatttgaaatgaaatggcattttttgttggaagagtttgaaatgacaaattggcattgtgttggagcaactgtagggaaaacaaatagcaaggcatcgtatttgaaaaggcaatggcatcgtatttgaaaaggcaatggcaccgtatttgaaaaggcaatggcatcgtattgaaaaggcaatggcaccgtatttgaaaaggcaatggcaccgtatttgaaaaggcaatggcatcgtattgaaaaggcaatggcaccgtatttgaaaaggcaatggcaccgtatttgaaaaggcaatggcatcgtatttgaaaaggcaatggcatcgtattgaaaaggcaatggcaccgtatttgaaaaggcaatggcaccgtatttgaaaaggcaatggcatcgtatttgaaaaggcaatggcaccgtatttgaaaaggcaatggcatcgtattgaaaaggcaatggcaccgtatttgaaaaggcaatggcatcgtattgaaaaggcaatggcaccgtatttgaaaaggcaatggcaccgtatttgaaaaggcaatggcatcgtattgaaaaggcaatggcaccgtatttgaaaaggcaatggcaccgtatttgaaaaggcaatggcaccgtatttgaaaaggcaatggcatcgtattgaaaaggcaatggcaccgtatttgaaaaggcaatggcaccgtatttgaaaaggcaatggcatcgtatttgaaaaggcaatggcaccgtatttgaaaaggcaatggcatcgtattgaaaaggcaatggcaccgtatttgaaaaggcaatggcaccgtatttgaaaaggcaatgg

SEQ ID NO: 26616 - DNA, 1667 bp, Heterodera glycines
aaaaaatttattttgctgttgttatttgttttttaccttgtacttgttgaagctgttccaaaattggatttcctggagcagttccaatgacgggttgttcgcaataatgcctgacaaaaatgagtgagggttatggacagaaaaaacacatattctaatgggatggaattttcgaaaaaccgcttttttcttgtcaccaaatgcattttgattgcacaccgattaatacaacaacaacaacaatcaaagcaccactgttcacccacctccatcaatgtatttgttgtccacactggcaaagtaggtaggggcttaaaatttttttgtaacttaaaaaaaaaattttttttttacccgccgatgaacgccttaacactttccacagcaacaaatcgtcgggcgtccggtagccgagctcctcattctcctcgtcatttgtcggtagtttgtagttgcgcatcagctccagctgaaccgggaagaactcggcccgcgtggtggtgaacataagtctggaaattttttttttaaatgaggaaataatttcaattttcaaattttatcttcccatataaatatttttcggcaacgtccccgaaatttaaaaaaaaagaagatattttcaagaaattttacaaaaaatttttttgctttcaacgacacatatttttcaaaaaaaaaattccaaggatttttttccgagatttttttcggcgatgctatgtccctgacacattttgggaacaccgaagcaaccttggccatttgaggtcgctgaacattgtctcggcccccatctcctggcgaatgaacttctcgagcacctgcgtgttgtgcggcctacggttgtcgaacaccatgtctttgaagcgcaagtacagctgcaaaagcatgcacacaaaaatcagtaaaataaaaaaaaattatctaaatttttttgagtttttttaattccaaaactttatacttttcagcgtaaaaaatactaataagaagtgtttaaaaaaccaaaaaaaaaaaaaaaaaaatttttttcatgtaagatggacagacaaaattctctgcttggataaataaatttagattatgttgaattgtcaatgcgataaaaatggaaataataaaaaataaataaaataaaacccgctgaatttggtgcagtgtttggcccattgcgagcccggcagagaccatggcaccggtggaagtgccgccaacccaatcaaagtaggggaaaatcggctcgcccataatgcgctcaacacagatcagaagctgaaaatatggcggaattagcattaccgatttgaatggcgtggttttgtgagaacatttttaattatatgaagaaggaccgtaggcagagtcccaaaaactcaaaaaaaaatttctttttttccccctaatcgttctaacaatcgtgtcccgacatttgcgcctttgtcaaaatcgggttcaaccctacatttttcaatccctgatcgggagcagcccccaaaatgggggacccccttcgcatcgaggtggggccggcgtaagaggtggaggggggggggggtcgtagtgaaggggaaatgaaggaaatttctgaaacccccggccccccttttcgcaaaattttcttgaaaaaagcgcgccgcaaaaaaagtgctttgaaaagcaaaaaa

SEQ ID NO: 26617 - DNA, 1379 bp, Heterodera glycines
gaaatgtttttgatttgggttgtatgggcttaaaataataaagaatgagatttttggaaattttattcaaaaccccatttttttttcaattttaacacattttttaccacatttttggcatttttggggtttttacacattatttcagcattttttagcacattttttattacatatttcagaatttttagcacataataatccggcccctatgatttatctccgaaacgaagttagttgtggtaaagaatttatacaattaaaaaataaaaaagcattgaagattttgtataaaaataaaaagatgaaaaatttttttttcaagatgaaacagaatgccaaaataatcaagaaatgaaaatatacataaacccaaagaaaaactgaaaaatccgttaaaattatacagcaaattatgatttctacaaacgatgacactgattcaagttggatagccattgacaacggtatgtacctgagtattttccttctgaaattgttttctctgcaccttcacattggccttgcgttctataagccttacaaaatttttgccaatctttgcttgtaactaaaatttaaaattgaaaagaacaaaaaaaattgaatgttaaaaatatatttaaaaagtaaaaaaatcgagttgggtaatatttttgagtttagtttaatatccatttctagatcttcaatttttttacagtcacagtgctcctttatttttgtcttaacataaaatatttaaaaaatgattcggaattcaaaatttacgcgtttaaaatattttggatgaaaaaaattttgccagaaagaaaaccctgaaaatatttgctattaattagaataatttatttcttaattaatctgcgggaagtgctaaagaaaaaataattcaaattcacatttgttcgttttaaataaagaagtaattcctctcaatccgtgcgacacaaatttgtttgatttggtcaaacgcaggaattctccgcccaaaatagatcggttgccgaatccatggcttccgtttttcccgttcttaaatgggttggacgacgaactgcttgaatgggtattgttcgagctatgaaattgagtttgataagttgccgaatttgtttgattggggggctgaactccaaacttgtcactattaaaaggtctcgacactgaacgcatcagttgttctaaggaattgttttgaaaatttgacggatttggttcattgaatggcctcgaaacagaacgcatcaactcttcaaacgttttgctgtttttgtcgctcattccttcacagaaattggcacacaatgccaaagtattcaatgccaaaagcagcggactggcggaaatttgtttcataatgattaaggctgcaaaaa

SEQ ID NO: 26618 - DNA, 1027 bp, Heterodera glycines
aaaaaaagccgttcccataataatcccccggggaaggggggggggaaaccatgtttccaaatttttcaatttttttttgttttatttttctcaaagcggttcagaattcaaaaaaaaataccatccccggggcaaaaaatggggtttggcaagtttatgggggaaaaaaaaccttttccaaaataatacccctgggagaaggggagtggaaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaa

SEQ ID NO: 26619 - DNA, 1375 bp, Heterodera glycines
ccgctatgtatttcctggcgatcacaagtgcctaaaaatgtcaaaaaatcatttttaacaaataattcagttttaagttcgctgtacgaaatttctttttttgaatttttgttttggcatttcgtcttcgtcaaatgttttttgggtccatttgagttcgtccccatataacaacgattttttggatttttgacccctttattcgccgtttcgttcgacttgggggcagtcgggtcaaactcccccccccccacccgggtcattagcaaaatccgggattttttgagcggggggggggggcgtccgttggacctgtgctgcggtgatgtgcgcccgtgggttagtttgcttcagctgcacgatgtactccaccaactcggcgtccagctcgtccccgataagtttgggccgtccccgtcccctgccgcgcaaatatcccccgcctccgcccccgccgctgtaattgccctgctgccacagctgtccgatctgttccatgcccgagtcatcgccctgtccgtcgccaatttcaagctaaaaagcgtgcgattaaaatcattttagcgcatttggaacttccccccttttttcccctcttttgtccccacttttgtgccgtccccgccggccatcccctgctgttgctgatggaccgaaatggaggcacgccgtgcactgacgccgccctgctttttgaactctttgcggtagtaataggcggcaactgcgggcggaatgttgaatttacgggccgcggcggtggcgccatggcattggacgtaactggcgacagtctgaggagggagagaatatagggagggaacaaagccaacacactctgcacaaccccctaccattaaacccatctgttcaaaaatgccaagaaaatcgccaaaatttgaaatcgcccgagaatggcacagacgggcaaaagcccccccgggcgagcctcatccgttcggccacacctttttctcctccggcgtgcagtatttagagcgtcggccccgcggtgccgattccgcgccgcttccgctcatgtcggcaccgccggcggagaacagactctgctgttgctgagtgccgggcgtcgcgaaggacgacgcggcactgccgctgtgcatgttgccaagtctagcggcgtgttgcaaatgctgcgaggcaatgccattggacacgggcagtgccacacagtgctgcacacgctgcgcgtcttggcactcggcacaggcgcacggcgcgacgttaagcgcacgcatcagaagagccatctgacggggggggggggggcaatgagagtgattagtgctgaacaaagagtgaacacatctcctgatcaaacatcgcacagtattaaactgtcacaattcatgcg

SEQ ID NO: 26620 - DNA, 1518 bp, Heterodera glycines
tgagccagctagctcggcgctcatttcagtgtaagtcagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgccccccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcgggggggactgcccccgaaaacaaaaaaaatcgatttttttcaagtgtccgttttggggtactcaaacaaattatgggggagcaaaaatccaacgcagaattaaagtacagactatagggaagctattccggaggattcggtctccccattaatctgggcgcatcggtccggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaagaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcagggggactgccccgaaaac

SEQ ID NO: 26621 - DNA, 2102 bp, Heterodera glycines
  misc_feature (2061)..(2061): n is a, c, g, or t
ttttcatttttttcataaatttcaaaaaattttgcgaaaactttaaaatttaaatattaattatttttttttgaaaattcatttttttagggggcggaatgccaatgggcagtggcatgggcggtgacaatggcggcatgggcggtggaggaatgagcggcggtatgccaggcggaatgaatggtggaatgggtggcatgggcggaggcggcgacatgggaggtaagcaaatccttgttgaatccctgatctgatctataaaattacaaaaaaagatcatcacgcattcatgatttaatcctatgaaattaattttctataaattaaatttaattaaaataattaaaattttaatgatttttatagcaaaaatactttattgagaaattttttcggaagattttttgtggtgagagggtttgatgatgtcagggttagcgccgaaaatttttaagattttttataatattagttagcatcgcctggctaaattttgaaattttttaaaaatcaattcgagaatttttataaattatacatttttaattttggttctcttaattttaattgctagaatgattttttaatttcaaggctacggctccaatcagggcggcggtggtttttcaaacggaggcccaagcggttttggaagcgcaggtggagcctccggtaagacaaacgatccgctgatgggtcccgcaattgttgtgccaaaatttgaagacaaataagaatatttccaccaaaaatgtcattttaggaatgttaattatttatttattattgtaaattttgaacgaaatttatataaaaaaattttttggaaaatttcgaaaaaatttaggcaaagaccgagtcccatcggatctgaagaaggttgaagcttccatttctcgcatttttcctggctattttccttcatatagcggctataattcaccctctgaaaattaattactcttgacaatgcaccaaaattgttaatttattatttaaaataaaattaaaaataagaatttgtatttaaattaaattaaattaaataggacaaacgctgtaaaattcacaaaaaccaaaatttttcttaaaaaatttcccgccaaaaaaattaaaataaaatgaataaatattaggtgtaagaataattttggacttctaaattggtgctaaaagatatatttaaaaaataaaattactaaaaaatttattttttattttatttttttaatttccaaattttagggatgatggaaagcgcgcgctacgtgcaaagcgcgcaaggcttaccacccattcaaattccgccatattcggcggaggaggacgggcctgggtcggctggccacaaaaatgcaatgccgccaattcaaattcctccgtacagtgcggaggagagtgatgataagaatgtgaagtcgatcattaagccgttgttgccgggcaattagtgggactaattagcccttctttaaataggcaacaaaacaatggattggattaacgggttaagtgaaaagatgttttgttaaaagcggttttttgagggtagaataacgaaaatatttaatatatttattaaaaaataaaaatttaaatcatattaaataaaaatttatcaaaaaaaaatattattaatttataagaaaataataaataaaaattttaaaaatatctattataataaatttattactaaataattcatttaaaattgattaaacagaaacaaaaatatcaaaaataaatgcattatcttcgttttccaatccataattttggtctaatttatactttatttaatttttttttgttaatgaatattaaataaattgtttgacttttgttataataaaattgccaatccataagaatattaattaaaatcagaatatttacataacatggatcgagccattaaatgccacaataattaaataaaaacaaaaactcttgaaaaatatttaaaataaaatattcattaattgattttgtactttaggcatttaggaccaatttaaaaatagaaaattatacctgaatgaacataattctaactanaataaaaagcaataagacgataaatatttaaacatatattt

SEQ ID NO: 26622 - DNA, 2333 bp, Heterodera glycines
  misc_feature (2222)..(2222): n is a, c, g, or t
  misc_feature (2253)..(2253): n is a, c, g, or t
aagtattaatcttccctatagaaataattaagctattaaatgataccataaaatcttgattgcagttgagtaatgttatcaatttatttttacattttttattttagaaatatttcaacaaaaattctaatttcctcttagaatttttcattgaaattgttcagtaagtttttaaaaaaattaattatgaaatttttttgaacattttcaaggatgacagttttaacaaacgcgcaaccccatttaacaatcgcatcgttatctgttgaacggacactgtgaatgtcctcgtcacgaaagccgtcgtcacttttcacgtcgcttccaccaccaccaccaccttcagtttgtgcagcggacacgatcatcggaattgcaaccgtggcgttcaacacgctgcgcattggttccggaattgctgttgctgcagctatttgggacgtcacacggttggcctcccgtatgacggccgcggtgtgctgttgctgcagtcgcccgctctccccaccatcactgaacatgcttcggattttagtgtgttcgttgttgttgttgatttgacgccgagatgatgttggcgtcgacgagtgtggcgacggcggtggcaataagaccggagtgacgaagccagcgtacaaccgacaaccaacaaatgatgaacaacggcagtatgatggcgtagttggtgaacaggagcagtgcggaccaaatctgcacatacatgactggggctgctgctgttgggtccacaccatctgcgctcatcgtaacgttcatctcaacggcagatggcacacttttgctcgtcagtgcaattccttaaatttacaaatgtctttgctgggggtgatggttgacataatgcttgggggtaatttcacgctgaccgctgtgcaatggcgaaatgagtggcgcactgtcaatcacccgtgctggcacttcaggtctggcattgaacaggggatgtggcgccaccagtccgtcccctcgtggctcatacaaaatcacccagcttaggtttggcatgtttatcgtgggcagacaatatatgtttatgtttgtgtgaggtttatgaataagacactttgttgataggtacaaatttggagcgttgagcaatgtgttgttaatcataatatgggctcctttttatgcaatttttgagtcggatacaatatgacggttgtagtcgatcatgatcaactgatcgaattccccgagcacgaccatctcaacgccgcctgccggtatcgcttcgttgaacgcgagccgaatgctggtggtgccggagcggagcagttcaaagccgcaactgtcgtccagcgtcgatgtcattggcaccacgaagatggtccatccgtcgtggaactgctccagcgtaatgtccatggagcgctccgagttggccatgcccagcgcctcgtacatgtcaacaaatggtcgaatgtaggcacagccggagaagtccatgcggtgtggcactgccggatacacatgaccggcagcgtgcacgctgatctcacgaatcgcgtagggcttgaagttgaacggtgacaatgccagctggccgttgaatgctccgttcgccaccaatgcaatggtcagccgacgcgggatggcggcggaaaatatgttgtgatccatctcggtacggccggcggtcagaaacacggacttcacctccgtcttccgtaccgcataggtggccggctgcttttccagcgtcttgtagatggacaggttcagcgacggttgcacctcaaccatcttcacgtacagctttatgtcgtgtaggtacagcgcgtaatgttggcccgccgctgctgctgctgccgctggcgctagactttgtaacaggaacgcatcctttgcccgatagatggtgaacaggacgtccatgttgttcaacagatacagctcctggttgcccaggtcgaagtccagccgagaaaggaagcgtgctttacgaccgcccgcgaagcgcgcacagcgtgccagaaaaccggcgtccgtcgcgtcgtcgtgcttccttgatgggtggtagcccgcgctggccataaagtgtccctttgcactgttcggaaaggacagttcgttggtcaggtacgccttgtaggggtagagggttccgctgtcgtataactccgtgttttggacctcaacctgattaaatttgatgctggttattgcagtcatgaggactgtgggacacccaccttgangtgttgtacaaatgtctgtccaatgcattgngcgggcgcgacgagtttgatcgcggccactgcagcttcaatgggcacccaacgtccgccgccatcctcccttttggatgg

SEQ ID NO: 26623 - DNA, 1492 bp, Heterodera glycines
gtaaagggcgaaagggtggagaggaggaggagactgatcaatcggggccatagcttgggagaaaaactgatcagatgtgatcattcccctccttcacacatttattaatgcttgtatggggctgatcaagacaacaaattggcattggcacaattcggttcaaaattttcggaatccaaaatcgaaaaaaaatcaaaagttttgattagctctgatcagaatgttgtgttgtttctttgtctgcctgctgctgatcacttgcaatatttactactcacaaaatcactgtttcccatgggcaaaattaatgttcggcttttttatttggaataaaaatggcatctcgtcaatcattagccataaattggcccatatcggcacactaatttacggagacactgccaattaaatacctacctataaaagaatacacatataataatcccatggtgcgactatcagttaaattggtcgcatttttggcatttttcaaattttatacccacaattaacatctcaagtagtgctgttcgagactctcggtctcgagtctcgactcgagaaaagtctcgggtttttttggtctcggtctcgagtctcggtctcgggtttttaagtctcggtctcgattttcgagactcgagaccgagaccgagacttttttacacccctaatgattggctttttgcaaatttaaaattaatatatttttggtaattttttgcttcattgtttactcgtaggtgtggtccggtgggttgttttcttggttatgttcttcattttagcgttggatcagttcccctccaagtaaatgttttttcttctaatttttcaaaattattcctttttcgataggaattcaatcaaaattttaacatttaaaatcataaaatattgtcatttttggactaaatcaattaacaaagtgcactaaaatttcaaattttccccagcggcgcctatcggcaccgccggcttttgattcataattttgcagttgaataaatgcaattatttcaaacgtaatagtaatttttcataatttttaagaaataagaaaattaaaaaaaaaagtaattcccctccaagtagttgtttttcttctaatttttcaaaattattcatttttcggtgggaattcaatcataattttaacaattaaattcgtaaaatattttcattttttgaactaaatcagttaacaaattgcacttaaattttaatgaatttttgttttgtgcgtttttgaaatgataaatattgtaccaaattgaatcaaaattaaaaaaaaaaccaaaaattagttaagaatagagtcaaaaaatgtttttaacgatttttaagcgaataggaaaattttttgaaaaaagtctcgagtctcgggttttttgggtctcggtctcggggttttcggtctcggtctcgggtctcggggtcgagtctcggtctcgagtctcgggaaatttttggtctcgaacagcactagtat

SEQ ID NO: 26624 - DNA, 1572 bp, Heterodera glycines
  misc_feature (22)..(22): n is a, c, g, or t
  misc_feature (56)..(56): n is a, c, g, or t
  misc_feature (69)..(69): n is a, c, g, or t
  misc_feature (87)..(87): n is a, c, g, or t
  misc_feature (98)..(98): n is a, c, g, or t
ttgttttttaaattaataattnatatgataatttaaaaataaaaaaaaacataaanatatgccattatntaggcacaatgcatatcncatggagaatnttatatgaaaaatgtaagtaaatgaatttttcgccaataattttttatttttggggtgtttttccataaaagtccgttttttaataattatttagaagttatttaataagcctggtatcattcgtctaaaagcacccgttttggcggggtttttgggttcatcatcgcaactttttaaccttttccgagagtctcgcattcacaaattcacaaatctttttgacaaaaaaattattcttccagttccgacaagcatcaaaaatgccatcaaattaacagatgttgttgtcacagaaatcagcatggacaaaagccaagggagaaagtaaaagaaaagcacaaaagaaaggaaaagagcagaattatcagaaaatattagaaaaagagtaaaaaaaaggtaaatgaattataagcaaaacataaaatggcattattttgctaaacaattaaaataaatatgaaaaaagatgaaaaaagtgagcgatttttggcacaaatcataaaattagcttggaccaaaacccaagtaaaaattcagacaaatttattgaactcagatgaaaaattatttttaaatattctgattgattgggtgtggggtgataagtaagcaagctaacaataagccgtaaatatttaaaacattttaacacagaaaaagtgttgcaataactataattgttagtccatttattttttaattaagttaataaatcttttctgaaattgccatcggattggctttatttgtcacttggaccaatgctctttgaacatcgtttggaagaagctgctttcttaaaaaataaattctcagcagaatttgatgaaaaaattaaacaaatttgtgataaacggaataaatatttggagagttacgaggacatgagcattcttttacccaatgtcgacgaaaaatcggtacaattgcgcatattaatgttaattatgagtaattgcacttaattaaccaaattattacataggattaatcactttttcaaagatggagctgatcattgaacacacattggacgtggcggaagacgggaaaagaaatgacaaaaataaactcaagaccatcattgaatggttcaaaaatggagcatggactttagaaaaggagggggattatgattatggattagcttatagccaagacaaacaaaaagcacttaaacgagttagagtcgtagtttgttgaaaatttttggcatcgcgataatttattaattattcccaaataaatttgaattccaatttttaaagttttatttttttttaaatcgaaaagagtacgcgataatatatataatagattgccctgctaggttaaagtattttaaaataaaaattgatatgaggcggagtgaaaagctcgataacgatgcgatttatgcgcgcggcggaaagagtgggcggattaaagatggatgaagatggaatgagaggagagagaggccacgagaccggt

SEQ ID NO: 26625 - DNA, 1062 bp, Heterodera glycines
tgtagaatagaatgtgcatcgctctgcgcgcgtctctccatgctgggagcatttgtatggtacaaaatatctctcacaaaagagatagacatttttctgtcatagagagtaaatataaaattaccctgtagaatagaatgagcattgctctccgcgcccctctgcccatgctgggagcatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagcctttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgccc

SEQ ID NO: 26626 - DNA, 1245 bp, Heterodera glycines
ctgattgtatgtgttatctcttctttgcctttggatatgtgttgtgttcacttacatttaattaaaataaaattttcctgacgcaatttatttatttttgaaaaattagtaaatttataggaaattgtaaatttcgtttttttaaatgacttcggcggcggcgcttgcaccaatgaagaataatccattttttctatactttatcctcgagtgcagcggggccgggaccgggaattcccggtcctccgagatcccggtcccgggttttgaaaatctcaggtcccggtcccggtagggcaaccgggaaccgggaaaaacaagcactggtaagaatgggggtctagtgaaaaattagtgaagaaaattggagttttgaaagtgtaaaaactgatttatttcatcaaaatttatatttcaattgtagaggaaataataaaaaaaatatttttgaaaattttttcccatttaggcttaatagattttggctttgtcctacccttgttggctaaaattactctcaaacagagggccaaccacaccagaaaataatcagttaattttatgggacctccccaataaaaagtgacttggatttggctttgattgattgccaatttccccctccccctccccctcatccctcattatcattttgtttagtcaacagtgggcctccccatatttttatcatttctctccccatttgctccacaattattaaaacgtttagtgccacgttttgtctgccatttgatttatgcaaattcttttcccacttcaaaaaatgggtacttgtactatttacagcccataggaatttttttttttaattttcaaaagccatgaaaattgtttccaatacttttcggaatcgctgatcatgaatccagcatccaaatactcagaaacgaagttgaaaatgatcattggttcaataaaagatcattaaactatttttatactaaaaatgtgaaatttgaaaaatttaaattttctactcttagttcggatttgggtccgggtttcgaaattggtcgaaatgaatgttatattcatgatcagcaaccccgaataggtattcatggaaacacgtttttatcttaaatataaaaaaatttagatttttcggtacgtgaatataaattaagtcataggaaatttgaagaaaaaaggcatatacctcaaatccgggtccctaatattgagatgaatagagacttgaaatttacaaaaaaaaaaaaaaaa

SEQ ID NO: 26627 - DNA, 1465 bp, Heterodera glycines
atcgctttttgtattttctaatctccggcgcgtctccgtcgctcgcggcactgtttggattcacattcacttggaccttaaggattggactgagaaggacaacggcggggagggaatttgccaattgagtcccgccgtttgagtcccgcggatggcgtctcaaattttaatgcgcagtcacattatgaattagtccatctttagagctttcgtttgccaataaaattgttttcctagaaagagtttttttcgtgaaaatttgaatttcgtttctgcactgccttttgcctcgacggggcgttgactcggaatacgacgggacatgtcgagaaattgaacattgcaaagaacagttggaggcgtatttgggctgggcaagcaaaaagttgaaatgcacgccgaaattcgtgggcacaggcagaaattcacaccaattggaaatccccgagtcggcatgtcacaatttgacggacgatttccaattcacgtcccaacgaaaagtaaaacggaaattcgaagggaggtggaggtgacgtaaacaatttgtccatttataacgaaggggtacaaacgctacacgactaataacctgcaaaaactggtggacaagctgaacgatgcggagacaaactgtgccacgatcagtgcggaggtcacccgtagagtttttgctgatttggatgtgcggtcggttgaccacgccgaaacaaaacgcatttataattaattcccttttataaaccatcagaaaggacaaatgggcttcaattgttcaccaaattgccactttcgattgtctaatggcgctctctctgtacgcgcagtcatcgcctcacaaaatgtgttttccggagtttgtgttcgaatttgacatggttcaataatacgttgattgtttattcgaccattgttttttagccgttcgtcgacattcagcgtgggttccatccgtcgttggccgaccttaagtcggcgtcagccggcagtttcaattacattccgaacagctgtgtgctgggctgtggctcgaacacggcccacacgatgttgctgacagggccgaatatgggcgggaaaagcactttcatgcggcaagtggccacccttgtggcacttgcgcacattgtgggttctcaaattggcgaactgttctctaattaatctttgccgttcgctatttgagggctcaatggtgccggctgattcgatgcgacttacgccggtcgatcgcattttttgtcggatcggcgccagtgacagattatctgcaggtgtcctttggctaatcagtttcgtgcctgttgttttattactcgactcattaaggacaatcgacatttttcgtggaattgtcagagacgaacacaattttgtcgcaggcgacgcgacattcgctggtgcttattgatgagctcggccgacgcacgaggttcctttgatactgaaaagcacgtatagtgaagtt

SEQ ID NO: 26628 - DNA, 1588 bp, Heterodera glycines
  misc_feature (1490)..(1490): n is a, c, g, or t
agttcccctccaagtcattattttttcttctaatttttcaaaattattcctttttcaatggaaaattcaaaataaaatttaatatttgttagaattttttcaatttaaatgaagaataaaaaatccatattatgaacattgatttatttaataaaaagggccaaaatttgcaccttttcacatgccggcgacgcctaaaaccaccatatttcttaaaaaattagctcaaaatggaaaatttggacattttttgtaaaaatctgttaataaattgaaaaagaaaaatggattgtattgtaactttatcaaattcaacatatgttatggcagaaactgtacttatttcaacttttctaaattgaccaaattttttcaaattttccaggcaaatagagaaaagattggctatcgaatgattcctagaatgtaaaatttgattgcctttaggcaaagttatgccatgttttgtcgaaaaatcgcacaatggtggattttacgaaacgacccagcacgatttcatatcacagaatctgtacaaaaatttataatattttaggctttgtttctgtgtgtgccaaaaagccaattccaaaaagtggcattttctactttgaagtaaatgatctaaatgggtttgcatcattgtaagtaattctgattgaacgtatttatatttgctaaagacgccaaatatgtgaatacatatttgcaaccccccccccccccaaatattcgcaaaaaaattccaaaaaggccaaaatatttgtcagaaattgaacaaaaattgctaaaaaataaattaattaatttctcaaaaaagtctcatttttattcatttcgctagcacaatgctaatcaattcaatgttttttgcagtaaatctttttctcgctctctatgattgactaattttttggaattttcttcgccaaaattccaactttggattaaaaagtgaatagtcatgaaaaaggtcaaaaaaataaaattttgtacaattttgggcattttggccaagaatttgggtgctaaaaagctattttttcaaaaaaaaaccgctaaattattattaaaaacctcataagtccaaaatattttttatatgtgcaaaaaatttgagcttttcatgcgctaaaatgttcgcaaaaaacatttaaaaatatataaatccgttccccgtaaatatcccttaaaagttttggaatgcttaatgtttttcagtgcagccgttggcttggcaccaaaagaattgccattgggcgaacgtgccgtatattttgacggcacaaacactgaccagcaaaacaattcatacgaatacagtctgcacagtgttggttttgcttcatcatttttcccaattttcaaaaatttaccatcgcttgaacctggcgatgtgatcggatgcggcgtgaatttgaacactcgcgagatcatttacacaaagaatggaaaacgcataagtgggaaaatgaagcaaaacaaataanaataaaatatattttttatttgttcaatcgcataattaataattaggctccaatttatagttttttcactttttatgagctctcagtggcctgaaact

SEQ ID NO: 26629 - DNA, 1259 bp, Heterodera glycines
cccccccccccccccccatatttacgggggtggagaaaacagacgcattagcgcccccggggtgggggggggggttgaggggagaagcatcagttcactccgcaatgaatttttgttttggcaaaatatttttttgcctgaaaagtgcctcaggcataaatccgagaagcctttaagcaaacaattttataattttatgtgtcaattcaaaatgaatttggaatttttattttttgttttggaaaaatgttttttccgggaaaaagcctcaggcgtaaatcttaggcaaacaactttcatctttttaactagcatttctcgtacttattttttttttgtttgttcacgtcaaagattgtggaaaaaaataagacaaatttgatgagagtttgccataaaaaactttgccatattttaattatattttttcagtcaaatttttaataattctgaaagaaattttaaataaacattttttaaattaaactttaattattcaaaaaagatttttcgttacctaaaaaataaagacagttattttcatttatttgtaaattttttgaacttttaattattcattgaaatttttaaatattttttttcagttcaatttttaattaatcgtaaagaaattttaaataatttttttttaaattttaattaataaattactttttaaattattcaaaaaatgattaaaaataaagacaatattatttgatttattttgtaaatttttgaacttttttctattcatcaacggtaaatctgttaagtcaacattaaatacaaaaagatttctcttaatagtttttatgttctttttactgaggaagatgtcgtccaaaattttgaaaattaaaatttaacttttttaaataatattttaaattaaaaatgttttaataaattaattccaatgtctcattaattttcaataataaatatttgaagcgatgtgagataaaaatcttatctgtgtgaatttcttgccccgatttttaattaaaatgattccaaagcgtttaatcaaaaaaaaaaaatgaaaaatttaatttttttttaaatatttaaaaactaaattaaaatttacaaattttagcgaatttaaaaaagctaacaaaatgcaaaaaaatttggctttacagcaactcatggcaaacgttgtgccagaacaactaccatttcgaccatcaatgccggagtacacagatgtgttgccaccgccaaaccatgacgatgtccaggcaagagacaaa

SEQ ID NO: 26630 - DNA, 1713 bp, Heterodera glycines
  misc_feature (1690)..(1690): n is a, c, g, or t
catccgctcaggttactgtaataattggcctaatggcaattttttattctggtgtattcaaatttaaaaatttaattttactctcattaaatcatccaaatttctgtaatgattagtcaaaacgcgtttttaggctctaattaattgacatccttttcaataatccaaaaatgcttttttctaaattcctaaaattgattttcttgaccataaaattctcaaaaaatagaaaaattatattttttgagaaaaaatgtataaatcaatttacatccattaaatttgggccaatttttgcaattttttttgcatttttacctattttgggattatcaaaaaatttaaattttctaggttggatttcaaaaaaataattgcttttttcgtcgatggcttcatccgttgaaccgtcctccatgctgctgctgcccaacccaaacatttcgccaaaactttcactccgaccgctgacacccaccaacataagcccggctgcggcagcgacaccgcgacggcacacaggtggcctaattgcggcatttttttcgaaatttcgacatttcacattttatttttcagtgttcgcctgcagtgattcgaaaaggtggggaaattaaaaaaaattaatacttttaaaattggatcatgtcacagtttgatttgctaagttacaaaaaaaaaacctgaaaatttcaaaaatataacttttttcggacatttggccataatttcagttttttaaatcgattcactcttcggtacaaaataaatattcattttttattacttctcctacactaatttttatttaatatagataaattattaaatgtcgtcatctcacctcacttcacccattctcctccccatgcttctcttgttccgttgaccaattgttatagtcattacattttaatgacagctgctgatgctgctgcttgacctatttctctctctgctgccagccgcttaatcgttcggttttggcctttgaactcaccgccccattatcgccccatgggaggggcgggtggcatcgtcattggcttccttgtggacaaatgatggtgtgacgtcagaaaaatggggcctcccaggggactaatggttggaaaagcattccacatatgccagaaatcactcattcctttgtttgcagcagcgagcgaatcaacaacaattaagttggcatttccttaatggtgccaactagagagaattttaaatttccatttttgtaagcttctgaactcctgaatttccgtaattatttgggcatcggcattacacatccttgatgcccttgagagtgatcaatgtctaactgattgattacagcggcatttgcacattttttgggttgtgccataattaatttgcggcgcttttcggcactgcctctgacccaaaatgcaattaagattttctgatctgaccagaaacattaaaaactcaaaatgtgagagggatgcggggatcaaattaaaaaatataatcatagaacccaaaaatttaatgaccattagtctcagcccgagtgttcactggccaaatgggtcgtttaattaaaaagaaactgttatttataattacctcataaatcatatcaggaaggcaattatttttgaaaaatactttatttctcgaaaattttttttttaagaattttttcagttttttcacatcgatnaattttaatgctttgattttttt

SEQ ID NO: 26631 - DNA, 2009 bp, Heterodera glycines
atgtgttccgattcgcccgcgcttcccatcggcggcacgcaaaaagggttttctgactccgtcgttgacgactcaatggagctggggacgtacgccaacgaacagacgacgaccgcgccaacaaatgacggaagaggcacaatgtcatcggttggggtggaggacgaagagggtggcgccgaaggtgcgaatccatcggacccattttggcatccgtcgcttaactttctgccaaacgtcgcattcggtaggcattttccatcacttaatttgctctaataaaaccattattttgtgctcttttggctttggtctcgcccgaaagcgaattgaacaaatatttggaagcactgaccacgagaaaagggcaatcgcttttcgattcgacttttcctcatcaaatatggtgactgactgtcttttgcattcattttccccctaaatttgctcctttatttcactttgtttctgctctaatcgcttgcttttccgcagattcgttccctcggcgctctctttcgtttccttgaacaacagaagggcgtttcctcttcctccgctgattcggccgccgtcgtcacttcagaccttcgctcattaatcgccacaattgacacctatattctgtagttcttccattttccagtcttaattttgtttttttttggtttaagtgaggattgtgtggaggttgactcagtcactttgcgtgccctcgagattttctactccgattacaacccgaagtccatccggcaaaagtttgtgtggggcaaccaccgaagggaaggcatgagcattttcaaactgtgcaatttgtgtcggtcggtgcccggcaagcaaatgttaaggtgacatgttttgacaccgagtcctgcacaagccacaaattgtaccgttccttcagaatgtggttcgaacgaccctccaaagaccggccaatgctcatggttcgccatgaggcaatttcctatttgtaccaagattgcaacttggaagtgaccgcacacttacgcactctgctgaaggacgtcaccagcataagagttgtcaacaaatgcaaaaaagcaaatgaaaaaagcacattttaagggcattctcaagcgaatgcgccgtggcaatgtgccgatcagcgattggaagagcttttttacggttaatttaaagggattttgcgtaaatacttttcaagactttgtgcacattggtcaaaattggcacttatttcgacgaacgcgatataaacttggccatagtgaaggaaaaattgcactttttgagggatccgctcaaacagctcactgccattctcatcggagtggtcggtcacttttcagtctttttttttattggtgttatgttcttcacttttagattgattttaccgaatcaataagtgaaaatcgtttggtcatctgcagaggtgtcgaccccgagcttgacaaaagtattaccatttttatatattcttaagaccgtgacgccccaaaaaacacacaaattattccattcgattttaataagcctggtacagtggaaatggtctttcattttacacagaaaaacaattgtacgaaaaattgccggaagatttaacatcggtggcacttttggaggcggaggacatttccatcgaaagttgttccgttgcttacgttccgatcatcggatatttgcttatggtggcggaaagtacgcaaattccaacggacacaaaagcgctcgtggaaattgtaaaaaagcgcaaataaaaatgtttggagtatagaaatttaaaatccatcccttcacagattttttcttccgagggaatgtcctattacaaaacgaatcgaatgcgtttgttggatgagaacattggtgacattaaaatgcaaattgtggacgcggaaacgaacattgtgcttaagtgggtcaattaaaatgcaaaattgtctaaattcttcttcgttttcagtttacaaaaacgtattttggacagcaaagaggcggtgctcagtgccgtcgaa

SEQ ID NO: 26632 - DNA, 1491 bp, Heterodera glycines
tacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaacagtgattagaagaggtacaactgcaattagaagagtgattagaagtggtacaacagtgattagaagaggtacaacagtgattaaaagaggtacaaaagtgattaaaagaggtacaacagtgattaggagaggtacaaaaattgttggaatggtacaacaatggttaaaaagggtacaatcatggtattaaaattaaataattaaggaaatcgtttattaaaaagtaagattaaaaattgaatgtaattaataaatttttaaaaataaaataaatttccttttattaattaaaaagagtgtttgaaaagtacaaggattgaatatttatttaaattgaaattaatattacaaattctaatttaaaaatacaggagttctttaataaaagtaaataaattattattttaatttaaaagatttttcacaaaaaaaataatttaatttaaattaaaaaattttattttttatagattaaacaaaactatttatatttattaaaatgaaaattaataatataatatttatttaatttgaaatgaaattaaacatgtaaaagtaatcaaaaaatgcacagaaaaataatgtacaccggccggattcgaacctgccgccccccccccataagatgactcagaatccccaatcacacagggattctgagggcttaacgatgtaataactgaaatctgatgtcagattagtgatcagcaccctcaaatagccctaatgacatgtttttgaagatttttgtgaaaaaaaatttctcaactcaaaaatcatgtgctcccccctttggtccagaatcccaaaatcacttttatttttataacattttttaaaaatgtgatagaaatgccaaataaaatttatataatagaggaaaaaattgcggatttttgtagtattttacttttacagtatgacctttcagaaccgagttatgaatttttttctgaaaaatcgaaaatttccagaaattctggaataactttttttcttttgaacattataaaaccaaataaacctcataaaattctcccgattttttgctatttttaaagctttaattcacttaaattgagcagtccttcattgagttatgaattttcaaattttaacccaaatttccaaggaccaaaaaaattaaaaatattttagaatttttaaaaaattccaaaaaatctgaaacttaaaataaacatcatatttgtgctcaggaccctaatttaccccagaaaaatatttttaaccctctttttcaacccaaaaaaaatttttgaaaatttctagggggcctagctcgaaaatttttgaaaa

SEQ ID NO: 26633 - DNA, 2451 bp, Heterodera glycines
  misc_feature (2445)..(2445): n is a, c, g, or t
tattcagccaattcaagataaattccagtaattttgtcaggtcgagatttgaatcgcgattttgcttcatcgagtcttttcattaaaactaaattaggattaaatttgggttcgttaaaatattaatgacttttatgaaacggatatttcaacacctgtatattccttgtccttcgcaagtgcatttctgcaaatcatggtaaaatataagcgaataaattttttctaaaaaatgataataacagaataggtcttcacaattgccgttttagaaaaaaaaatgacgaaatgattttgcaatttgttaaagttcttaaaaattttttaagattttacattttttgacaaattttattccttctttaattttaaatcagggctgccaagttttttttttcaaaaaaaggacaaacgaggctaaaacaaagatttggaccccaaaaaaaagattttttgaaaaaattgattgttaccttgtaaaaacagttaaaaagcattattggcttttataaaagcaaaatacaacaaatttgcacaattactccggttttattattgaaattaatattgttttttcaaaaaagagtcattcaaagtatttgtcccatccaccgatctgatccaacagtttgtgattggaaatgagcatctgatacatttctgggcaagtcccggtcccgaagaaaaatcgaggtcccggtcccggcaagtcccggtaccggttttgcccaaaattcccggtcccgctctactctacttttgcataattttcacaataaatatttttgcgtttttggtggggcatttggaaaatgtaaaaaaagctaaaaatgggaattagttatgcgtctgacaacaggttatggatgagaatgctcaaaaaaacaaaagttaagttgagagggaaagagaggaagagaaaatagtattaaaacgaaaataaataaataaaatatcagcgaaataaatcattaagcacaaaaaatttaaaaagtttggggaagcctaaaataaaggacaatctttaaaaaaaggacattttaaattttaaagatccggcccctccaaaaaaggacaaatctttaaaaaaaggacacttggcagccctggttaataatgatctgatgtaaaaatagatatataatggcataaataaaaaaatatttttataaaaaatgccatgcccataaatgaaatacgcgcaaataggggatgaagacattaacaaagaaaaatgtggcatcatattgaataccaatgactgacgtaagcaaagctagcgcgaaactaatttttttttattacaattactaatttaatcatttttttaacttttacagattctactaacgaacagggaggccaaatttaaataatgcccggaagggttcactggtaccgagggattgaaaacagggcatttttctctaattcaaaaagctctcgttgaaaaaatttgaaaatctctaaaagtctcattttaacattgatatttaaaaaactatatttatatccaatcctttgaaataaagttattacgaaaagctcgtctgagaaaccctggaaaaaggtcgtttggcgctccattggcaaaaaagtgctttttgaaatgccattgccctccggcgtgttcctttgaattaaattgtaaggccatgagtggacaattactttctcaagatttttgattattgctcaaaaaataaatttgctgacaaattgtccactgtagtgattgatgctccagagtctcagtctcgactcgagaaaagtttccggtttttggtctcggtcatgactctcgagtttttggtcgcacttttcaaagttccaactcgatatttttttacgtccctaatattcggcttctagcaaaatttaaaaaatttcgtttatgagaatttaaggaatttcgatgcaattattttataatttttagccaaaaattgagcaaaaaataatttttattcactgattgcagttgcaaatgagctacatttcctttataaaattctcttagcaaatattgacattttttaaatcaaaaattttgtcaagaaaaaaaatttgggggaagaatttttgaaaaaatttatccagggtcacgagagacccgacaacagaaatgattctgtggggatgatgtctccccaagtaaacagatcatttctgacattgacaagtccccaattttctcaaagaaaaatagggacagggacaagacaaacttgttccctttgttgtgctatgggacatcctccaagtcgatgtccccaatattccacaccaggagcacgcagaaggcggctcgcaaaacagcgaaaatgttttaattgccttatgaaagatcataaggcacaacaatgccaatctccaaagagatgcttgcagtgtggtggaaagcaccacatatattatctgttatcatggagatgctccaattgnggagca

SEQ ID NO: 26634 - DNA, 1123 bp, Heterodera glycines
cagacaagagaaggcaactgtggtaccaagttgcgggtaaaaaaatgagaaaaaagagatagccattttttggtcaagaatttttttgtttgcgtttcaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaatatcgtaagattgtttgatagggccagacaagagaaggcatctgttgttaccaagtttgcggtaaaaaaatgagaaaaaagagatagctattttttggtcaagaattttttttgtttgcgtttcaaatatcgtaa

SEQ ID NO: 26635 - DNA, 1395 bp, Heterodera glycines
tatatttagcaatggagtctttttgctgtgtttgtaaagcaatttatggaggaactacagctgttccgtctgcaaaatagagaccggacgggatcgggatttcttcgggatcccgcgggattaaattcgggatcccgacctcgggatccgtcccgagcgattttttaaattcatcgggattgatcgggatccggatttcatcgggatccggaagcgggatccctcccgaccattttaccaatcccgcgggactgaagtcacgataatttttcgaaaaatctccattttttaattaaaatcttgaattttaaattaaaaaatattgtcatttgataaattctgttaacaaattacatacagaaattgacattaattgattaaattgtaaaaatatttaaagctatgttgttaaatgttctaatttttgaccctagatattctaattttggaaaaaaaatttataaaaacctaatataattaccatccctatttttcacaatcgaattgatcaattataaatattagataagcacttgaacaaaacttagcacaaaactaaaaattaaaaagccactaaaaaaaaattgggttttagcaaatcccgataatcccgcgggatcccgaaaaaaatcttcgggattcatcgggatcgggattcggtcgggatcccgactcgggatccctccgaccccagttgtccggtctctattgcaaaagcccgcagcaatggacataagctcaagccctatgtgttggtcaacagaaagcgaccggtgccgcaaattatcaaccaatttgctggaaaattgtttcgtttttcagaaaaaattagtgccaaacaatgtactcaaaattctatttatcccccatgggggataaatggagactgggtgattattttttaaactcctcagaaaggggggataattggagactgcggtattaatagagactgggctataattagagcatatacggtatattaaattacaatttatttttataaaatttagaatatttttaaaataatattatctattattacagttgcttttttatcatatattgagttatgacactttcttaattatataatcgcttgttgtttaattatttaaaaaagtttttaatcataaagaatttaaaattttttcttaaaaaaagataatttctattgtaagaataccgtattttctctaattaaggcccccggggggattatttttcaacctcttcagaaatgtggacataattggagacagggcctttaatggagacggggggattatttttcaacaaatttttaatgactagggccgcgacttttagtgatgaaaaatctcgaaaataattaataaaataatgtagaggggaccgggaattttgagcaaaacc

SEQ ID NO: 26636 - DNA, 1394 bp, Heterodera glycines
ctcaaaacggttcagaattcaataaaaataacatttacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattggggaaaaaaagactttacaaaataatacccctgggagaagggagtgggaaacatgatttcaaaatttttgttgaaatatttgtcgtgctctgaagggcgtgggagggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactatgcagggatactccccggtaaaggactaacttacactgaaatgagcgccgagctagctggctcaaaaaaattttcgaaaatctgagtctttcgtttttatttattttttgcaaaattaattcataaatattttttcagaaagggttctgaaacgcaccaaattttatttacatgttagtttaggcactctgatgctttttctatcaaaaagggagatgaataaaattgttaaaaatttttaattcctttttaaacaggccaaaaagtttaggcttagcttttttttcagaaactgatcagaagcgcaccaaactttgcagggatactgaaaggaagagaaataacctattttaaatattatctagtcagttcatttaaataatttttatccaaaaaattttttttgggttttcggggcagtccccccgaaccgatgcgcccagatttatggggagaccgaatcattcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatcgatttttttgtttcataaatatttttttcagaaagtgctctaaagcgcaccaaattttatttacaacttaattttagcactctgatgctttagtatca

SEQ ID NO: 26637 - DNA, 1435 bp, Heterodera glycines
ggagggggggggggggggagaattctatattgttatgaaaaagtaagaataatttttgaaataaattaccccccccccccctatttaacaggagccacgacatttgcggccccgacatttgggcctatgcctaaaatcggattctcagttgaattttttctaatagcctaacagcattaaaattcagaaatcgtcgtcttctgtttattaggagcattaattcacttttttaaaataattatttctaagatttgcttactatcaaattatcaggcacaatcactttctatcattaggctaccaaggcttgaaaaaacttaattttgaaaccgatttttgacattggcgcaattgtcggggcacgatttaacatatgatttacattaacaacgaaaggatgggggagagttccaaatatgctccaccctgaacacataataaatcagccaatactcacaaggatggagacgaacgtcagtgattgggtgaatagaattttcgaagtaaaatcgtgtgctaatttggtacacttccgacggcttcggtggcacatcgtcaggcatttttgacggaggcggagggatcggatgcgggggacagggcggcaatttcggtgccgagcaaaattccgttgggaaggaacgcacggattgacaaggcaaagagacggagggacagaacatcgaagacaacggaggaacggacgaagaagaagaagagacattctgggaggtcaaagcattggcaacactgaaaagggaattgaaagtccagaaaagcgtaacaggtcattcccccagaccccgaaaattaaaaaaatcgaaacattattgttttcgaaaaccatagaattttttaaggaaatttcatgaaaaaccaatttaaattttctagcgattttttggaaaaaattagtattgggttggtgtatattatgttagttttttatgaacattaaaaaacagcaataagatgacacaccacaagtctccagcgctgcgacaactttcaattccccgctcaaagaagtcgatcaacacttttggcacattctatgtcaaggtctcatttttttggcattttctggggctttcttgcaggaggaaattttctgagagagtaaagcacgtaaatcgaatggggccatgtctaacaataaggaacaagatgtgtgaaaaaaacaccttccaaaacaaatgttatttttcagaaaaaatactttttttgacatataaggtaaagtacgaaaacagatagaacaatagttagaatgtaaaaaatacccaaaataaaaaattaagaagagttacatatgcaaataagaaaaaaacgaacgttttatacgccaaacccataattcatagtagattttgaattgtaagaaaaattttctaaatttttttgaggatagctagctgtttggaatttaaaaaaa

SEQ ID NO: 26638 - DNA, 1162 bp, Heterodera glycines
tttcatagaaaaatggtccaaaaattgcaatatttgataattttttagtgaaaatctgttaacaaattgtattcaaattttcaaaatttttcggcggcgcctaccggcgccgcaagccccctcttcccaaagttttttgaaaaaaaacatgccgctaaaaagctttttatttattttttaatttgaaatagaattttacaaaatgataatttttgctttatgattttgactaataaaaaagttgtagaaaaaatttcgcgtttcgcaattttgcgttttttggaatttcccgtttcggatttattttcatttcgcattttttactttcgcaaatttcgcgtttcgcattttattttccgatttggcccatccctgatacgtaccacgctttacccccccctggggggcctccctggctacgggcctgcatgacacaaacctcaattatattctgttgctggtgctgattctgctggtggtacccttgctgctggtgatccccgcaacgcattggctcaattaaatccaaatcgaaatcgtctgaaaaatatgagtcttacaattaaaaaacaaaggtgcattttaactatctttctgacagtgagatgatcaggtgagggaagacaaaatatagctgtctgtccgttttaccatttatataccagaaaatcggtttgtgaatcaagaaagacttgttaagtatttaatttaaagaatccatttaaaatcaatgttttaagagtttgaaatactctgacataattcaccttcattggatatacttggcaccacgagatcatcaacgagcccatcctccacaaaatcggagagttggggaaaaactgaattcgaagttgaagaagggtgaaactgctgcgctatcggcgattgctgcagcatttgcttcgtatgtattgacttttgttgttggtaaaagtcagcggggctcatttgttgaagcgactgatgcgaaggaggcccctgatgatacgactgattgttattagcgttgatttgcggaacagaatgaagcgaaaactgctgttgttgctgctgctggggagtgtttgtccgcgagtgttccacggtcgacccaccgcttccgacgggcgtcctccgctgactttggtgctgctgatgaacgctgccagtgctcccatgg

SEQ ID NO: 26639 - DNA, 1818 bp, Heterodera glycines
  misc_feature (272)..(272): n is a, c, g, or t
tgtgactaatgcgtaaaattgcggagcggaaaatggtgatggcaacacggttgcccaatttattgcacgcccccaagtggtgccctatgctaaattgggaacaatgtttccaacaccatttcacaactccattcttctcaataaaacttttttatttttttcatctaaatgtttggcctagtaagaaaaccttgaacaaatatgcacagcaaaaaaaagttgaatagggtccgcgaagtggcaaagaagaccaacggggcacatgggggtgnggggggggggcacaaacgcttgtgttggtgcggaccgggtggagggcgtaataggcccagtgaacaccgttggccaaccaaccgaaggtccagcgaaaaaaagttgaacagggcccgcaaagtaccagagaagacaaacggggcagaggtggtgggggcggaggggggggcgcatacgcttatatcggtgcgggtcgggcggaggggggtggtggtctgatgggcgcaaataggcccagtgaacacagctggctggccaaccaacccccaaggtcaagctaaaaaaagtcgaatagggcccgcaaagagtgtgccctatatctactaaccccaataattatttaaaacattttttaatgattttgcagaaattttcgaaatccttgtggcttcattgataccgccaaactctaaaatgagtttcacaataactctttttataattaaaatcaattaacaaatgaagttttcttgttgaatttttattttcataaaaatttcgattatttttttgtttgataaatttgtccactaaattctttcatagtagagaatcgattcgtttacggattaagagaaaattttgccctttttaataactatcacttttaattttctgaatatatgcgaaaattcaaaatttaattaataaaatttgaattttctttggtatttaattaaaaaagttgatttttctttgatatctaattaatgaaatcgttttctttgatatttaatgaaaaaaattaaaattttctttgatatttataataaaatttgaattttctcatgactcatattctccttttttaggcgtctgtttttagtgtctcgtatctgctggtattttgttttctttctgtaatatccctcctaggcccaagcaagcctaagcctaaagcttaggccaaagcctagatccaaagcttagatttagtttagcctataagaatttatatcaggcttgagacaaaaaataacaagtttttatattttattagtcaaactttcaaaaagcttttagctgcagattatgcggatacattaccatataaatatttccattttttccataattttagtctatttgttattgaaagattaatgaaactttataatattttaaaaaaattcaatgtaatctggctaatggttttatttaatattaagtaaatttaattatttttttgatatccaaaaaagcttttagaagaatatatacaatatgtcaagcataatttaattaaatttatcttaatttcaatttttttaaagacaataagcttatagataaaaaatcatttgaaaagtcagctttttgatttttacaatattgtgaagctaaatttgcactttttatgaatcgacctagcactaaaaatcgatcaatatatacacgtaaatgcacatcagatggagaaattggcaataaaacaatttttttgtaaaacagcaatgattcttctataataaataatattaaaaaataaatttaaaaaatactaattatgattaatttaaagcatttgtttaaaacttttttttt

SEQ ID NO: 26640 - DNA, 1200 bp, Heterodera glycines
attttcaaacctagaaatttttataaaaaaaattcttaggaactttcttagtacgaaaattccaagaaaaaaatttttgagaaatttttcaaggattttttagaaaattttgaaaaaacttagtagttcattataaaatttctaaaaaatcgctgaaaaatatctcaaaaaatttttttccttgattcgaactaagtaagttcctacgaattttttttataaaaaatttctaggtttgaaaattttttttttaaaaaatgtttcggggggggggggaaatgaagtccacccatgatagggatatcattcaattttgttttaaaatatttatatttgcccctcttcagaaggccgctgccgtactttggcgtcgttttgccgacgacgacggcaccggaatggacattgctgcggacactttactgcatcccatcgctctgttactgctccgtctccactcgcgacgcgtgagcgagacgagcagcgaggtggaggacattgtcgtcgcggaactcacttcgtccaataaagtgttgagcggaagtgcggtgcgcaagttccacgacctgtgggtgttctgtcggagtgccgtcattgaggaggtgtacgccggcattctgctcaagccgatgaacaggtgatgccacggagagagtgcgctaagggttttgtgttgttgggacatagtttctaaccccaatgaacacagttaaatatgtagttgaatagaaagccatggtgccgataccgtccagtctgggaaattaaattattatgtcgtctcataattattaacaccccttaaaaagtagcctatttattaaaaaaaacaaaaaaagaaattgaatcgaaaatcgaactatttttcatttttttgttggtcacagtcttgcactttctctggaggctttccaattcaccacctcaattttcttctagggttgtgatggttctgctcagttttatcgccgatgacaagctcagtgcggaacaggtggagctgaaggcgttggcctacgcctggtttttggactgtgcccatcacaacgaactgcacaaaattgttcaaatgctcacgcttatgttgctgaacccagtgacggcacgggtaaaaactgttttggcactgacaatgaatgtcaaaaaattcaaaaattccccctgttttttgccaggtttccatccaatttgtgcaaatgc

SEQ ID NO: 26641 - DNA, 389 bp, Heterodera glycines
  misc_feature (151)..(151): n is a, c, g, or t
  misc_feature (158)..(158): n is a, c, g, or t
cgaaaaaaaaaaaaaaaaaaaaaaaaaaaaaaaaaaaaaaaagagaggggggggggggggggggggggggcgccccccccccccccccccccccccccccccccctcttttttttttttttttttttttttttttttttttcccccgccgncgtgtcnaaaaaaagagaaaaaaaaaaaaaaaaaaaagaaaaaaaaaaacaacccccgcccccccccccccccccccccccccccccgggggttttttttttttttttttttttttttttttttaaaaaaaaaaaaaaaaaaaaaaggggggggggggggggggggggggggggggggtttttttttataaaaaaaaaaaaaagaaaggaagggggaggggggggggggggggggggg

SEQ ID NO: 26642 - DNA, 1109 bp, Heterodera glycines
  misc_feature (1088)..(1088): n is a, c, g, or t
tttcagtcttgagcatcccggaattatttttttacccgaaagtccttaaatccaagggcaaattgcgcaagaaatttgatcaattactccccccccccccctcaatttcagaatcccactttttctattttgctttcgagaatgccgtctgtccaaattatgtgacggagaaattttggaaggcattgcgcaatttggtggtgccaattgtgttgagtcgaaaagtgatggaagaagttggcattccgaatggcactttcattgcggtggacgactttaacagtgtgaaagcattggcagaatatttgaaggaattgcaaagggacaaggacaaatacatgaggtaataggggtaattatggaaattgattgctcaacaaggtgtagttaggaaattgattgccctatagggggtaattagagggaaatgattgtaagtgagggtaattaatggggtgaggaaaattggacaaatggtgctacatcgaccgacgaaaaatgcaaaattgggcaagtgacgaaaacattcaaaaatcatttttaaattttcaatcatttttatttaaaaataaaaaaattaacacatttaaatattcattttaaactctttttcaaatgaagcaataatataaaaaaacaaaatattgtaaaaattaatataatttattagaaattaatttgattaaccaaatatccaaaaatatcttaaaagatccgataatgctaaaattcattgaaataagatgttgaagtcggggtaaataaaatagataaattttgccgtttataccaaatttgtgacgtttatttagctatttcaattggaccaaaacgtaccaaaagcatcggagtgggcatggcattcagccaccgctgtgccaattgtgcgaaattgcgcacaaacaaaggcacagcgacacattcaaaacgtacaccgttcaattggacaaattttggcccaaaggccaatgcgaacacaattttgtgcaaaaaagattcaaagacatctgacaaatggaagacagaagagaagaaagaagatgaagcggatagacaaatgaaaaagggagggacaattaattaacganaaaattacattttttaattcg

SEQ ID NO: 26643 - DNA, 1817 bp, Heterodera glycines
caccataactttttcaagaagattccaaattaaaaaatcttttggagcgccacgagagcccgcaacggccgcgagagggccgctttttagcgaaaaatttcgatgagtttcaaagaagcgggtgcttctagaaaaagttatagtgctgatcaaaaattgatcatttaaggtgttcaaagatttaaccaagtatatctttttcggtaaaagtcgtagccccatcattcaagagggaaatcagtagagaatggttgtgctctttcaagtgggcttgcccattttctctagaaaaaaattaaaaaatttgtcggtaaaaaaagctgggatcttgatcaagaaaaaaaaaataccaactcttaatattatgaacagaaagccaaaaaattaacaaaatttttatttaagcttaacagaatttaaataaaaatgtcaaaaaataaatatttttaagattattaatcaaaaaaaaacaaaattctattgggaaattatgtcaaatttgtttatattgaacaaatattgaaacgaaaaattggcagtgctattgataaaaggcaaaatttaaaagattataaatcggtatattcatcatttacgacaaaaattaaaacaaaattaagattttcaaagtaattattgtgctatcattcgttgcaagaccgagccgtcggggggcaaaatgtcggggccgggtcgggaggggggggggggagctcaattgtcgggggtcagggaccccgatcgggtagtgatcaaaattttattttaatgaaaaaaccattttttctttttaaattctcgtaaatcttcctttttgtcagtttaataatctgatttcgttagaagctggcctttaaaccagggcttccatttgtttttatttataagaatgctctgattttggagtagcgatgaaaattgtgctgatttcttaaatatacttataattttgaaattttgtggcataatgtcactattttatcaagaaatttaaactctgatgctaaattttttggtcttttgatcccaaatgtgaacattttaagaaaggaggcagaataattaaatattatttaaattaaatgtgcggtttcatttctgagtatttcctgaactgaatttatttttcatcaaaatctaaccattatgaaaattttaactgaattaaaaacaatacttttatagaataattgaaaaaatataaaagaaatggactcttaaattaattaaaaaatttattaaaatgttatgaaataaatttaatttaaattaatgcgacaagagttccaaagaataattcacataaaaatgagaaaacgaattagcattttactaatccgatcctttttacaagtgtgattttcaatgaaataaataaaattgttagagcaaggcaaaagaaataagtagaatctatttaaataagtgtttgaagaaagaatttaattgaaaatgtaaaaaaaaactctcaacaattcagacagagttttaaatgtttcaataaacctaaattttatatagcatttttaattaatttttaaaacaaaaaattaaaaattttgttaaatagtactcatttaaaaatttattcctttattaaatcgtttataataatattaaaatttctaaaaattaaaagacaaaaaaaaattgcagtcctctcacgaaataatacatttgatagattgcaattattagtccatatttgttcatttttaaactttttatccatatttcgagcttttatagtccatatttggcgttaccgggacctcggagaacagggaattccctttgaaaaattaaaaagataaaat

SEQ ID NO: 26644 - DNA, 707 bp, Heterodera glycines
actcacaaattgctgttactgtaatagtttatgaacaatacggtaatgaaagatgcctccccaatgcttttgctgcttcttcttccttttcatctcattttcccttttcctctctaattttttaaataaataatttttcccttttcgtttttctttttcaattgaatgattcttccataaaggacacttttcttctctctctttgtccctcctcctccttccccttctccttcttcttcttcttctttccctttttttgctttgttttcccacattttgttgctgaaattccatccttccctttttggagagggtcgagaacaattgacgaatgactgaatgaatggtcgagaatgaaaagaaagcaaagaaaggtgcttaaggctaacatctctttggcccatttgggcacttaaaatccgaaatttgttgggcgatgcttaaaatggcaacgggcggagggggggggggggggggtaaaaatgccgaagacgagccctttttggagttggagcacgggaagaaggagcatttgatcaacggacgggggagtggaggcgaagccgagccgagcaaacattgcccgggggcatcgcttagaaatgcatcccccggcaccaacgcccacttggccctttacttggcccttttccttccctttcatagcaattaaaaatttccgccccaattcttccaaccactttgcg

SEQ ID NO: 26645 - DNA, 1067 bp, Heterodera glycines
aaaaaagagatagccatttttctgggataacctctaaatataaaaatcctctgtgaaataaaatggcgattgtgcacagccctccgtctatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagacatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatatccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaattatcaaaaaagagatagccatttttctgggatacctctaatataaaatcctctgtgaataaa

SEQ ID NO: 26646 - DNA, 1615 bp, Heterodera glycines
cgatagtctcttgggaaaaaacagtggaaaatgaattggcataagattcgtcattatatcctttgtaattattcccaagaaatgaattgccgataggcaccgccgggaaaaattttgagaatttgaatgcaatttgttaacagatggttgttaaaaatgacaaaattttcatcaaatttttaagcgcacgcatttttagctttcataaggtttatcgtttctgaatccctcctaattatatggtcgaagcaaatttcaaaaatgcgcgaaaacacggcatatttatgcgggagatgcgatgtcaagctttatcactagggctgggaatttaagccaaatgacttttttttgctgactctaaatggcctttaaatgacttaaaaagtgttctaaacttgtttgaagcttctgacatgcattttttgtgatttttttaacttttttacactttttgggatttttatgactttttgagtttttgcgactttttcgtgattttttttactttttgagtctaaatttgaattttaatgaagaaaatgccgaaaaataaaatttcggccgataaaaggcagtgaaacttggatgaatttttttaatcaattgttggaagaatctctattttatgcacattttaggtacctatttataaaattaagtgtctaaaaatacgatcaaaatgttattctacaaattattaaatgggatttttttaactttcgcataatttttcaggactttttattttttacgtgttttttggattttttgtgactttttggttagtttttcaggacttttgaagatttttcgtgacttttttgtttttttatgactttttgtgtctttttggcgattttttatgacttttttagtcgactttttgaagatttttagtgacttaaattcccaaccctatttattaaaaaagagaagagattttataaaaataagaattaccaaggcacgaaactttttcattatttacatttcttgatgttaggaaaaatagaaatacttatagaaataatatatgatttcattaataaagaaaagtaatactttgacctctttaaaaaaactattttattttctaattattcagtaaattaaataacatttattagagaattaattcaatgaaaataatcaagactataaaaacttaaccaaaaggcaatcatctaaccttatttttctatcacaataatctataaattcatattatttttataaattaaatgaattagcaattcaaagagtaaaattctaataaatgttcatgtatgaaagttaatgtctttaattgaaatgaatgaatttgtgtcattataaacaatttaaaaaatttttagattatcttagaataattttgcctgaattaagaaattaatttaaatgtttaaagaaaatataatttaaaaaattaattagttaaatgcatattattattaaaaacaatttttcaatattattaaacatgcaatctaaaaatagaaaaaaaaaaactttgttttctacaagagaaagacattcatacatcgagtgtttttaattattgatttttttgttaaaaagaattaagttcggctaatagcttatttaaacttataag

SEQ ID NO: 26647 - DNA, 1254 bp, Heterodera glycines
aaatttaaaaaaatgtttatatatttatgtgttttatagcttgcgtccattttattcgcaagaatctcggctcaatttcctgttttttgtaagcctagggctcggagaaattttttgtttttaggcctaggagtctcggcaaatttctttgttttctggatgcccaagactcagagaaattttcgttttttttgtacgccttggtcttggagaatttctccttttttttataagcctaagtctcggagaaatttctcaatttttggagacctaggtctcggagaaatttcatgtttttttgtaggcctagatttcagggaaattctcaattttctggaggcctaggtctcggagaaattttaaggttttttgtaggcctaggtttcagagaaatttctcaatttttggagacctaggtctcggagaaattcctaaatttctaatttaaaaaaagaatttccattttttggctttttcaacttttatcacgtccatcatctttatttgaatggtacccaaaaaaagcttcaactcgaggggggaaaagcataagaaatgtgtgcactattttctattattttcacccctcccgcgccaattgtttcaaatttaaattttcgtcacaaaaaaataaaaaattttacgctttaagaatttccattttttaattttattcttttaattttttgacgcattatgaccatgaaaagaagccaaccaagtggacaaaagccggttgcttcttcttctgatgacgtcttacagcagcaaaacggcggcatcgccaaaagaaaaggtaaagccgcactttaacaaaaaaaaagatgatgatggcaatttggcattatttggcacatttaaaaacggcaaatctttggcattatgtatgtattatggtgacttcataggtgagcataccccggtcggccaccaaggccaaaaattacattccatgcactttttttgaaaataaaaattgccaatcgcctaattttagtattaaaaatggcacaaattttattttaccatattcttgcactaatgatatgcctactgtagcaggtaattaattagtgaaaagaaaacgcatcacgcttaacaaagagtggcgccgcttaattgtttttttttgaaagctatggcctacagtagaacaacctatttaagttcctacgatacttttacgccgtgctgaaaactgataaacaataaaaatttcaaaaaggttacataaagggggggggggtaaataag

SEQ ID NO: 26648 - DNA, 1552 bp, Heterodera glycines
aatttttattacgctttggacaaatctctttcgtttgttatatgtcgcattcaaaaatttcaacttttcgaagttttcatgtataacttttttgttaattgtcgaatcctgagctaaacccctaaaatatgcctgcagtaaatagttttatttcaccttttctatttcgcgaaatttggtaatcataaatgtaaataagaaacaataatggtcctgagccttacgccattaggcatggatactcgtctggaaaattggaacatttttaacaaagaatgttcgatttaaaaaaaaattataataattatatatagcttaaaaatttgtgtatcatattaataaggaattatttataccaatacaagaaagcttaggaggaggagattattcggaattgggtcaaaagctttcgcccagtgaaaataaacaacataaataaatttcttattattgggcgaaagtcaattgattttcgagttagggatttttagaatagggcatataattgagtttttccatatataatgaaattggatagacatcatagaaaaaccagaaaatatgtaaaagtggttggatttaaataaaatgttttagaaaaatgttcgggatatcatttaacgatgtattatttatgttagaaagttttgtaagtgaaaataaatttcaatagggatgtaagcgtcattgttctgaaaattctggtaaacgtcagaatgttctgtaaattcttgtaaacatcagaattgttctgaaaattctgttaaacaccagaatagttataaaaattctggtaaacgtcagaatggttctgaaaattctggtaaacaccagaatagttctgaaaaattctggtaaacgtcagaatggttctgaaaattctagtaaacaccagaatcgttctgaaaaattctggtaagcgtcagaatggttatgtaaattctggtaaatgtcagaattgttctgaaaattctggtaagcgtcattgttctgaaaattctggtaaacgtcagaatggttctgtaaattctggtaaacatctgaattgttctgaaaattctggtaaacgtcagaatgtttttgataattctggtacacacgggaggagggcgggggtgggggtggcgcaaagcgcccttcgtaaaattctatcctctgcctccccgttccccgcctctagcctgcatccctcccgcgccttcacgccccccgcctcaccaacgccgcactgatgcatctgcgcatgagctgctactgccctaccagcccggctgctgctcgaataaaattaatttaaaaataagcgactttcagaaattaaataattcaaattattttttgtattcattttaaatataatatatatgttaatgtttaaataaataatgaaggactcaaaaactcataataatttaaaaaataaattttagaaagctgaaaataaaaaaagcgtgtctcgaccatgaaaagaatgtcagggaacttttgacatatttgtaccgttttttataattagaagaaattaaatcataataaatttatttctataaaa

SEQ ID NO: 26649 - DNA, 1836 bp, Heterodera glycines
ccattttgacgcaagatctatatcattttgatttcacagcaaaattaaataatcttggtatgattttaagtggcttgatagcgcctattaacctgcaaagtttcaaaaaatttagctgagaaacaaaaaagttatggccaaaaaacctcaaaaaattgcattttcctggccattttgttggtcgaattaaaaaaaagttatgaatctttaaacttgtctgcgccaaaatggcctgcgccaaaatgaccccgacccttaaaattgtgtgtgtatttggtatttgttttagctgcgcggcgcggcagggattggaccgatgccaagaagatgtatgaaatcggtattcacttcaaaaaatatcgggaatacgtaatcatagtccggggtatcaaaatctcggggagagaattttggaaagcggaaagttcaagcttcaaaaagttttggaaatcgagaatcgatttgagcggtttgaaagaaaataattcgagagtcggaaagcgcaattccgagcttttggaaaacagaattcaaatactggacggagaattacgaggctcaaaaagtttagtttgcgcgaaaagtcatgggtcgcctcctcccatcactgccagataaatataaatcacaaaatgaggctaaagcctaatgaacaaatgggattaaggcaagcacgaaatacttaaaataaattaaattattgcaaaattttgtggcgcgctatttgcaaaaatttactgtggaagagaaggcatagagatttttaaaaaaattttttgcttaatttgttaacacacaaaaagtgttgctatgacgttactcaaaaaaccatcaaaataaaaaattttttttggtataattttgctcaaaagcaaccaaatttttaattcttgaagtcacattgattgtcctaagtggttttttgcaaaatttcataattttgttaattttcaaaaaagttattaccaaaaatgttcaaaaaaagttggttttttgaatttctcaggtcataactttatttaaacttaacgagtttttttttttgaaattttgcaggataatagaaaacacttagggctatagaaagataatcaaaattatttaatttgatttattttgggcgaagttatgagtaattttctgtcaaaaattttccatttgatagttttttgagtaacgacccggcacctaaaaaatgatttttttttcttttgtgttttttataatccattttcaatatttcgctgatttttcttcaccatttaaatcgcttgaattttttgaccaataaatcggtttacatttccgaaatacaatataaaacaaagccctggatttttagatttttcctgaattcaggatggaaatacatttgtcctgaattggagaaaggcaatttgaaggtcctaagagtttccagaaacttgtcctgaaatggagatggattgaaaattttcgccaaatttcctccctttaaaatctgaaattttcaaatttttttaggcttacttttgagaaatgtcatactaattttgtaagttaaaaattttctgcgttcttaaatgaaattccaaaaagtaacttttacccaattcaggtcgaatctaaaaacccaggacatgtttaatcgtttggatgatctttctccaattcaggatgaatctttaaaaattaaagatattactgccccataaaaggggcccgttgagctgaagcaacagcccccacattcattcattcctaattaccctttccaattcttttaattgtcattaaatttagcccggaatgaatattccttttggcttttctctctcctccgttggcatttctgct

SEQ ID NO: 26650 - DNA, 1200 bp, Heterodera glycines
agagggtgatattgatatttgaatacatatttagtgacctcttttgtgggctgatcgcagctccagagaatttgagaagcacgctaaagcttaacgatgtgccgcggtggctatgagagagggtgataattatatttggaatacaaatctagtgacctcttttgtgggctgatcgcagctccagagaatttaagaagcacgctaaagcttaacgatgtgccgcggtggctatgagagagggtgataattatatttggaatacaaatttagtgacctcttttgtgggctgatcgcagctccagagaatttaagaagcacgctaaagcttaacgatgtgccgcggtggctatgagagagggtgataattatatttggaatacaaatttagtgacctcttttgtgggctgatcgcagctccagagaatttaagaagcacgctaaagcttaacgatgtgccgcggtggctatgagagagggtgataatgatatttggaagacaaatttagtgacctcttttgtgggctgatcgcagctccagagaatttaagaagcacgctaaagcttaacgatgtgccgcggtggctatgagagagggtgataattatatttggaatacaaatttagtgacctcttttgtgggctgatcgcagctccagagaatttaagaagcacgctaaagtttaacgatgagccgcggtggctatgagagagggtgataattatatttggaagacaaatttagtgacctcttttgcgggctgatcgcagctccagagaatttaagaagaacgctaaagcttaacgatgtgccgcggtggctatgagagagggtgataatgatatttggaatacaaatttagtgacctcttttgtgggctgatcgcagctccagagaatttaagaagcacgctaaagcttaacgatgtgccgcggtggctatgagagagggtgataatgatatttggaagacaaatttagtgacctcttttgtgggctgatcgcagctccagagaatataagaagcacgctaaagcttaacgatgtgccgcggtggctatgagagagggtgataatgatatttggaatacaaatttagtgacctcttttgcgggctgatcgcagctccagagattttaagaagcacgctaaagcttaacgatgtgccgcggtggctatgagagagggtgataatgatatttg

SEQ ID NO: 26651 - DNA, 1207 bp, Heterodera glycines
cccaattttgtgggccaatggaccagtgaaatattggggttagacgggattgggctctcgaggaaaaaccggaatacgaaaagggcgcgattccgggaccaaatccggtcgggatcgcaatcccatctagctctcccaaaacctatgtctcctctctcccgctaaattggaataaaaccagcagttgatgagcatttatttgtgtgtgtgtgtgtaggttgccactgaccactttttccacaattttgagtagccgagtccacgcgtcgaagtcgtactggtcctccttgaccgctttgagcgcctgctgaagcatcgcttgttcaaatgaatttgttctaaacaaaaattatttcaatttcaaaaacaaaagcgcactaattgagatggaaaagtttgttgtccacgacatttatgaccaaaacttgcaaaaaattgtgggttactattacattttatgagtccaatttcacgagagccaggaatgtcatttgtgatttgaactcataaatttgtaatagacccattatgtctcggtgccagagtttttgccgccctcaaactttctgatagtcaacaaaaacaacaaacttggttccaaatccaacattgttggtaacattcgaaagctcttcagatgctctataagctttacaaaaaacaaaaagatttagagcctgtaaaaaattttattaggaaaacatttcaatttttgactttttcgcaaattgcatgtggatgccaaagaaatgttatagccaaaagataaatttttttgatatctgcccacagataattaacaagtaccgttagaacttggcctcgttttcctgggcccaggtccaaaggtctttttggcagcatggctttttctgggtctgctttttcccagaaaattaaggccaagactttttcaaaatgctctctgtccatatgttttgcaagccgatgttgaatttggaaggataccaagtttgtcatatttgaggactattacaaaagtttgggcaatcttgtaaaattcggccggttgccagcccttcttttggcaaaaattcatgccacttattggactgatacaccaagtcttgccaagattgtgtcccctcactccgtttatttaaaaacaataaaattcgaaacccgtcatcgcgttctcgactttcgctccgatggcgatggtttctgaccgggctgatgctgacgt

SEQ ID NO: 26652 - DNA, 1708 bp, Heterodera glycines
attgaattttacctgaaaattttcgaaaaatttttggtatggaaatggcctaaacaccttagtatggaaattgcggtatggaaacggtggcatggaaacggccggtatggaatggaaatgactggtatggaaacggcggtatggaaatggcggtatggaaacggcagtatggaaatgggtcgagctaagaatttttccgaaaatcatgaaatacttaggcgcctaggtattattttctttgactcgccttgctttgcttattttatttcttcatatgcatccatttgtcttacgtaattttctttctgagaatgattggccgccacttcgcctttggacagatgattatttgacagaaaaattagggaaaggacaatgtttaaatgtacgaattggtgaaaagagacattttcgtggaaaggtttggttgaaatttccaaaaactataaaatataaatgaaaacgttaggttctgcacgagcatcaatgtgatcgacatacttttgagaatagtgcttcaatgctcaaatggatgaaaagtgctaatttcggccctgtcaatggaaatgaagagacttcatcggcatacccaaacccgaacacacactgggcctacttggattatcgggacgtacttgaactgttagaacaagacgaagctcaatatgttgattggtcattgttggggatgaaaaacgcaacaggggagggcgaaaactggcgtaattccactgtttggatcggtaagaggcgcagattaccaaagcaattggtaattctgtagcttgtgtctcaaaacaagtttcatgtggttttctgggtcgcgatcattaagtcggcatcaatttcgaccaatcccggacacgaatttaaataaaagatgaaaaaaaataaaaatttaaaaaaagtattcaaaaacttctttctagggctctttggggtcgctggtcgcgaatctgacattcatttctatcaagtccgaaccccagacccgaattcgaacagaaattagaaaattaaaattttcaaaattctcactacaaaattgatttattaaagaagcaaaaattagtcataaatcatcaaaacacggcaatggtgtggaattgcggtcccgacggaaaaaaatattaaaatttcaaaaagcttttttctagggtaaaaaaatttgctgatcacgaatctaaactctgattttgaaaaatcattgattttatctatgccttttcatcaagtactagattttttccaaaatattaagaaatatttcggtgtaaaaaacccatatacagatgttctagagctttcgaatgagctattgaatatatggagaagtcaagtttttaatttttttacaattttttgaaatttaattattcatgcctttaagagtcatatgagatggggtgtgggttcgagcccgcttggctgcggtttattttttatgctgattggtgaaaaatcatagacaaaatgaaggattttgaaattttttttatcctaaactcattggaaagaaaatactttaagaaaattaaaatttgaaaaaatctagtcttgataaaaagtcatagaaaaaagggctcaagtacagtttatgcgtccaatggacttttgtgcgtccaatcgacttttatgcgtccaatcaatttttatgcgtccaatcaaagtttatgcgtccaatcaaatttttatgcgtcgcaatcaa

SEQ ID NO: 26653 - DNA, 1658 bp, Heterodera glycines
tgaccatttttaagattttcactgaaaattagcctttaaatgccttatgtgtttttaatcaattctctacaaaaataatttacatatgataaaataatttaaaaaaagcacataaattattattatgaaaaataaatatgttcaagaaaaaattttataaagttttttggctatatggcttaaggcaaaaattgaaaaacccgaccccgaacgatttggcaaccccacccccgaaccccgacgattccaaccccgacaaccccgaattttccaaccccgacttcggggttgcaaccctagttgaatagtccaagtcacttttttatattttcctagaattattatttgtgatagggaaaaattagataaacaagttttcttacaagctttttttcaatccatgtggccacgtgcgaagagatttcttgtagcataattccaatagcgtgcatttctttctgaattttttcagctttaccagctgacgaaatatttgcgcattgtgtggcaataacggtctaaaacagataaaaattattctaatgttaagatataatttataataaattcttttcaaaacatattattttcatacggttttcatcaaatcgaggcgaacaatttctgcaaaatggaaaagttgctcccgtcgccaatggtttccttccataattgtttttagccaacatctaagaattttaatttaattgtgaaaattttaaaatctcacaagttttcgtcttcgtacaaacgtcgatgtaagattttaatttcattttcgacttctcctgtctgctcattagaataaaagactaaattaaaaatgttgtgtatcggttatattagggcccggattttatggataaaaaatccaaaatatggttataatatggacaaaaacatgaaaatattgactaataatttcagaaaattggattgaatttttaaaaattcataaacccatatttttttgtcaagaaggaaaaaccattttaattcatgaattatagaatttcacaattgagaactataattcttatttattatttactgaaatattgaatttagaaaaattgcaaaaattgtaattttctttaaaactcatttttatacaaacgttattaataaaaaatgtttgcacaatttttatattttttcaaaatttttggattttatgagcgtatcttccaaaattttccatctttaggggatgaaattctcgatttgttatatgaaaatgccaaaatatggaaatatggacaaaaatccgaaatatggaaataaaatgcatcctaaaacataaactaagcaaaaaactattcatgtggtattaggccaaaataatgtgcaaaaaaaaatatggaaatccataaaaatcagatctctagttaaattttatattaggtcaatgaaagtaaagttaaatgattacaattttatttagcataattactttttttaagctcttccgaaacaaagacccatgaagctttggaaagaattgcttaaaataatttagctttttatttaaataatatagatttttgtaaattttttattatataaaatatttttttctagattcttacattgttttatcgcagcatattcgagcgaagaaaaggtaaaatttttatggtgatgcttttcatctgctg

SEQ ID NO: 26654 - DNA, 1250 bp, Heterodera glycines
ataattcaaatggataaagacgaaaaaatcaggaatatttttaatattttgtattcttattcgcaggacaaaggtgaaatatcagtacacatttgatataattaatgaattaggtgccaaaaaacacgctcaatttgctgcattaaggctactgaacagaacaaagagttggcctgttttatttggcgatgattaattttaaaactatggcactactgacataattaggcactccttaaaattcatagtgaaacttctgcttttctaggttataatcctttttttttgaataattttataaatataaaattaacaaaaaatccaattaaaattatgacggaattttatttttttgagcattttaatttgcgtatatttgctttataattattgtttttgtaaaaactctaaaactggcaatgctcatttataatttgatgacggaaaggaaaaaattgaaattataaaaaaaattcacttcaatggtaaatgaatataaagaaaaaagaaaatattcacacaatgaatggaaccaaaattatgccaaaatttgtaagaaaatcggagttagtcaaacaatcattagaagatggaagaaacaattttggaatgaacaaatttataacggagaaggaaaaaatgggaaaaataaaatttattggcaaaaaaatggttaaaccaaaaaatgagtgataaaaaaaatgaaaattgatagaacgacaatttttagatggaagaaacaatttggagataaaatgcaaggaagattgatataattatgatgcgatttattttaataccttttgtttttttcattgcaatttgtgaggatttatttttcaaatttgtataattttaaaattgttgaaaagtaattaattatttcgtgaaaaatcctaaattgaattaacaaataatgaacttatttcgcattgaattcagctgcccaaaacaatcagctgatgagtgcccccaaattcttagctatttttgtttcaatttttttccatccttttgctgaatattttcttcctttttgcttaattttctcttttattttataatattttcttattatttcccgtttcttctgttcattttgcgctttttcttcccatttttctccaagtatttcgccaaaatgacttttgctgtaattttttattttctgattcaattggactaattagagcaattacaattaaaataaaacagaataatagtaataatttcatttttctggaattata

SEQ ID NO: 26655 - DNA, 1076 bp, Heterodera glycines
  misc_feature (35)..(36): n is a, c, g, or t
aataaaccatcagctgatataagaaaagcatgtgnntctgtccttttcctatttatattgccatttcggcatcggtctaacaaagctgcgcatggctttgggaaattcctcaggaattaatttttcgttgtctaaagaaatgcactagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgtactagtgtcgggcattttgacattaaaatgccattaaggcaccgttgtagcaatgatgcacgtggtccttggaaattcctctggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcactagtgtcgggcattttgacattaaaaagccattaaggcaccgttgtagcaatgatgcacgtggtccttggaaattcctctggaataaatccctgaatttcttctattttcttatcactaacaaatcactgggggaaaattaagatgatactgatgat

SEQ ID NO: 26656 - DNA, 644 bp, Heterodera glycines
cctcctctcccttccttacccctccctccactacctttctatccccttcccctctcctcccatcctcctccccctctctcttcctcccaccccctacctactcccgcctctccctctctcccctcttattcatttcttccatccagtgggttatgagaatactcttgtccactaatattttcttttgatgcgatcgatcggagacctctgttaacagaccataatcacaaccaattggcagcaaaaggcgttttatgggacgccttataataaagactatagcttaaaagaccaaatctgtccgatggttttgagaaattaaaaagagccttcctcctctgtctattaattcatatttaattggacttctagtaaccacctcactcatatttgaaagagaccgttatgaatgttacttttattcccaacggatcgaatcaaatttgaaaatgtcccaaaaagactactgaaaagatgtgctgacactgggctggattttgatgatgatgtcctgaacatttgcgaagtgttcagcaaaggctaccgaagtcacgttaattgctcttctgtaaccaaaagaacaaaaaatttttttttgaattttcgtacctttagagattttgcccggttacgttgacgtccca

SEQ ID NO: 26657 - DNA, 1851 bp, Heterodera glycines
tccttcgcttcgaggattttctttacgttcagaaattttatgtcaatgcatccaaattggctgcttcggttatttcgattatttctttgacctttcatccccactttttcagatttatttggatatgattgaaacacctcaaaagtttacggacaaagtcactgaagaagaagggaatataagcgcagcagagatgaaaaagatgcgaagaaaagcgaacaaagtgaaggcggtcgaagaaaaggcgaagcaaaacggacaaattcaggggaaacaggtgaaacaattgggaaatcacaaaggatggaaacaattggaattggtaatttagaagagacggactgacggtgaattggatgtgatagagcccgaaccattggatccgaaaaagttggccaagcccaaaaatccgctagatgaagcagcaaaattcatccggcccatcttacaaatgccgtgcaaagacgtggatttatgggtggtcgcattccgggtttatttccacaagaacaaagtgaccgacctattttaacattttgaagaagcaattggacttctgttttcagctgctggtcatgttgcaatgccttaacaaaatcgtcactttggatccgtcaaatgagaacacaaaaaagctttttggcaaatatatggaaaaatgtttgttttttgtcgatgattctgtattttaaacccccgggaaaaacttcaaaaattttaatgtcaaaatctgaattgatcggagtgaatgtcacattcgtgacatgttcttccttaaaaaaattaagttccattaatttttttagataaaactgcctctggcgatcgtgcgacggatcagctggtcaaagaattaacccggtctttttccgcaaggattggttttattgccgacagtgaaattgacagataggaaaagcctgctcaccgacatttattatgcttgttttgttttaaatgcaattaaagaatggtattataaccgatcgattgtttatgttgtattcattgttgtggtaatatgaaatgtaatacctaaacagaaagaatatttttagttctgttttttgttttatggcattttggctttgataaacactaaaagcgggtgaaaccgatggtaaatgaccgtgcagagggatttggaagaggcgattcggggtgacttgtcaaatggtgaccattcaaaaaataatgtgcttttttaaggggcagggcaacagccgagcggtttttaccgtatgtatgagccaaaagaggtgagtgtgtgcaaatcgtaacgaatccgatttgattacaacatggaattgttattgaattggccattgtcaggtgatcggccggggactcgcttcggttgtgaggcgttgtgtggagaaaggtgatttagggagaactgctgaaagcacatcgaaacgatgccatttttattttgaagagtcgaggaaggaatacgcggtcaaaatcgtcgatctgagcaccgaacgacagtccgaaagggaagcgaagcgcctaagcgaagagactttttcggaggttcgcctcctcaaattgttgtcgggccatccgtccataagtacgttcttacgccttcgtaaatttcctctgatttttctgcgtttttcagtttgtttgcatgagttctttataacgacaacatttgtatttgccattttcgagttggcacgctgcgaattgttcgaagcgttgaacaaatcggtgacattcagcgaaaaacggacgcgactcgtcatgcgacaactgtttgtattgttttatatgaagttgaaaatgttattacgtttaggttcgacggtgtccattatttgcactcggttagttatttacaaa

SEQ ID NO: 26658 - DNA, 1176 bp, Heterodera glycines
  misc_feature (65)..(65): n is a, c, g, or t
aaaatgatcaaatgattatcaattttatttttctaattccaaaatgaattcgaaacgcaaaaatntaatcataattcatgtggtaaaaaatgcatttaaaaataaaaaaaattcttgaatttgcttctgaattttttaattttaaatagaaaattactttttcgaaaattttgcacaaataagaggcggagaaattcaacgaaatttttattaggattttgatttaaaatgttgagaggtttaacaaattttgatgttgagaggtttaacaactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttccccactgcacttctttcttcggtttaattacccaagtttgaggtacttggcgtgtcctgcccataatatctgtggcatggaataaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattactttttcgaaaattttgcacaaataagaggcggagaaattcaactaaatttttattaggattttgatttaaaatgttgagaggtttaacaaatttgtacactgaatgttggatcgtcaacaccaatgagaaatgactaacagaaaagagggagaaaggcgttggcttaggaaaatagcttataataaaggagagacgagcagacgatgagtgagagaaaaatagtggtaaaaatggtcaactgctgcattggcagagtcagagaggggtcacaaagagttcgcacagcatcgaatatttccttcattttgggcgtcattcttcccactgcacttctttcttttggttattttacccagtttgaggtacttggcgtgtcctgcccataatatct

SEQ ID NO: 26659 - DNA, 1259 bp, Heterodera glycines
  misc_feature (66)..(66): n is a, c, g, or t
gacaaatggcactccaacgagacgttacgattcattgtttatagaaactccattctttgttcgatntaaggttcaaattgaagttgagacgatggacaaggccggcggattcattggctatatgttcgtgccggtcttaggcgagaaaggaatcatccataaaaacctttccgaactgcttgttgaggctggccttgccagtgtgcatttcactgctgatcggtcttcctattacaatcatttgttggcagcggaaaaaagcgcaaaaggcgcgaaattgggcatttggaagcattttgacgaaacaacgggcggtaacacaacgacaaatcacgaggaggagcgacgaaagcaggacaacgatgcgtcagaacgcaaattgcagtttaagaaagtgctggccaccgaaatataccctggcttccggtttgctgctcagtactttgacgatggttagtttttggggggaggggtaacaaaacatggacatttgtttattcaaggaccaaccattgaaaaactgatgcaagctcttcaaattgagatgaaaggcgtgccgactggccaatttgttcccaaacgacaacagatttgtgccgccaaatacactgacggcgacctttggcaccgagccaaagttgaggctcaaaagggcgacaaaattgacgtgtaagaaatagtctttaaaaatttattttccactgcttttcagttattacattgactttggcaatgtgagttctgagcattgtttcttttactgttcgactgagaattgacttttcagagagaagccctttcactcgaacgaattgcacctcttccaccccaattccattctcagcctccactggtcaaagaatttcaattggctcttattgcaggtgttaattaacataaaaataattaaaaatgatttttggtggataataaatgtcttatggattaataccggttttttactagaaaataatataaaacgctttgaataaatttatataacttgcaattcagaagttatgcttaatttgttgtcactagggttccaatttttaggctctaaaaactgccaaaataggtaggctctaggctctaaaaaaccccaaaaataggcactaaaaacctcatttttaggggtgtaaaatggcaatcaaaaaagtaaaaaattaggccaaatcagtttgagttaaatatttttaaaatcacaaattcttgtcaataaataaataaataaattttggagaaaaatttttgaaaaa

SEQ ID NO: 26660 - DNA, 1987 bp, Heterodera glycines
  misc_feature (62)..(62): n is a, c, g, or t
ttaaattattaaatatattattgtgttagtatccctcaacgaagataattaattataaattnttcaataaaattaaaaattgatatataatcatgttcttcgtacaagtattatttcggttaacataatgaattgcatttaatagaggcttcataatatatctttataagcgtcagtcaaatcattataattttgtttaattctagttctatgcaggttttatctttcatattcttttcaaaggattttttaacaaattttattttaatatttgattataattattttattcaagtgaataagtgatattttatattatctaataacttattatattaagattaatccaatgtttgatcataaatatttatattattctcagtttaaattcttgatattagtgtaattttctttatttatatttcaataaagatattacaatccaaatttcacatgaagcacctttcttcactacactgcccggaaaattaattgagaatgagaagaatctcagatcaggaccacagacgccttgagcattaagtgaatgatgccctttacgatcatcaaataaatgttcatcattgcttggtgcaacaattgtgaaaagtgaaccatcaattgccccgcagcaattaacaaatcatgtgggttaaactaatttaaaaattaataatttttaacccggtaagtttccgaatcgtcctttggatttatgaaaaaattgagtagcaattaatcgacattcattctcgtcatttggccatttaatattttgaaaattatttatgatagcgttttcgacggcaataacacaactgtgtgccgttcagggctggacgtaattacggattacgtattacggattacggaaattacggcctttttggagttacggattacggattacgggttacggatttttgggatttttccgtaattttgatccgtaactggctttttagattatttttcgagactatttcttgcaagattattttttataaaatgaatttttttttctatttttattaaaagactacccatatttcgatttaatctgacttattcttggtaatttgtagtattattaacatacataaagggggggaggaggctagcaaaggggaaaagaggaaatactaaaaatttggctattttttaacaaaattcgttaaaattctgaaaaaaattttcctcggcggcgcttatcggcaccgtccgccccaaaaattcctaattatttttaaatattagctccaaaatcttagtcatttttagacaaagtcttatagcaaattgcataaaatttttcaaaaatttttccggcggcgcctttcggccccgccctgaacaaccccccccccccacattccccagttttttgggaaaagcacaccgcgaaaaaaactatgttgggattttcacctcaaaaaaacaagcagatattctgatcataaattaatcttaacaatttttagattggattttttaaatttaaaaattttttaaattaaaaaaaaattttgaaaattacggattacgtattacggattacgccaaattacggccttttttgacccccgtcatgacggattacggatggccgtaactgaaaaaatcgccgtaatgacggattacggatggccgtaactgaaaatcagttacgtccagccctgttgcatacgccgagcaaaaatggccaaccgaaggagttttgttgctcgcattatctttaatggaaataaacaattggttcgacaatcacaaacagcagcaggtggtcgacaacaaggataatatttgctttcacaatttctgcttttgtcgacagggattttcgagactaaaaaaagtgtcccgtttttccttgaccgcgttggtcctggcttttccgcccaaaaccaatcccttacagcagcagcagtttatttggttgcatgcatacatattaggcgtgctgagtcgaagcacgaaaatgcaaagt

SEQ ID NO: 26661 - DNA, 2525 bp, Heterodera glycines
  misc_feature (1678)..(1678): n is a, c, g, or t
agctttacaccttcgataaatcaagtgcggacggaactagttattttggagatgcgaatacaagaactcctgcaaagggagaatttggacggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatgtgccatctccagctggacttttggttacgcaggatgcttcaaaactggtactgtttagtcgatgatatgaaaagcaatcacaatcttaaggtaattaaaagggcacggcacgaagtcaatgcaccacctgcggttccacaaagcgttgaccagctgattgttcctcccgcttaccagacgtacgagtcaactgacggcgaagtggagcagtttctgttggctgactctggtgtgtattacgaggccggaaacgaaaacccgcagaggtaatttttttttaaaactataatccattttaactatttttttcaaggattctgctgtttggacgtgaatctttcgggcgatgggctgatcgaatgaaagactgcttcggggacggcacattctcattggcacctccgatgttctatcaaatctacacaattttggccaagtgctgttttaatttgatttcacgtgaaaattgttttaaggcgtgggtcgtgggttatcgtcgtgtgccattgcttgctgacgtccaagtcgcaagcgtcctacgagaggatgtttggacttctccgtcaagcgtggccgacattctcgcctgcctcgttcaacatggacttcgagacagctgcgcgcaacgccgctgttgccacgtttcctgcatgcgaaatcaaattttgcttcttccatttcgtgcggaatttgcaaaaaaaaatcaaggaacaaaatctctggcaggtcagtaagcatattcagtttgtttttgtaattttcgtgtctattcagagatactgtactgacagtgttggctgagaatctgaggatgctcacttctgtcgcgtttctaccgctgagtgacatcaggacagctgtcatcgcattagacacggagtttgggaacgtcgcggcactccgaccgctcattgactggttggtctcatcattatcagaagtgtacttcaatttttgtgcaatttttaggttgctcaacaattacattggacaaccgcggccaaatggaacttggtctcaaccactcttcccaccagaacaatggaacgtctcgaactctgaatggagaagcaaggacgaacaactacgcagaggcagaacaccaccgtcttcaaggcgccttcaattgccgtcatccatcgatctggcacttcattgacgttctccgccgtgagcagaagggcaccgatgggaagtatgcgtcatttattgctggacttgagccaccgaagaaagctaagaaataccaagcggctgacgagcgcatctttaatttggtgcagaattataatccggtgaatccaaactatgacaatgatcacaattaccacataaatcaaaatcatcatatcattttggaatttcttcgtggcatttcgcgcaattatcatatgaacccctgaattgttgttattttttcattttgttanattttacttatatttgaaaaaaaaatctttttcctttttttgcaacatttttgaaatttacgtctttccctttttaatttttggcttcgcgccaaaacgtgggcgccaaaacgaccctggcgccaaaacgtgggcgccaaaacgtgggcgccaaatcgtcagcgccaaaacgaccctggcgccaaaacgtgggcgccaaaacgtgggcgccaaatcgtcagcgccaaaacgtgggcgccaaaacgacccagtcccctccattcaaataattttgtcatgtttcagctggatttgcaacgacgtttggctgaatgttctccccttttttgaccgttcccaattcttcctcaaattggcattgctttcttaccgtttcaatgctttggtggacaaacattttgatggaagaactgaattgacgcttcggagatggaaaagaattcaaggaccaaaaccgaaagtgtctgtatttaccggtggcggttttcccgaatttcctttgccggaccgtccgcttcccaacggaattcgctttaaggacctttacatacagtaattttaattttttgtttaagtatatataaagtcatttcatatttcttcaggtacattgaccactctgtgctcgcatttctccgctcaaataagcacatttgggacagaggcacaaaattattcattcgagtaaatgaatttgaaaatgatactacggagatttggaatgttttggtccgtgaaatttggcccatttttacggagacgacaaaatgccatcattttccccatttacaatgctgatcatctggccaatttgcttcgtctcacatcgccaacaattctctccgat

SEQ ID NO: 26662 - DNA, 1264 bp, Heterodera glycines
actttaattctgcgttggatttttgctccccataattgtctcccgtaccccaaacagacacttgaaaaaatcgatttttttgttttcggggcagtccccccgaaccgacgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagagctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgatggctctagtcaatttttcaaaatttttgttgaaatatttgtcgtgctctgaagggcgtgggagggggggggggggggggggcgaaggcccaccacgaggccgcgaagaggccgagagagtaccttcggtgcaggaaaattattaaattttaaaaat

SEQ ID NO: 26663 - DNA, 469 bp, Heterodera glycines
aaaaataccaagaacgcttgaaaaattttccatttgcggcaaggtgcctggaattttttaggcattttgcaaacacctttttttagctatttttattattttttgtaactttcagcaatttcgtaatgacgtttggctggacattttggcaattgtgaagattattggtcccacaaaaaaaaagaataaaaaaactaaaaaacatgtttttaggggttatttgatgcgctgagcacgaatatgacatccatttcgaccaatttcgaaccaggacccgaattcgaacaaaaagtcgaaatttaaattttcgatttagcacttttattctaaaattgactaaaactagcagaaaaaaaatcataggcaattttaacagcaaaatgagtcattctatgcaaattaaaacatacccagaagtaaaattcaaaaaataaagactttcgactatgttcgaactctggtccggggt

SEQ ID NO: 26664 - DNA, 1398 bp, Heterodera glycines
ggctgcgctgaaccccgaatttgatcccgccattgtcataggagcccaatattttttttagtttcgaggtggctttaaaatgaggcttttgccaaattagctctcgagactgtagccagacggaagcagggcccagccgttcgtccagttgactttttacagaagtttggggtggtatttttaccaatcagttttttatcctgtttcgaggtaggctttaaaatgaggcttttgccaaattagctctcgagactgtagccagacggaagcagggcccagccgttcgtccagttgactttttacagaagtttggggtggtatttttaccaatcagttttttatcctgtttcgaggtaggctttaaaatgaagcttttgccaaattagctctcgagactgtagccagacggaagcagggcccagccgttcgtccagttgactttttacagaagtttggggtggtatttttaccaatcagttttttatactgttattgatcgtatccaactgagaatctgctgaatggggtttttggctgcgctgaacccgaatttgatgccgccgttgtcataggagcccaaataattttttaggaattttattgtacctgtttcgaggtaggctttaaaatgaggcttttgccaaattagctctcgagactgtagccagacggaagcagggcccagccgttcgtccagttgactttttacagaagtttggggtggtatttttaccaatcagttttttatcctgttatcgagtagtttaaaatgagaatttgccaaatgggctctcgagactgtgccagacggaagcagggcccgaatttcgtccagcctttttacataggagaccaattaattttttagtttcgaggtaggctttaaaatgaggcttttgctaaattagctctcgagactgtagccagacggaagcagggcccagccgttcgtccagttgactttttacagaagtttgtggtggtatttttaccaataagttttttatactgttattgatcgtatccaactgagaatctgctgaatggggtttttggctgcgctgaacccgaatttgattacaatcaataacagtataaaaaactgaaaaaattatttctaaaatttcgcgcactttcagtgtcctttatttcccgcactaaaaattggggacccaaggctttggtttttgcaccaaaattagtgaccggggactcctttcatttttaatcacttttccgagttttaaaaatactctttttctctaattctctcctctctcctatggtgaatgcgcatctcagagtaaaagatctgcatgttttttgaggtggaaatcccaaaatatgggcctaaaccgggagaaaaatagcaaaaataggggtaaaaatggcagattc

SEQ ID NO: 26665 - DNA, 1467 bp, Heterodera glycines
  misc_feature (39)..(39): n is a, c, g, or t
  misc_feature (53)..(53): n is a, c, g, or t
  misc_feature (88)..(88): n is a, c, g, or t
  misc_feature (122)..(122): n is a, c, g, or t
  misc_feature (950)..(950): n is a, c, g, or t
aaaaacgaaaagttttcaaagcctgtaaaaaatttattnaagaaaaaacttcnaaaaatttcgacttttcgcaattttcatgcatacntgttttgataattgtctaatcgcaaagcaatacnttagaaaaagcttctaaatagattaagctttcgaacgacatcaacatgttggatttggtttacaaagaaaaaagttatagccaaaaacatgctggcgccgaaacgggagcgccgaaacgcagtggacccggtaagtgaatatcataccatttagcacaaatttaatgctttttggttcaaaaaatttattaaataatatggcatagtgtttattttttaaatttaatttcagtgacgaaaggttcagtgacgaaaagttcggcgctacttgtaaatagtacttttttgaattttatcaaaaacaaaagggggaccctttcgttttgcaaaatttttttgtgataaaaaaccatgaaaatttgttatccggggtcttagaggtcgctgattatgaatctacgcataaactgtacttgagcccttatttcttatccccttttcatttctttcctatcaaaggtatgcgcaccaagcaaaatgtgcgggaaaaagttatcaaatcactccttcatggtgacgggacaccccaaaatacagtgaaaatcgggcaaattttagaagaagaaaaaaaattcccatgggtttttttgaaattaaatagacccattggaaagagcacaaattctctacaggattgccttttgagaatggtggttctatgacttaaacctacaaaacttgcattttctgtggagaatttgtgctcgtttcaataataaaattttgaagaaaaaattcaaaaactaaaatacagtgaaatcgggaaaactttcgaaaaaattcctaggggttgggaatttttttttgaaaattttgattaggcttatnggaaagagcccaaaatttactaccgctttgctttttaatgtttaatctacgtcttatacccacttaggtatggccattttatttttgatgatggttatttctactgtaaacactgttttcttaagaaatacagtactttttgtagactccgaaattgattttgatcagcataaaaagttatgtttgcatgaattatttcagatttttctgtgctctcaaatttgagattcaaaaagtggtgttaaacatatgcaccactgaaaatggggtatggtacacaaagtcaactgtaattcgggtttgaaccgatatttgcttaatgattggtatcattcgaaagcccattaaaaatgctacaaaaaatgtcaaaacattttggtcatcaccaaccatttaactttttataaagccaaatttctcgaaaaggctagtggtgttaaacttatgcacctgactgtattgtgtcaaaaattaaaaagataaatacctaaaaactgtattattattattttttgcc

SEQ ID NO: 26666 - DNA, 1416 bp, Heterodera glycines
  misc_feature (1372)..(1372): n is a, c, g, or t
  misc_feature (1379)..(1380): n is a, c, g, or t
atcagaccattccttcacggtaaatgcaatattccttaaatggcttaaaatgtagatttcataaaaaaattctattgaggctaaaaaattggctgttaaaattttccgtgaaacgtgatgcggaccgaatgtttttttccctaaaaacttcccggtttcagcgcattttggagatattgatcttcatgaaggaaagatctgatcatcttcggtgtgattagaatttttgattgtaaaaaaatatgcgtacaaattttttcaattttttaagtgaattgtagatagtgccgaatttggggccatttacagaaaaaattcattatttattttttttatattttcgaatttattttaatgttttttttaaagaatctgtgcttggtaattcacggaaagtgttcaaattcacgaaaaattgagatgtattatatttgatacgaagaatatatatttatcatcagaattatatatagaaaaaagtttccacttcaaaaaactatcagaaaataatatgaaaaatcattaactttatttagggttacatgggtttgacccgaccgggtccagactagaatacacggctttttcaagaaatcattcaaaaagaaaaaagaaaaaccgtgttcttataaaaatctgttgtttatttaaaaaatttaagcatcaattatttttgccaaaacgcatcaactttatttttttaatgggtaataaaaaacttattttttttcaagatttggacccaccccattccatacaaattagtcatttgccttacgattgcataatgcgcatgggcagccagctccatccagtcccttttttgtccactgccaatgtcatgtttctgcagctgctcgtttagccattgaacgaaacgctccatttcttcaggtaccttatccggatccactgctcgatgttgtccaaccttgattttttatgtttaaattaatacaaaaatttatcacttctaatttttgcctcaaaattttattgtattaaaatatttaattatttagaaaagctgtcgcggtttatttatttccctttaaaggaattttttaaggttataaaaagtcaagcattgtgtgggctgaaaatttaaggaattcttttaaagtcaaagaaagtgttttaacaaagctcactatttaaaaaaataaattcttcataataaactggtcctcggatacggtacatcatatggtataaatttaaaaaaatgcttgaacattctctaaacgcagttgcactatgcgccttaagtaatcaaacaaaatgaatttttaagaaataattgatactctacttagaaataagatagtgcctctatttaactttgttttctttgttgtcataatgttttatngtattannatcatcattgaaataaatcgtctataacctaaacag

SEQ ID NO: 26667 - DNA, 1719 bp, Heterodera glycines
ccgtttttgttgcataaatgtgaattttttgaaaattgaattttcgagttttcgtacgagtccgggttcggggttcgaaatgggtgtcataatctgattcaccgtcctttaaaaccatttattgtgtgtttttatttttgggttggcgccgaaacgtgggcgccgaaatgaccctttcccgctgaattgtccttaaaattaaatattacaccttttacctcgttattcattgacatttgaaaaatgtattagcaataagcaatcttaaaatttttaatttttgaaacccatttttgctaaaatagaaatttctttttttattttaaagcaataaacaatgaaattgtttggaaaggtcttgttgtgcggttgaaacgcacgctcaacatttataaagaaaaattcaattgtttttaaaattaaatttctgaaattaattttaagtgaatttttttttacgaataaccaccattttataatttgcgattttgagatgttgttttcccaggatggcatttgcacctggccatttttcgaaccctggaccagcattttttacttccttgaaagcgaattattttttattttttaaaaattccaaaaattcaattcttaggcggtgtattaggcttagttccaggtccaggctatttttcggcaaactgggtttgtcatgggcctggattttcctgggtttttatccagaaaaagcaagtccaactctgggtttcctggataatattttcgaatttgtttttttgagtaccacttttatggcaagttatcaaaaagattaaatatatttaaaaacaataataataataataataaatattctgggtttttgttcatgaaatccaggtccaggtccaggcttttttcaaaatgtcgagctctaatggatttatacggacaaaaactttaaccaaaccaaataatttaaacacaaaaaatcactttttaaatgcaaagaaaaaaaaagtatacaacttataaccgtcattatatgcttcatttcacaactaataaccgtcattatatgcttcatttcacaactaataaccgtcattatatgcttcatttcacaactaataaccgtcattatatgcttcatttcacaacttataaccctaatcattaaatgcttcattagttcatgtttttccgcgtgaatgtttacgaaaagtgcaaagttgggccgataaacaattttacggccctactgtaccaattaaaaatacagtatccatttgcgcatttccctttccttgggttaagcgagtaaattggccaattcgtgcaccgaaaactttgcaaatttccaatcagaatttttttcgctagaaaatgaatttttttctcattattgaaatatatttttgatatttctgaagtttatttaaaaaacaaaaattaaagaatttttcgtttttctaacaaaaaaattcattttaattttttgctttttgagaattcgagattttatttgaaactctaaagttttttttgtttttgtctacgagttgcctattatagctttgctttttgtctgagttgtcattccacctggccaaacgatgatagccatgcgaaagttgagaatttgctaatattattttatttttattttgagaatttgcaatttttgagaaaataaatatttgccaatttttttttaaatatgtagcaataaaaaattttctgaaaccaaaccccaaa

SEQ ID NO: 26668 - DNA, 2372 bp, Heterodera glycines
atttcaaattattaattttctaaattccacctttttggtgttccgcctcctgccaatgtaaacggtcgcttttccattgccaatcggacaaattttggcactaatttgttcctgaactgtcttggcccgtagacattgttcattcggaccataacataaggcactttgtaggaatgcttaatcaaacggaagcaatgatcccccaaaagtggttttgaacggtcggttaaatccaatagctgcgcaagagcagttcacacgcggctttgctgacagcgtacggattggtcggctccatcggactttgctcccttttcggctcttcggcgttcagacagtcgccatacacttcatctgcagttttaaaacaatggatgtttttttgtcatttcaaattgcgtaattgcgcctgtgctaatgtgcactaatttggccaactgtccgtggtctttcgccgcttccagcagtacggtcatcgctaccgtattttcctgcatgtattcggttgggttcgcgtacgattcgtccacgtgggtcaaagcggcgaaatggacaattgtgtcgatctgaaaagagtgaagtgccgcgctctctctctgatcagttcggtgtgatcggcagctgaaactgacccggtttctggttaaaatgtttcggacgagtgtcgcttccgtcagatttccttttacgaataaatagcggtccgaatttcgacatttcttttcgatgcgttcttccgaggcgcccggtgccattttgtccaaattcacgaacctttatttttgaaaatgattaaaggaaaataaaatgggccacactttgcttggggccatctgtcaaaagcgaaattcacaaaattggagccgatgaagccgcatccgccggtgatcagaacatttgcagggaaacattcagcggacaacgcatcattcatcatttgaatatttttaaaatataaaattaattaaataattttcaatgaataaaaatcgattaaattgggaaggactcggccgtaacattcgtttgggttgcgcacacacagcgaaattaaaggcaaattccgatatttaatttgttccaaatggagggagaaacttttgtacgtctcttcccaaatgacaaattgcgcataatttgctaattgggccggtaattgatcattctactccgatcattcattggcgggctaaagacagcacttttcattgtgccgaaaatgactcaaatgccctgtctcagtttaaattcgcttgtcgggtaattaattgttttattaaatgaaaacaaaaatagaaacaaaaacaaaaaagcaacataaatgaacagttaaatatttgttttttcattattttaatttataattcatgccctattcttttctcaactcggcactcgaatttcggacaatgaattgttatgcccatttcgcgtttgattgagggcaaaactttgccaaccgaaagctgaaaataaatgcaattaaattttaatatttttctttggttgttaaacgcactctgtactgattgagaatatttgcagtgaacaggaaaatttccattttggccattgattcggcaaaacattttctaaaattccaaaccatacaaagcaataaaattaattaatgatttttttaaattttaattattgtaattttaattattcattgaatttttcaaattttcttaccgccgtccaactgaaaatggaatcagtttttcgcatgtcacaaaattgccattttcgtccaaaaatctttcgggtcggaacattttcgggttatcaaatacctaaatttttaaaattttaaatgatttttgtctttctgttacttcgtcatcggccaaaaccaccgaaatttgtggcaaaatgcaagtgcccttgggaatttgaaagttgccaatggtcacgtcgacgaatacacgtcggtaggcattctgcacgatcatgttggaaatgcgcagaaactcctaaaagggaatggcacagtttggcttaaacaaataaaataataattattttattttttcattttaaattaattatttatttttgcttcctttccctttttaaatatttttgctgtaatatttatttatttatttttgtcatttccgtcacatttatcgttgcgtttgtgtaaggcagccgcgctttgtcccccgcgttgatcagtcgccgttcgtcgcccatcactttgtccaattcgtcgtacactcgcgtcaaactctgcgggttgttcagcaagtgcgccatgccccaggcgatgattgtactgctcgtttcctaaggcatttccgaatttggcatcagtcaaattgcattttcatggcatgcacttcgcatttctataatttaattaaatt

SEQ ID NO: 26669 - DNA, 1284 bp, Heterodera glycines
  misc_feature (143)..(143): n is a, c, g, or t
tttattttcatgataaaattttaaagattttggtttggatttttcatgactgggactcggtttaaaaactaggactctgacccggctttctgtacccggcaataccctgacccggtatttgcctaaatacccaggcccgtacncctaatttaatatacgattttgaagttttttaaattaaaaaataaggctacagaaaaaaattgaaaaactctcgtcctctcgcctctcgccaactctcgtgtttttggggactctcgcctctcgccaaactctcgctctcgtgtttttggggactctcgcctctcgccaaactctcgctctcgtctttttggggactctcgcctctcgccaaactctcgctctcgtcttttctgagacaagtcacacccctgctgtgcagcagcactgtgtgtgggaaaagggaagaagtgagaaaaataaagaaggaaatagtgcactgtctgactgtctgtctacgcttttgaaaaatttgaccaaaatataggacccaaactagaggagtaccaaaaattctgggctgctgtagaacataaaaggtaactcgcccggtgggactcgaacccacgaccccagcaatccgtgccgtgctctaaccaactgagctacggacgcctcttttaggggttctctcaggtcctttatcccactttctcccacactccgttccttctggcatcacacttcaaatattttccattatacccaacaattcaacccctttaccagtatgaataatgccggaattcactgtgccgtcggttcccccctctgttaccaattgacgcgcgttcttctcaactctttgctgtgcaaagaacgtgtctccttctccaaacagcacaaaaaagttcaaaaatttcctttgccattttaaaattttgttgtaaatttcctacataatcctcggatttaagcaccgcaacttttccgagcgcaatcgccaaatccgatggattctctccgtgggccggcgctgggccctcgggctgaacacgctgggcttgtcaatcgcaattttggacagagtgttggaccgactcaaagtgcagggaaagtgcgttttttttctttgggacgggggaaagaaaggcgctattataatttacgcgtcaagttaaatgtataattttgaaaggagcatcaaattaaacattcttacaattattagcattcgatagctctaagaattttttattcgtttataaaactaaaaaattagcttttcacacttttttgccataagaatcttgtttttttcaa

SEQ ID NO: 26670 - DNA, 2113 bp, Heterodera glycines
ttaattgattaaattttgccatttataggaggaactcagcactcccgtatcctactacagttttgcaccatggagtgatcgatcagagctgagagcacgcatcaaattgctcgatggggacaccacacatttcaacatttatttgctccacgacgccattgaacctgtcaaaaactgtaaaagcgcattttggatacgatggttgggtattttaataaattttagtgggcgctaccgtaatgcaactggaggtgaccgtatccaaagagaatgtgtcgacaatcgaattcagcgaattttatgtaggaattattctaattaagaaaaatgttggtctccatttccaaattctaaccagttattttaaccatcgaatccaatccggaaaatcccggccaaatggttcgtttttaaaattaagatccccgacaccaatcctagatttttcaagatttccagttttgaaatacgagtccttttttcatttttttttggcatcttgctctcgggttatcgtttttggaaaatgaaactaaattttaaaaatcttgaaattattcgatagccctaaatgttttctattatcctgtaaaatttcaaaaaaaaaaattcgttaattttcaaaaagttatgacctgtgaaattcaaatttttttttgtgttgaacatttttggtcataactttcttgaaatttaaagaaattttttgaaattttttaagatcatagaaaacaagttttttagggctaacaaaatgctatcaagaatttatcaatttgattgcttttgttaaatcaaaatttccataattatttttgcgtcaggcatttccatcaaaatgcccccctcaaattgactttttgccttaaaattttttacaaattttagaaaaacgacaaaagacccttcgacatatacagcaaaatgatcgaaacccagttcaatgcatttctcaacaaagaacagcagcgcgcatttgaatttaaaattaaattgagcggacggacgtgcactttgagtataaatggtgtcaaattgtccaacaatcagtttcggcaacttccagcttgggccacaaattacattcgggtgggtgtgtatgtacagctgttggccaattccaattagatgttttcggaagccaaaaaaaattccgaaatttaagcatccaaattagggtggcaacaacccttgcgcggagggggagggggaaggagacagacggcattctcgaaattttgcccacgtaaacaaagttttacccttttttgccgacccaggtcggttacgaaaaactggtggcactggcgaaattttcaaataaaattttcaccgcttttttccgaatattttttgaaaaaatcgctctaaaatttgaaattattctttcttcgaattttttttttcttggcggtgtttcgggcattttggggttcatcgttatattcattccttattaatttacaatttatttagctcgagggaaatgtgtcaacattggattaccttgaatattattataaagatgaggcacgctataaaactgataagaaaataaattctgttttaaattgttattttaaaacaattaattaataatggctattaaatataattttttttttaaattttaaacatacttaaacatttagctgaaaggcggatggaaacggcacgagaagaaggccaagattgatcctaatgcggtaaaaataatatacaaagcaatgtaaaaaaaaaaaaatgtcaaaaataaatgtatcggcagaaaaaccctaagaaggaattaacaaattaaccgtatgattgatgacttacccccaacccccccaaatgggttataattagggtcgttacgtttaatgacgaaaaatctcgaaatatttaactaaaatagtgacgataaagtgccaaaatagtgaaaaaaagtccgaaatagtgacataattttcagccaaaaatcgagcaaaaaataatttttatttactgattgcagttgcaaatgaagtaaatttcctttctaatcttttcttagcaaatattgatatttttaacccaaaattttgtcaagaaaaaaaatttgagggatgagtttttgagaaaattttctaaa

SEQ ID NO: 26671 - DNA, 1703 bp, Heterodera glycines
  misc_feature (1567)..(1567): n is a, c, g, or t
  misc_feature (1608)..(1608): n is a, c, g, or t
  misc_feature (1651)..(1651): n is a, c, g, or t
aaaagcaaaaaaaaatttctttaattaattgttttgcagacacattagccatcgaatactaatccaagaaaaatatccccgacccagactctcatcacttaaaattgattaaaggtgcgccagcactgtcggccgaaaattcccaaaaagttccaaattggggccaaaaataatattttacccggtggcgcaaaaattaaaaatttttggcaaaaattgaccctgagccccaaccccggtcggttgggttcacccccaccccacgtatcgcccccgacaaattgcgttcttccactccaaagcctcgggacgcaacccttttatgaattaaagcagaaaccttttgaaaaaaaacaaaacacgaaaaaatatggcactaaataaaaggtgaaaaactgaaattaccaaaaagaaagaaaaagtaataagtaaattagacttacccatacgtcacggcatgtcttcaataagtcgtcttgcaggttccaaaggcattcatttaatgcctaaatcatataaaaaatatatttatataattaataagcaatttattcttttttaaacattgattaaagaccgtttctttttcttcatccaatctttcaagactgcgaagaacttcaagtctctttataaactccaatcgttgcttgacatcttttttgttggcatttgcaaaaaggtcagcctccattttatttatttcctcattttttgtacctgattggacaatggactgaaaataatgaaaataattattcagaaatttatatctatttaaattgttttattaattttaaacatacttttgttattttatttttttaataaattttgataataaagagcgaattaaattcaaatttatgaaaaaagcataacaaaaaaaattaaaaattggcaaataatatataagggtttattaaatttacaaacaaattcttgattaaaattttaatttattaaattaccaaatttatcgtccttgccgcctcatcatatttatcaattttgtaaaaataattggctttttgatacagaattcgtcgttcattgaccattttatttatgtgattctgacaataattaattataaaatcattcctgcacacaaaaaatatttatcaagggcatataacctatatacttgaaaagctgaatttcgtgttttctcattgctatttttctgcaagtcatatttgctttcttctttatttataaattcacaagactttaagccttcgtttaacaccaagaaattagtcaatgaacagattaaaaaaacttatggcctaacaaaactgagaatgatcagtgattgaacgaaagcatatactgcagtacagccccaaaaaaatctcaaaaatactttttttctaaaatatgtacgttttcaataaatccttggttttgctggcaccagcggtgccgaaaggtgtcactggggaaaattctaaaattaaaaaggcccatggttgcacattttgcattaaatgcactttaccgtaattaattgaaaaataatggaacgaattattttgcatttttaagtttaccgccaatttanaaaaaattagcaatttaaatttggtatgaaaaagccactgngccaaaaacatagctgcactaaagatcatatgaattatatgcnccattcttagctgtaagtgattaataaatgaggcttgcagcattttgttgct

SEQ ID NO: 26672 - DNA, 1286 bp, Heterodera glycines
  misc_feature (1189)..(1189): n is a, c, g, or t
  misc_feature (1239)..(1239): n is a, c, g, or t
  misc_feature (1247)..(1248): n is a, c, g, or t
  misc_feature (1259)..(1259): n is a, c, g, or t
  misc_feature (1266)..(1266): n is a, c, g, or t
agcaaaaaaataaatttattctaaactatttaattacattcaaatcaaacaaatgattttctgataatattcatcggcgggtggactttgtttagccgattttttatgcgttttttgatcggttccatccaaactttgatcaatgctttacggaacaatgagctaaataaaataaagcaaaatttagagatttgattggattaaatggaattaaacctggcaagtgcataaattatgaaatttgttgaaaaattaaagcaatagagaaaaaaggaaatggaataaaaggcgtaatatttttggtaaagtgagtcattagtgacggaggcgagcacaaatttgagaacactgcgcacattaaaaggcaaattgaaagccacgaaaacaattgggatgaagaagaggacgacattgttgcatttgatgtcagcggaagaggaagaagaagaagaagaggaggaggaggaggaagagcctaattagtgggagaaaatttagaaataatttttaaaaattggcacagataatttaggaggggtaattttagaaaataaatgaggtaaattatggagtatattaaagagacaattaaatatcaaattgattaatcaataaggaggaggaagagcctaattagtgggagaaaatttgaaaaattaaaaaaaatcacaaaataaattaggagggggtaatcttttagaaaatcgacaaggtaaattttgattgaattaaagaaacaattaaattcattcatcaattaatccattaattattaattaatttattaattcatctattaacaattagtgaataaaaataaatcttaattaataaggattaattgattgaaagtttcaaagtgtttcaatttgctcacactgaccttgaatgatgttcagagagcgaactttgaaggcaattgccaggttggcaatcagaataattgtaaccggcaaaacaaaagtaaaaattaatcggggccaataaaacaaaaactaaaacaaaaataataaattaaaataaattaaattttcaatgtttaatacaataatatatttacataagcggatgaatttttgtagtcgtaaacgcatttcacattgtcaccaaaggacgattggacaagaattgtgtagggatcactttcagtgtttttgagggcgaagaacaaaacattggcattcagaanaagggtgggcaccaaccaacaaatgatcaatttccatctgccgctgtttngatactannacataacattntaaatanatgaataaatggaggaaatt

SEQ ID NO: 26673 - DNA, 2217 bp, Heterodera glycines
ttcttatcggccggcgaattctcctgaacagctgagacaaaaatgcccgactgattgcctccgatcacgcggatgccaagtccatgggagcctttgtggaaagtaatcgaatgcatttcacggggctttctctgctgaaaggtcgaaacggagacggactgatgggaagcgacgaattgctgctgttgttggaagtcgagcattctgaagagacaaattaatatgtaaatgccaaatcaaaagtcaatggaatccgtgtttttgattggtcacttgttcgaaattgctaaaaatggcacagaatgccctcctctcccctcctttcctccgtttggttttcttggccaacctttgcctttggtcggccaaaaatcgctggtgttgctcataagaatgtgttgctgtttggttgaattgcgtttgttgctgctgttgttgttggatggtggcgttgttcatcgaatggacggaagacggcgtttgggagagggggcggacggaaggggcgggcgacggatgggcggaaaggcgctgagagtgtgccaaatagggcgattggtgctggaagaattaagtttattatgcaaatgttaaatggactgatcagattaaaaagagcgataaaatggacagatcagaggaggccaaaaatagaagtgaaagatcgcttgttctgaccaatttgatcagacccgaattaattggattcggtgtgaacagttgaacaattttaatgataaaaaaaaaattgccgagcaaatgctcaacttttttttgtttctttgctgggatgtaacaattgatcagatgaatgttctgatcagttcgtgtctcatgttctctctttctctcacctgacatgagtaatttggctgtgtctgcgccggcggcgtgtaattaccaccagaattggtcattgggtcggagtaccttttggcaaacattgaattgtccaaatttatctcagcaaaccgtttgaagccaggcaagcagttctctgagccggcggaacatttgcgggcaattgcccctgtcggaggggcgaattggccgtcggcggatgagtgggcgtaatggacgggggtgggcgactggcggggcgtcgcctgcacactgcccaaacgttcgtacacctttttaggtggaattgtcaataattttttgtggggatggcgttgtgccgtggcacgcgaattttaaatcagaatgggttcgcaattcgcattggcattttccaatgactgaccgtcgtttggctcggccaacgcgacccgcccgccgtccctctgcgcacgtcccgctgcacaaccaaagacagtttctcgcgcgaccgctgcaacagtcgcgcggcttcgtccaaagtgaatccgtccagtgtctgtccgtttatcctcaaaaccgtgtcgccctccttcagtcccggctctttctccgccaatttcgggttcaaaatctctttgatgaagaagcgacagcccaaaacgatgccgaagtcatcctttttgcgcgacttggacagagtgaatttcagcgttcgctgttcaaactccacaaaaggcactggcactcgtcgcttcacaaccttcagaaaggggaccgattttattcatccgcaattgtcttcttggccaattctgctgaccatgttaagttgctgtgcgtctttcatcaccgccacggcacttgcgtaattcgcgtgttcgagtgggtagccgttgacggagatgatccgatcgccgacttggagcagaccgaaggccggacccgattttatgacgtcactgacgagaatggcactttccttgggaccacccgaaattgcgatgccgaaaccactttgagaagcctgcgaggtggaatatcagtgtaaatgaattacggagaaggagcagacaaagaagtggatgaggagaggagggaaagtgatcggaaagcaaattgatcggaacaaagggacgaattgcttaggaacaacaatcggcaacactccgccgatcgttcgttgtccgactcccccggggcatcagttggccaaagagaggccggaagaagcggaggaatgaatgactgaagagtgaatgaccaggtggccagccgatcagccaataatggggattaaaggattaatggagagacggattgagagaaagcgaagcgaaaatgggaagaatgaatgttgtgattaagaggatgaggtggaaaaagggaggggggagt

SEQ ID NO: 26674 - DNA, 1626 bp, Heterodera glycines
  misc_feature (14)..(14): n is a, c, g, or t
agacgtaatacacnggggaatattgtaaatttgcacaaaaatatagttcaagattataaaatttatttcataaagaaggtatagataattttaaattatagcttttatattatccttgcaataaatttatacattttccgtctagtgaatcgtgatcagatagctaaactatggagttattctcaaactaaaatcgaaaattttaatcaaacaatctaatatcttgagaataattccagaatttttcagtctgattccgagtcactagaagcataatatatataacaatttgaaggataaaataaacatacaatttaaaaacacgtgctaaaattatcaaaaataataatctaaatgtttatcagaattttaggacattttcctatttgttctcagagaattacgattaattaaaaaaaaaataaaaataatacattaattaaaaaaatatttgaaaccatttaaaaatttactataattcttgagtgatttttcaatcttttatttttaagaaccgccccaaattgcgtttgtctttccgatggatcagagtgactaatatagaaagcaatttgtgggataactcaacaaattgattcgaaattgtttaaattttgttgaaataatatagatattttttgcctatgttttagtaatttctcacatttttcacagagtgctccattgttaggccgttgtttattaggccttattttatttcttaaaatgaatatatcgggatagctgaataaaaaacaagacgaatttcaaaacgctttccaaataaattaaacgattttcttaacaatttcagataattgttgagaaaagtttgttcaaaaataatctgggatttagtctcaaaattaatcacatttatccatcgggaatactcaaggcaattggagtgatttttaaaagtaaaaaaatagaaaagctttaaggaattaatctcaaaattttatctggtttaatataattttcttcagggcatgacttatgttttttggtgattaagacgtaatacacggggaatattgtaaatttgcacaaaaatatagttcaagattataaaatttatttcataaagaaggtatagataattttaaattatagtttttatattatccttgcaataaatttatacattttccgtctagtgaatcgtgatcagatagctaaactatggagttattctcaaactaaaatcgaaaattttaatcaaacaatctaatattttgagaataattccagaatttttcagtctgattccgagtcactagaagcataatatatataacaatttgaaggataaaataaacatacaatttaaaaacacgtgctaaaattatcaaaaataataatctaaatgtttatcagaattttaggacattttcctatttgttctcagagaagtacgattaattaaataaaaaataaaaacaatgcgttaagtaaaaaaatatttgaaaccatttaaaaatttactttaattcttgagtaatttttcaatcttttatttttaagaaccgccccaaattgcgtttgtctttccgatggatcagagtgactaatatagaaaacaatttgtgggataactcaacaaattgattcgaaattgtttaa

SEQ ID NO: 26675 - DNA, 2213 bp, Heterodera glycines
  misc_feature (17)..(17): n is a, c, g, or t
  misc_feature (94)..(94): n is a, c, g, or t
agtaaataatacacaanaaaaagaataaaattaatataaattatgaaatattaatgaatacaaatttcagttggttatgctgatgaatggattngagacgggtaaattttatttttttaaaagttattaattgggcataattcccttaattgaggcttattgtccattaacggcgcagttttctgcacttatcctgacttgatttacacatccggatcagttggtttatgtaagaatttttggttaaatttcgatttttaaaaaattaaattcttttttagccctttggtacgcaggtatttaaaaatttaaataataatttttatttcgaaacttattttttgaaaccggagctgaacttttgctggctatcaaccgttgtctggagcttcttgctccaaaataaaaaactttattttaatttttatgaaatatataaacttttggcgaaaatccgtatttttctttcattttaggttttttaattcaacaaatcacacaaaaaatgcaaattgaaaactaaaaatattttgttcaaatgtgtgtcccagagaattcccaatttttatgcatttttgacgacttttttgattaaaaaaaaattattagaataatttagtggtccttataatgaattatttataattattttaatatttttcaaagcttaactttccgtttcaaaacaaaaatgaattaattatcttaattacctaattaattacccattttgaggcaatcgcacttggttgctgtgcattgtgccgaccgtttatgccattattttgtcattgtatacgacgcccattctgttctctgggctgtacatgtcgtggttcttcaacccatacgtcggttacgtggacgattttggcaaaattgtaaagattttcaacatattttccatttatcataccgtatcactttcgcaattacagtaccacagcccaatgcacacgtaggttttgattttgatctttttttaaaaaacatttgaaatgttcatatcgccaataattaaccaaactttgccagtgtataattatttttacaaaaacaaaattacagtatccatgacatgttcgtcatcttcggcttgtccgccatttacataacattttccgttttgcttatcatccagacacaatcctacaacaatgtacattaccaggccactctcgcccaaaaattggtcgaatttacgatttaaaaaatatgacaggcatttttagatgcttaaaatcccaaaaaattcaaaatatgcaaaaaccaaaaataccaaactaatattttagaaaatcattaaaactgtttttccacgcaattttcaaataaatttttcatcgattgcattttttaaatattttttaatttcttctaaaattttatagactttcctccaagttgtgctgatcagcttcttcaacggaatggctgctggcatttacatttacatgcagtcagtgcgtatcagcgatgcactgatcatcgccggaacatacgcatggcttttggcacacggtactcaaatggcagcttttcatttcttaaattaatattcaaaatgaaattaattaaataattttaagttaaaggaaggatacaatttttaaaaagaataatttttcctgaaggaatttctattacttcaaaataatttttttgccactatatttcccggttcgtgccaatagctctcactgagaccgaaaatcaaagaataggattagactagtcaaaattagcatatgagtagtgaaatttttttggtctaatttggactaaataaattctagttaaaatcttcaaaatttgacaatttacttagtataaggaagaagctggctgggcggttaaaacgtttaaagtggggttgataggatccataaaaaatggggatgtgcttggtagctcaatggttgagatgcccacggaaagagtgcacgagcgggttcgattaccacccgaggcttaacatttacctatttcttatgttaggtaacaaattgttatttttcaaattttggacatcagaatgttctattgtaatttgcgtgctgagccgaaccgaaaatggtctcagtagggacgaaccggaaatagtctcagtgtcaataaaatatttaaatttaatatacacttcaattcggtatcgaaaaataataaatttaaaaagatgtatttaaaaaaataaattaaaaaagaatattata

SEQ ID NO: 26676 - DNA, 1221 bp, Heterodera glycines
  misc_feature (32)..(32): n is a, c, g, or t
  misc_feature (38)..(39): n is a, c, g, or t
agatgcgtcacgtcaatcggctgctcggcatntgcagnnaacaaaagaaagtgcgggcggcgcattagtcaaaaatgatcagttgcgctgtgattttaagggaaaatgacaaaatttgagcgcatcgcttaaaaatgcaactcccaaaaaaaagacttttaaaaacccaacccccataagtttaatttttctgaaaaatttttaaatattttttttcgaatacaagccatcataacagatacagaaaaattggttaattttaagtacagtttgctctaaattcaaaaaaaattgcctagttttcgagttgaattggtaatttgaatattttatgcttatttcctgtctattttagggtggttttcttatgtttttttgcctatttcgctatttttgtgcctaaaatcacagcccttatgatcagtcattgttataatttgccatatttggcggttttttttaataaatttatttaataacaaagaaaacaaaaattttcacacgttttgccattctaaaatagcataacttaattaagttaaatgtcacaactttattttattcatgcgttctccccccccggcaattcttttttttgtttactccggccgctcgacttcaattgacaaaaatggaaattgcctctctggcacttcccacgccattcattccatcattctgaatttcggcaaatttgcgcatatgacaattaaatgttttccggcacaaaataacacacaaaaaatgccaaaagtgaaccccccccatcaattagagaagcgaaaaatgctggaaaaggggcagaaaagacgaaggaaacaattaacattagcagggaccaaatttaatgggtttataattgtatggttttcttaatttaataattttttacgtggttccaaattgccaaatagtcttagattatgccatgacatttattcttcgccataatggtaattttgcattaatataaatttaactttaataagttagtctaaaaaatgcccaaattcgtgataatattgcatacaataatcatttatataataaaagtaaattatttaaaaagaatttaactttttttaaattttaaataaattcgctttattttgcattaatataattttttagaccgaactttaataagtttggctaacaaaatgctcaaattgctattaatatttcactgatgaaatcattaggattctaaatatttaattt

SEQ ID NO: 26677 - DNA, 1189 bp, Heterodera glycines
tctcattaagcgatttgtttcttatttaacttcgcactaatttcggagagtaatcattcaacagtttaaaaaaaagatacttagcaaaatgtgtttataaatttgtttgttttttagttggaaaagggaacttgggttctcttcacactgtccactcggacggcctttttgcattctgtcgaccgaaaattggttgaccgcgtgtccatcacagaccaacgtcgtgagacagcagttgacagtatgaacattcaggtttggtttgggggaagcaaatggactagcaattttatcgaatttgggaggggcaacaattcaatagtcgaaaaatttgttacttattacactcaaacagtcctttttcccttctcatccgtccgatgttctctcccttttcatgtgatggcattcgttcgctccttccgacggtacaacgattattatcgcattggcatggaccaactgatcggatgggttttggtgtcggaggattcatttgtccgaagggtcgtcctccaagaaaacctcgctgctcaagtaataagttcttaattagtttactaacttttcacatttctattacctcttgcttcagatgtccatcatcttcaaacatgactgtgtgcgtggcttcaattgggtggccgtctcggtgaacgaacgtcgtcaggaagggacggaatgttacagaaaggcgtgacttttcattgatttttcatagaatttcaaattcgtaaatgttgtaacaattttatttgttagcacagatcgatttcgacaattcttaattacaataatttatcttttcgacaattttatttgtttcagcttgagcttttgccccgttttatggacgacaatgcttcaatgcattacaactcccgcgaaaagcaattcgccacacgttaccaattgcaaaatccgctgccttcaatatttgtcgcggaatacggagattgtccgacaatgaaaaaagtagcaaaattgggcaatgtgcactaaaaagggaaggggtggtaatgtacaaaaattaaaagatgctggccgacgagtacgccttgggattgctctttggatttgagaaagactacgagagggacatcaacggagcagatatggtgatgaacggagggacggatgcaacacctccactgatctttattattaaacacttcgcatttaatttttg

SEQ ID NO: 26678 - DNA, 1271 bp, Heterodera glycines
cgtgccacacagacaaagcgaacgaaactcgattagactttatttttgtgatacaattgaatgatttgccccaatatgcccattctccgtcccatttagtggttatcattccctctagaagcctctgacgttggcacgaccaaaccgaacactgcgcagccgccgaaattgcgcattcaccgcgtgtttcgaagcgtggaaggcgtcgaaatcgtacgttcggcggagaaagaagcaaagaatggcctggccactgatttgatgagattgaccattagtttaagcaagggcatcatgtgcaaagcgaacgaacacaaaaaatgccaaaagattttttttgaaatcggccgtttttcagtcccaaaaagctaaaaattaaatgaaattaataaccgcatcaaacaacattcacttcttttccttgccaatccattcgcacatttccttttgttcagcgccaatgcgaaaccgtcgctgatccgcgccttgtggagcagtacctgaagatgcgcatgttgtgcagcagagaacaactttggcaattggccttcgatgacgtcgactcggagagggtttggcggggaattgcgacgcttttggcaatttgaagaatttttgaggatttccgcgcgatgagacgccggctgcagaagcgcttcaaatattatgagaagaagcaaaagttggaagagacggcggcacggaaaaaagcgacggcagcagagaaaagagcaagggaaacggaagaggagaagccggacgagacgaaaaaggttggaaaagagagaggaaagggagagtgtgggagagaaaaagaggaaatgggagggaaaaaggaagagggaaaggaaaagaaaaagagtaaatgggaaaaagggagaaaaaacggctaggaaaatgtgagggagggaaacgaaaaactagagggaaaacgaaaaagagagaggaaagggagagaaaaagaggaaatgccagggaaaaaggaagagggaaaggaaaagaaaaagagtaaatgggaaaaagggagaaaaaacggctaggaaaatgtgagggagggaaacgaaaaagagagaggaaaacgaaaaagagagaggaaagggagagaaaaagaggaaatgtcagggaaaaaggaagagggaaaggaaaagaaaaggaggtgaagggaggagatggaaagaagagaaagtaatgggaaataatttggactccaaaaaggagaaaaggaaataaatggccaaaaattggtggatttttgtcacaaaaaaaaagaa

SEQ ID NO: 26679 - DNA, 1407 bp, Heterodera glycines
tgtccgttccagcccgctgcccctcttttctttaaattgttaattgtttttgtgttcctttcctccttgccgcgcacaatttaaccgctaattcatcaaatcgcaacttttctctcccaatttcattacgatttttgccccgttcctcccgcccaaccgccgtaaaattgtttgtcactaattgcctcctctgttcatgtgtgcggtaaaaaacccaaaaattggtgtgatcaaagtactccattccctcccctcccaatttgtgatcgaaataccccatttttcaccatttctccaattgttgcccgtctctcatcatcccatttttcgcccaatttctgtccactttttcaatttttttatgtaattttgttaatatttaaatggcccaaacgaacccaaattcgcatttccattttccaattgcattttccccatcagagaattgtcccattgtgcggtgaataaataatttttatttgttctttgatcatccgggagcctccaatcccagcacactcctccccaatcaccgtccgaacaacaaagcacaacattgtgcactttgtctcttcaaagcgggatgggcaaaatgaggagtttgtggatcgcgatgatgcaaaatggaatatgaacaatatctttttgcaaccggccgaagtgaaaatgtgggcggtatgtcagtcataacagcaaattaatttatttttaattggaccatcgccagatttgtctgatttccggcggttcgcgtgacgaaaatacttctcagcaaatgatttggagtgagtgtcttttgttggtgtgaattgtcactgaaaaatgagcggcgcactgattagttggggtttttactgatcgctctctgctgatgatcatttccattccgatcaaccatctccttttttctttcttagtccatcattttaccgtactccccttctacagaaatttcatctgcgtgtatatggaaacatgccgtcgacatggcataaatatacacaatcctgatcaccaaaaaaaaatcggagcaaatgcaaccgatgtaagtgctcaaaaatgggcacgacgctatgattggaaaatttaaatttaaaggtggaaaaatttgtgatcgactgtaaaggggacaattacaaaataattatttttgtcacaagcgacggagtaaaattgcatggtaaaatttaatatatccctttgcaaagaaattccatttttagatataataaaatcttttgaacaaaaatatcaaattatcacacaagacgtaaaaatgtcgactgcttttaacatttcgtgccgaggaaaaaccgaaatagttgaaaatattgtggcaaagtcgaatgaaaaattgggcggcattaattattcagtaggtgtttacgaagggtgctttctatgacg

SEQ ID NO: 26680 - DNA, 1810 bp, Heterodera glycines
  misc_feature (798)..(798): n is a, c, g, or t
acagtggcgcccaaaatgcgcaaaacaaaaatataaaaatgaattaaaaagggggcaccgatcgatgcgtcggccgatcgttctttcgttcgttcgttttgtcctccgtcgccaccgtttggccattcaatcgctccctttttggccttcctttcgtatcatttctccaagggaatgaatgattcgtcgttgtcctccgatttggacgccctcctccgtctccaattccgcgtccgccaactccgtctcgacttggacgccttccgttcgcccattcgcgacaatcaaaatgcctttttcctcactttcatggctttgcttattttccgttcgtcccctccctcaaatttgcccattttgctcccatttccttcagttatgcagtgcggcttcgcctttctcgaggcgggcgcagtgcgtgccaaaaatgtgacgaatattttgacgaaagtgcgcactttgccaaaataaaaattaaaattcggcatttcccacttaatttggcccaaagaatgtgctcgactctctgatcaccatcgtctcctattggtctctcggctgggctttggcctacggtgccaaccccgtgaccattctcagccctttctttggcgcttcgcaattctttggccaacaaatctccgactttggccgtttcttcttccaatacgttttcgctgctcgcgcctccacaattatttctggcgctgttgctgagcgtgccgaattcactacctttttcgtgtattcactgctcgtcccaggtgacactttcttttgctaattaatgactaattntcgttccattttgccccccccccctcccccaggctttgctttccccgtccttgcccattggggttggtcttcggttggatggcttcacaaaggaataaccgttggtgaacacaattcattccatacaacttatctggtgatcccatagtaaaccaaccaaaatggcactttcccttaggacctcgccggtgccggcgttgtgcacctttgcggcggcacaatttcgctgatcgccgcttggatgatgggaccgcgaatcggacgcttttcgagtgagggacaaccatgcaaaatggaaggacattcagtaccggtgagcaaagagtgcaaattgacggaaaatgagtgccatggcattgccaatgccaatccaatggttcagttggcttcactcggcggcttcattctgatgctcggctttttggccttcaacggcggttcggtggcggacatttctctgccgggaaatggcctattggtggccaaggcgatgatcaacacgctgctttgtggtgcatttgccgcaatttgcactttgattatccacaaaattcgcaatgggaaatggacagttttgctgacgatgaacgcgtgtttggcggggatggtgggccgggggggggggaaagcatcgaataaatgccaaagccattggtcgaatgaatggcatccaaatgacccggcacttacggtcagaactgacacgaggaaacattgttcagattgccgcatgtgcaggatgcaatcagatggacgcgtggggcacaattgtgacgggggtcggcgccgggcttatttacatggcactttcaggacttatgctaaggcaagtaaatgcaaaaacatcaaaataatgactttttatatctctttgctccgtctctctctctctctctctctctcttttctccctctctctttccctttctctcattatctctcttttttctcttgcttttctctctctcatttttacactttgtctcttttttcattcattgtccgctcagat

SEQ ID NO: 26681 - DNA, 853 bp, Heterodera glycines
gagctttttgtggaacgcccacactgagctttttgtggaacgcccaactgagctttttttgtggaacgcccacactgagctttttttgtggaacgcccacactgagctttttttgtggaacgcccacactgagctttttttgtggaacgcccacactgagctttttttgtggaacgcccacactgagctttttttgtggaacgcccacactgagctttttttgtggaacgcccacactgagctttttgtggaacgcccacactgagctttttgtggaacgcccacactgagctttttttgtggaacgcccacactgagctttttttgtggaacgcccacactgagctttttttgtggaacgcccacactgagctttttttgtggaacgcccacactgagctttttttgtggaacgcccacactgagctttttttgtggaacgcccacactgagctttttgtggaacgcccacactgagctttttgtggaacgcccacactgagctttttgtggaacgcccacactgagctttttttgtggaacgcccacactgagctttttttgtggaacgcccacactgagctttttttgtggaacgcccacactgagctttttgtggaacgcccacactgagctttttttgtggaacgcccacactgagctttttgtggaacgcccacactgagctttttgtggaacgcccacactgagctttgtttgtggcacacccacactgagctttttttgtgtaacgccgacactgagctttttttggggaacgcccacactgagctttttttgtggaacgcccacactgagctttttttggggaacgcccacactggagtttttt

SEQ ID NO: 26682 - DNA, 1305 bp, Heterodera glycines
ttttccaaaattttttttggaaaaatgcgaggcaaaaaaattgtcaaaaacctgatttttcaattgcgattacattgaaatataggatttactacccaaaattgttaaaatcaacattggagatgaaaaatataaaatttgatcttattgattgataaaattgttacacaagcgatttaaagcaacttttgcaaaatgttctgattttcgacactaaaaactgattttttggcccggtgttctgatattctttgcatttttatgttttaaaaaatgaggatttcttgcggtattttagtggcaaatgataatattttatggctgaatttcaattataattttatatgctaatcacgaagataaagagtcaaatttctcaatttgcttctaatatttgcattattgaccaatttgacaaaaagtccaaaatagtgattgttttgtgacgaatagttacgttaaaaagaaaattctcaggcattgactatgcattccatttaaggattccaatccagataaattttaaattaacccactccctatcgtagcttttgtgctgattatggtcgtgtcgaaaatgcttatgaatcgcatcgtggacgccaatttgtgggagaattaataccaaaaaatggcaaattaaatcaaatgccatcatcatttaatccgccgtttttatctttcaattagtgagtagcaaattaggttttcattatttattgatttaaaaaagattcaatgaggtgctttcgaatgtccaaaatttgtgaatccgggttacgacaacaaaaaagctccaccacattccggaatttcaaatttattttttagttaagtctgagttttacggagttcgccaaaaaattgcacctcctacaattcacagccaaaaaaagtttctttgctgctcactaattttaattttaatatgcttaaattttaaatacgaattttctttgcgcaatatatttatatctttttcattttttcaataattttaccaattttttgaattttcaatgttattctaatgccttaattattaacttgataatctaaactataatatccattatttgcttgtattctatttttcaacttttttcaattaatatttggcatcattattatttccaaaatattataattgtaattttctcgtttttcatataaaagaagcattatttatgttaaaaagagcatttgaattattatttaaattttgctgtgataccaaatactgccaaaaacaaaaacaaaaaactaaaattttcctattccatcggttatacggcccgcctccct

SEQ ID NO: 26683 - DNA, 1919 bp, Heterodera glycines
  misc_feature (37)..(37): n is a, c, g, or t
  misc_feature (993)..(993): n is a, c, g, or t
ttctcacaataaaatgctcaaattatgtttctattgntatataatagtaaaaataaagcaaaaatttagcctcaaaaattgaaagaaattttagtccaacttttaaacattccaatcatcatcatcatcatatgcacagcacacttttctttctttccgtcattcattcattcattcgagtatttcaaagttttcatcgctgtcacaattgaagtcatagtctgaaaaagttaaaatctaaacagaattttatttgtttgtttaaatgtagcgaaaaaacaaatgagtaaaaccaagggtgtagccagacttgaaaaaactttctagtttttttttgaaaattagaaaatttcaaaaataaaaaaaaacgaaggggcatttttggatttctggctgatttttcacgaaaaaaggcgatttctggtgtcaaattttgaaaattttgggaattttattaaaatttcataggaaaacccggtataaaaatatttatatttttcactaaaaatttcatttttggaggctatagccccctcattggcagcccttcccttggctatgctcttgagcaaaaactaccttttatgtcgagtgaattgtcgagaaaaaatgcgctctcaaacggtgtgaatttaggccaacccttaggacgggagtcgagaatctcgaacagtggcggggatgagcttggcagaacgaccgtcttaaaaggaaaggatgatgtaaatttgcaaatcgcattttttgagaaatggcaccacaaattgatccctcaaagaaatttaaattacctaattaattgaaaaaaaaatttttttttttcaatttttggtttgaattcgggccaaggttgggaatcggtcggtgtcagattcgtgatcaaggcgaccccgaaaatgcccattccatttctttaaatgggggctacagaatttccgacaaagcacggtaccagcacaaagaattagtcatattcgcatattcgaaaccatnacatgtgcaaggggtgtctcgacaccccccccccccctcttcgttcgtcgtaagggggcggctgtaaaagagggagggggccgtcgtgggaacggggaagtcgtcgacgacgggggaaaaatttaaaatttgatcaattttcataaaaaaaattcaaaaaatttcccggcggcgcctatcggcaccgccggccccacccccctttcaaagttttttggaaaaaacgcgccgcaaaaaaaaagtagttaagcaacgaaaaaaggtaatcgccggagaaaaaatggaccaccttcgtatgaaaaatcggtcccgagacacccccccccagtcccaatcgtccgtcgtatggcccttgggctgagacaccccttgcacatgtatgttcgaaaccaattccctctttcttaacaattgggacggcggcggcattaccttaagccgatgcactaggtcctcgtactccgccaagtcgcgtgtcaaaaacccaagtgccaacgacggatctaaataattgtaagaaaaaagggtacacataacaaatttgaaaaaaaaaaattgtgtggcattcttctgaaacgaaccgagcgatttgaaatccatcgtcaaaatgtacgggcagtgaaatgagctgtcgtcaaatgcatcgctgctgctgttgttattatttttacattttgttgttgttgcttctttttcttctccttcttctgtctttgtttttgttggtgcatttgcaaaggttgaggctgaaaatgggacaaataaaattaaaaaaaattttttttttccttttgaccgatttttttgttttgttttttgcatagtcaccgctcccacccagaagagcccctcctccatactcgaaatttttaaggaaaaatagtgtttgtgatgaaaatttatttagttttacaaaaaaaaaaaaa

SEQ ID NO: 26684 - DNA, 1243 bp, Heterodera glycines
aatttaattgctttttaaattattttttattgatttcatttttgaattcgatttcaagcattattttggaagagaagactaacaataagcaaaacaaaaagaaaatcccaaaaagcaaagagtctaactcactaattcctcaagtaatgttaaattcactttaatggtttgtttttttaaatacattaaaatgtgatttcggtaaaatgttgggccctaatttcctcgtccactaatgtaatatacgcatggaataatgtcttttattccgaaggcggatatccataaggtataatatgctaacgtaatgaggtaaaggggaaagagagcccgatccgtacaggacagaaggggaggggatctgctggggtatctgtgatcagggttaaaagaatgaaaagaggtgatcgctaggggatgggccacattacgaaaaggggcggagctaaagttgatcagagtgatcagaggcactaacataaacagacagtcagaaaataagaaatgaaataattcagtcttttttgcaaacgaagagggtccaaggaaacagatttcgcagacaaagaattgtagaagaaacttaattttcaaaaatccagtcaggtcctctgaaaaagaacgaatttgacaaaatgctccaaaaagagctcacattaaaagtaaggaattttataaactagcggggtcagcgccttcggcgcatcccccgctaggtagtacgattgtattataggattatgaatgataaaatcgactggctcggccgcttcgcggcctcgcatccttttcttggctttttcttcaatcgccgggactcaacccaccagtatttcaatcactgggactcaacccaacagcatttcaatcgctgggactcaacccaacagcattctaatcactgggactcaacccaccagcattccaatcactggcactcaacccaccagcatttcaatcactgggactcaacccaccagcatttcaatcactgggactcaacccactagcatttcaatcactgggactcaacccaccaacatttcaatcaatgggactcaacccaacagcattctaatcactgggactcaacccaccacatttcaatcactgggactcaacccaccaacatttcaatcactgggactcaacccaacagcattcaaatcactgggactcaacccaccacatttcaatcactgggaatcaattctccagcatttcaatcaccgggactcaactc

SEQ ID NO: 26685 - DNA, 1753 bp, Heterodera glycines
tttttttttgtaaagtgtcagaaccagagaaaaagagatcaaactattcccggagtaggacaaaacgtcgtcgaacgaatttttcgaccataacttttttctttctcaaccaaattaaacattcttggtattattcgaaagcattcgaaaaatgctattatcctgcaaattttcaaaaatttttatttatgcacaaaaaaatcagagcaaaaaaagttcgaattactgggtttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcactgaactattcccccccccttttctctttttccatttgctcatccgaaaatttgggatttttttttgctgaaaatttacggatttttttgctttcttttcgcataccgttgatgggaagattgtatgtttgggttcgttgagaaaggggcgggggaggtgggcaagggattgaatcgcttcaatttatttgctcacccgcggaagtgccaattttcgcttttcctggatggattcaaatttaatgggttcggctgtttttttcctttctctcactcggtccctctctatatcactctctcaccctctcactctctatctgactctcttatgtctgtgccctctctctatttccccttttcttttcctcctcttcaaaactaacacactctctctctcccttttccgtcctaaagtctgaacaaatgctgaaaatggcttcaaatttgacaaatcagcagacgagcagcaagttcaccactttggccagcaccaacacgcgatgagaaaccttttgttcgagtcggaccaacttacggtattccgccgacttggcccccttaaagcggaaattcatttttgaaggcacaatgctacgcgaggagcaatgacccgtcgcccattgtttccgccgttcattcggtctgtccgagtccgttggatcagctgatcaaagtgagaagggacccaaaggggcgactgaatggccattttgttgatcgttcattggctcggatcgtctccattatttcaagtgtttgctttcacccattgaatctctttagctccaagaacgcctccaacaagccgacttctcatctcccgcttcgtcctcccccaaaatgccattgtccattgctccgttggccaaaactcctccagcgatttcttctctttgtcccacctcatttacagacactaaggttgttctgatgctaacaatcccattttttggcttcattcgcttttccaattccaattcagcggagtgtttcttctgccattggttcccaatcgtggctcgactcttcgtctctcgtcatttcaacgtacgcaaattccactcaattggcggcaccgatagccgctgccgcggtaacgccgtgggcaccgtccgcttggcaatggagcgcagccgccactgagacggccgcgctgcttaacggaacatatggaggaggaggaggagcagcagcagggacgacgacggcgacaagtttgacacagtcaaacggaggatggaatggtgcgtcgtattttggcaacacttttggaggtgggacaattcggaggagggaaaggcaaattaatgaataattgaaagaagtcgcttcatgg

SEQ ID NO: 26686 - DNA, 1384 bp, Heterodera glycines
aacctcaagaaaagggggggggggacagtaaaacaaaagtcattacagtggtcaatcactgacaaaaggcctcttctgacgtcattcgctcaacttcaatttgtccatcggaaatctgctgaagttcgttttcaattgcgcgctcatcgaatcggaatttgtcctcgggggaaacgatgaaaacgaccaaagcatccgcgtcaccaaatctgagcctgtaattaattatcttttatttttccattgaattttctttatttattcccttaccatccattgaaaagtccccgtgccattgtatttactgcccgattcggcggcacattcgacgcgtccatccccaacttttgcagcatttgccggtgcacttcggctgcccgtgggctcattgccacgcttcccaccatgccaatcgtcattccagtctgatgagcgacggattcacgaattgtttaattaattaacatattatttttattccaatattattgtccaagttggcatagttttgttaattcaataattgaattaattttctcaaataattttatttaataaataacagacatttgataggactcattaagacactgttgtcaattcgttaattaactaacattaatcacctgcttcagaccaaactgtcgctgctgtccattgggttgttccgttatgctattattatccatcacataatccttttgtggaaattgccggtccattttaaacattccgccaaattttaaaaacaactgaccgctcgtgtcaacagcagcgtgtacggctgctgatggccttctcgccggacttggtccataagtcccaccatccgttcgtacgttttattcgttttggccaattgttctgtcgcttttgccagaaattcatagtcacaagaaacgcgaaagaacagcttttgcattccctaaaacacaaataataattattattttatgtttaatttgaattttgaagtcgcactttgtgcacggcgatcgcccggtggaaaagcgaacgagggaatggggacgggaacagactgaacggctgaatggatgccaaatcggtggtccttctgaagtaaatcgggcatttgtttggacaaccaaataccccgtgtttgtgccgcttacctttggcgcgactcgtcgtccgacaatcgtttgatcagtccgaactcgtgggccaagtcgaccgccgcctccaccaactcggccaattcctcttcgcttttcaccgcttcggccgcgtaatttctgatgagttctgcaaaattgtaagagcaattcaattcaaatgctgttgttgttcatttcattttcatgtgcaatcatctaatattaattatggtgccttattagatttggtgctttcgtgctttgct

SEQ ID NO: 26687 - DNA, 1524 bp, Heterodera glycines
aatttcgaatcaatttgttgagttatcccacaaattgctttctatattagtcactctgatccatcggaaagacaaacgcaatttggggcggttcttaaaaataaaagattgaaaaatcactcaagaattatagtaaatttttaaatggtttcaaatatttttttacttaacgcattgtttttattttttatttaattaatcgtacttctctgagaacaaataggaaaatgtcctaaaattctgataaacatttagattattatttttgataattttagcacgtgtttttaaattgtatgtttattttatccttcaaattgttatatatattatgcttctagtgactcggaatcagactgaaaaattctggaattattctcaagatattagattgtttgattaaaattttcgattttagtttgagaataactccatagtttagctatctgatcacgattcactagacggaaaatgtataaatttattgcaaggataatataaaagctataatttaaaattatctataccttctttatgaaataaattttataatcttgaactatatttttgtgcaaatttacaatattccccgtgtattacgtcttaatcaccaaaaaacataagtcatgccctgaagaaaattatattaaaccagataaaattttgagattaattccttaaagcttttctatttttttacttttaaaaatcactccaattgccttgagtattcccgatggataaatgtgattaattttgagactaaatcccagattatttttgaacaaacatttctcaacaattatctgaaattgttaagaaaatcgtttaatttatttggaaagcgttttgaaattcgtcttgttttttattcagctatcccgatatattcattttaagaaataaaataaggcctaataaacggcctaacaatggagcactctgtgaaaaatgtgagaaattactaaaacataggcaaaaaaatatctatattatttcaacaaagtttagacaatttcgaatcaatttgttgagttatcccacaaattgctttctatattagtcactctgatccatcggaaagacaaacgcaatttggggcggttcttaaaaataaaagattgaaaaatcactcaagaattatagtaaatttttaaatggtttcaaatatttttttacttaacgcattgtttttattttttgtttaattaatcgtacttctctgagaacaaatagggaaatgtcctaaaattctgataaatatttagatttttatttttgaaaattttacctcgtgtttttaaattgtatgtttattttatccttcaaattgttaaatatattatgcttctagtgactcggaatcagaaataaaaattctggaattattctaaagatattagattgtttgattaaaattatccgattttagtttcagaataactccataatttggctatctgatcacgattcactagacgaaaagtgtataaatttattgcaaggataatataaaagctataa

SEQ ID NO: 26688 - DNA, 1855 bp, Heterodera glycines
  misc_feature (1140)..(1141): n is a, c, g, or t
  misc_feature (1183)..(1183): n is a, c, g, or t
gtgactaaattgggagcagtccccccccccgtttcattgtttcgccgcaaaaaaataaaataaaaaggaaatttttcaaggaaaaaaattatgcttgaaatttgttttaatttcaggcgggggaggggggaattgtagtgcacccgagtaaactatatattctaaaccaaaattaagtagggtgagggggctttcgccattcacttacagtagacttgatggaaatggtcctcacttagggacggttggtccaaggcattgtaaaaatggtttttgagcaaatcgtcgaaaagtaattcctaagtaaaagcttatttatcacatatgttttaactcataatatttgctttttcttcttctttcaccttgcacaacgctgtgatggtaatgccacaaattgcaaatggaaatctattaattaaaatttgaatttattttcattacttgagtaacagccgaacaaccaacccaatgatcgggtggttggacaacgaaaggacgcgctgacaattgtccaaatcgaactgggcgaagaataccaattggtcaaggccgagcatacccatgccacggaagtccgtctttctcaacaacacaaataaataaagcatttcggaattatatgtataaatcgtcctcaaaaaggaattttatggattaaaattttcaaattttgaaggcaatgtcccaaaattgaaccaaaaacgagggttttcataaataatggattttgaagaccatttaaagtgagggaattgcgcttttaccgccgggtcgtccccctggaagccgatctgttgccattggtccgttattcggccctccagcgcctcttccggcttcagcaacttccacagtctcagcagctcccactcgtgttccgaacagttggcgcagtaactctccagccgtcgctcctccaccttcacacaaagcttttgatagcctttgatctgcggcaaggaatgggccaatgtcttcgatagtcccaacgtttgtcgtcctcggcgaccgattcctccaaaatggcctccgccgcctcagtttcatcccctgaacaaatgaacacgttcaatagacactaaaaagggagtgcctttgtctgttgtaatattatttgcctttcattccattgctgcnnttaagatttgtggttgcggggcacccgctgtgaaagtcttcnatccaatttttcttggtttgtctcatttggaggatgggatacaactcctcgtacacttgcctgagcaaacccctgtccctttgctaatgcacccaccggtgtcccaactaaacgattggacgagttcgttcggataagtgcgcagaatttgttcaattttctgattgcgagatgccttggaaggcttcttttcagtcaacttaaaattagtatggtcaaaaaatgaaagtttgtccaactcacaatgtcttccaatttttggttggcgaaaattcggttgattaaagtgcagaaaaagcgccaaactgagcgaaaaaatgaataaataagtgacaaacacatggcaaaaaaataaaataaaaatagaattatgcagagaaatgggtaaaaaataaactgaaagaaaacagaaaaacagagaagaaaagagccaacgaaacccatttatgcaaaacattattaaacgaaaataaattaacagaaaaacgaataaacggtcagttaaatttagaatgacttttatattcccatcctttcacattggtttatccgataaagttgacgaccaccaaatggagaattacatgggcgaagatgaaatcggcaaaggccctctcgggagaaatgttggggaattcgaccttgttttccgggttcacttggatgcgcaaa

SEQ ID NO: 26689 - DNA, 1457 bp, Heterodera glycines
ttttagttatttgtgactttgagaaagccgaaatgaacgccctgtccgcagttttcccagccacaaacatcctttgctgcatgttccactacggacaaaacctctaccgcaaaatgaaggggctcaaactggtgcaaatgtatggggaacagtctgtgcgtggtgaagcggtccgacactcattcaggtaacaattctaaaaattgacccaacatcccaaatttttcagaaatgtcctatctttgccattgttgccaccaacttacgtcagacgagcattcagcgtcattgccggcacagcccctatggagatggcgcagtttcttctttactttgcgaggaactacatcggaatgacgcagcgccagctgcttgacggcgccaacgcgttcggagttcgtcctggtggcatttctccacgtttttcgtgttttttttacatttactctttttattttcttttatttgcatttaagcattcgcggggacatcattttcttctgttgaatccgaccacacatactcacggcagcccttgaaatttggctttgactcgcccgccccctcaacactatcatgccttcaacagtggagcaaaactcgccgttggtgcagtactcattgagtccatcgtcaacgactacatttcagccaggcacaccaaaacacaaaattattcatgtcaaaacattttaagcccgtccttgggaagaacccgtagtccgtcgcgcactatttccaattccattttggaacgtgcactctcatgcggcttccgccctcgcaaggaccaacaacggactcgaagcaacacaccttcatttctctgtatttattacttataaaacccccaatttaaataattttagaagggtctttgtcatcacccagccctttccgatttcatttctgaagtcagcggaagcatcgacagacaagttgacgcagcgaggtcagctcggaacttcatacacaaacgctacgtgctgcaggacgcagtcatcatgagaattttggcggatgcaacatacaacgacgatgccgaaattcacgatgttatgacggctcttggtctgcaggtcgaaggatatgcaggaaaattgaaggactacgaaaacacggaagattcaatcatgaatttcgcttagatttgttcgatcccaatttttacccttttttatttattcattttttgaaatattcctttttcctgcaaaatttattatttttgttatttgtttatgctattctgataaatcgttaatgaattatgtgttctgaagccttaaaaatgtaattttccgactttttcactaattttttagcttggcgacattttgactcattttagcttgggcgacatttcgacgcggcgacatttcgacgcggcgacaattcgacgcggcgacattttacgcagcgacattatgacgcggcgacattttgacagcgcgccc
